(12) United States Patent
Kastelein et al.

(10) Patent No.: US 11,873,349 B1
(45) Date of Patent: Jan. 16, 2024

(54) COMPOSITIONS AND METHODS RELATED TO IL27 RECEPTOR BINDING

(71) Applicant: Synthekine, Inc., Menlo Park, CA (US)

(72) Inventors: Robert Kastelein, Menlo Park, CA (US); Patrick Lupardus, Menlo Park, CA (US); Deepti Rokkam, Menlo Park, CA (US)

(73) Assignee: Synthekine, Inc., Menlo Park, CA (US)

( * ) Notice: Subject to any disclaimer, the term of this patent is extended or adjusted under 35 U.S.C. 154(b) by 5 days.

(21) Appl. No.: 18/164,386

(22) Filed: Feb. 3, 2023

Related U.S. Application Data

(63) Continuation of application No. PCT/US2021/044577, filed on Aug. 4, 2021.

(60) Provisional application No. 63/135,884, filed on Jan. 11, 2021, provisional application No. 63/078,745, filed on Sep. 15, 2020, provisional application No. 63/061,562, filed on Aug. 5, 2020.

(51) Int. Cl.
*C07K 16/46* (2006.01)
*C12N 15/63* (2006.01)
*A61P 37/02* (2006.01)

(52) U.S. Cl.
CPC ............ *C07K 16/468* (2013.01); *A61P 37/02* (2018.01); *C12N 15/63* (2013.01); *C07K 2317/31* (2013.01); *C07K 2317/565* (2013.01); *C07K 2317/569* (2013.01)

(58) Field of Classification Search
CPC .............. C07K 16/468; C07K 2317/31; C07K 2317/565; C07K 2317/569
USPC .......................................... 424/133.1, 136.1
See application file for complete search history.

(56) References Cited

U.S. PATENT DOCUMENTS

| | | | |
|---|---|---|---|
| 8,258,268 B2 | 9/2012 | Wu et al. | |
| 8,921,528 B2 | 12/2014 | Holt et al. | |
| 8,975,382 B2 | 3/2015 | Revets et al. | |
| 9,334,331 B2* | 5/2016 | Igawa | A61P 7/00 |
| 10,421,807 B2* | 9/2019 | Gonzales | A61P 11/00 |
| 10,927,186 B2 | 2/2021 | Roobrouck et al. | |
| 2006/0024295 A1 | 2/2006 | Brunetta | |
| 2010/0297127 A1 | 11/2010 | Ghilardi et al. | |
| 2011/0028695 A1 | 2/2011 | Revets et al. | |
| 2011/0053865 A1 | 3/2011 | Saunders et al. | |
| 2011/0142831 A1 | 6/2011 | Cua et al. | |
| 2012/0201746 A1 | 8/2012 | Liu et al. | |
| 2012/0316324 A1 | 12/2012 | Adams et al. | |
| 2013/0189262 A1 | 7/2013 | Wong et al. | |
| 2014/0065142 A1 | 3/2014 | Roschke et al. | |
| 2015/0079088 A1 | 3/2015 | Lowman et al. | |
| 2016/0046730 A1 | 2/2016 | Ghayur et al. | |
| 2016/0251440 A1 | 9/2016 | Roobrouck et al. | |
| 2017/0106051 A1 | 4/2017 | Oh et al. | |
| 2017/0298149 A1 | 10/2017 | Baeuerle et al. | |
| 2018/0362655 A1 | 12/2018 | Wang et al. | |
| 2019/0185562 A1 | 6/2019 | Gromada et al. | |
| 2019/0352404 A1 | 11/2019 | Xu et al. | |
| 2019/0382500 A1 | 12/2019 | Abujoub et al. | |
| 2020/0016202 A1* | 1/2020 | Kuchroo | G01N 33/563 |
| 2020/0157237 A1 | 5/2020 | Regev et al. | |

FOREIGN PATENT DOCUMENTS

| | | |
|---|---|---|
| CN | 111018985 A | 6/2019 |
| WO | 2008/011081 A2 | 1/2008 |
| WO | 2009/068631 A1 | 6/2009 |
| WO | 2013/006544 A1 | 1/2013 |
| WO | 2013/059299 A1 | 4/2013 |
| WO | 2015/142675 A2 | 9/2015 |
| WO | 2016/097313 A1 | 6/2016 |
| WO | 2017/198212 A1 | 11/2017 |
| WO | 2019/129221 A1 | 7/2019 |
| WO | 2019/242632 A1 | 12/2019 |
| WO | 2020/144164 A1 | 7/2020 |
| WO | 2020/187711 A1 | 9/2020 |
| WO | WO 2022031871 * | 2/2022 |
| WO | WO 2022055641 * | 3/2022 |

OTHER PUBLICATIONS

Edwards et al. (2003, JMB 334:103-118).*
Lloyd et al. (2009, Protein Engineering, Eng. Design & Selection 22(3): 159-168).*
Goel et al. (2004, J. Immunol. 173: 7358-7367).*
Khan et al. (2014, J. Immunol. 192: 5398-5405).*
Poosarla et al. (2017, Biotechn. Bioeng. 114(6): 1331 -1342).*
Vajda et al., (Current Opinion in Structural Biology, 67 pp. 226-231).*
Marks et al., (J. Biol. Chem. 295(29) 9823-9837 (2020)).*
Akbar et al., (Cell Reports 34, 108856, Mar. 16, 2021).*
Lo et al., (BMC Genomics vol. 22, Article No. 116 (2021)).*
Cairo, et al. "Control of multivalent interactions by binding epitope density." Journal of the American Chemical Society 124, No. 8 (2002): 1615-1619.
Fan, et al. "Bispecific antibodies and their applications." Journal of hematology & oncology 8 (2015): 1-14.
Heldin, Carl-Henrik. "Dimerization of cell surface receptors in signal transduction." Cell 80, No. 2 (1995): 213-223.
Holliger, et al. ""Diabodies": small bivalent and bispecific antibody fragments." Proceedings of the National Academy of Sciences 90, No. 14 (1993): 6444-6448.
Nie, et al. "Biology drives the discovery of bispecific antibodies as innovative therapeutics." Antibody therapeutics 3, No. 1 (2020): 18-62.
Saerens, et al. "Single-domain antibodies as building blocks for novel therapeutics." Current opinion in pharmacology 8, No. 5 (2008): 600-608.
Shahangain et al., VVH Against VEGF-RBD, Genbank entry (online) National Center for Biotechnology Information, 12 May 215, retrieved from the internet www.ncbi.nlm.nih.gov/protein/BAR73350.1, 2 pages.
International Search Report in PCT/US2021/044577, dated Dec. 9, 2021, 10 pages.

(Continued)

*Primary Examiner* — Lynn A Bristol
(74) *Attorney, Agent, or Firm* — Kilpatrick Townsend & Stockton LLP

(57) ABSTRACT

Provided herein are IL27R binding proteins that bind to IL27Rα and gp130 and comprise an anti-IL27Rα $V_HH$ antibody and an anti-gp130 $V_HH$ antibody.

6 Claims, 4 Drawing Sheets

Specification includes a Sequence Listing.

(56) References Cited

OTHER PUBLICATIONS

Pingwara et al. IFN-λ Modulates the Migratory Capacity of Canine Mammary Tumor Cells via Regulation of the Expression of Matrix Metalloproteinases and Their Inhibitors. Cells. Apr. 23, 2021;10(5):999.

De Weerd, et al. "The interferons and their receptors—distribution and regulation." Immunology and cell biology 90, No. 5 (2012): 483-491.

Kontermann, Roland. "Dual targeting strategies with bispecific antibodies." In MAbs, vol. 4, No. 2, pp. 182-197. Taylor & Francis, 2012.

Shouval, et al. "Interleukin 10 receptor signaling: master regulator of intestinal mucosal homeostasis in mice and humans." Advances in immunology 122 (2014):177-210.

\* cited by examiner

US 11,873,349 B1

COMPOSITIONS AND METHODS RELATED TO IL27 RECEPTOR BINDING

CROSS-REFERENCES TO RELATED APPLICATIONS

This application is a continuation of PCT/US2021/044577, filed Aug. 4, 2021, which claims priority to U.S. Provisional Application No. 63/061,562, filed Aug. 5, 2020, U.S. Provisional Application No. 63/078,745, filed Sep. 15, 2020, and U.S. Provisional Application No. 63/135,884, filed Jan. 11, 2021, the disclosures of which are hereby incorporated by reference in their entirety for all purposes.

SEQUENCE LISTING

The instant application contains a Sequence Listing which has been submitted electronically in XML format and is hereby incorporated by reference in its entirety. Said XML file, created on Feb. 2, 2023, is named 106249-1361753-006820US_SL.xml, and is 2,426,545 bytes in size.

BACKGROUND OF THE DISCLOSURE

The interleukin-27 receptor (IL27R) is a type I cytokine receptor for interleukin-27 (IL27). It is a heterodimer composed of the IL27Rα subunit and glycoprotein 130 (gp130). IL27 is expressed by antigen presenting cells and induces differentiation of a diverse populations of T cells in the immune system. When IL27 binds to the IL27R, signaling pathways, such as the JAK-STAT and p38 MAPK pathways, are turned on to induce pro-inflammatory or anti-inflammatory responses, which involve different types of cells, such as macrophages, dendritic cells, T cells, and B cells. The response that is activated can be dependent on the external surrounding of IL27.

IL-27 is a heterodimeric cytokine consisting of two non-covalently linked subunits, p28 and EBI3. The p28 subunit belongs to the 4-helix bundle cytokine family, while EBI3 is the shortest form possible of a soluble cytokine receptor, with two typical cytokine binding domains (Pflanz S, et al., Immunity. 2002 June; 16(6):779-90).

The primary binding receptor for IL-27 is the IL-27R1 (also known as TCCR- or WSX-1 receptor). IL-27 and IL-27R1 form a complex of considerable affinity (nM). Gp130 is the second receptor that binds the complex of IL-27/IL-27R to create the active signaling complex. Gp130 binding to the IL-27/IL-27R1 complex is much weaker than the interaction between IL-27 and IL-27R1 (Pflanz S, et al., J Immunol. 2004 Feb. 15; 172(4):2225-31).

The IL-27 extracellular domain has 5 domains. The first two domains form the IL-27 binding domains. Typically the loops between D1 and D2 provide most of the binding energy.

The other 3 domains are called Fibronectin type III domains (Fn3). The sequence of each Fn3 domain varies.

The gp130 receptor has 6 domains. The top domain D1 of gp130 binds p28 of IL-27. D2 and D3 contribute little to binding IL-27. The membrane proximal 3 domains are Fn3 domains. The sequence of each Fn3 domain varies.

The structure of the IL-27R is not known but the domain structure is known. The structure of gp130 is known as complexed with IL-6. Based on that structure it is evident that the Fn3 domains do not energetically contribute to IL-27R complex formation. Rather the structure of the gp130 forms a 'C' with the domain 4 and 5 at 80° angle of each other. Certain residues in each of the 'tall' receptors are conserved similar to D4 and D5 in gp130. This indicates that all tall receptors of the gp130 family, including IL-27R, forms this 'C' structure. (Yibin Xu, et al., J Biol Chem. 2010 Jul. 9; 285(28):21214-8).

IL-27R has 5 extracellular domains. D1 and D2 are the cytokine binding domains. D3, D4 and D5 are Fn3 domains. The D5 domain of IL-27R and the D6 domain of gp130 will come close together at the membrane because of the 'C' shape of each receptor. This is required to be able for the receptor complex to trigger binding of JAKs at the intracellular domains of both receptors.

SUMMARY OF THE DISCLOSURE

The present disclosure provides compositions useful in the pairing of cellular receptors to generate desirable effects useful in treatment of disease in mammalian subjects.

Several advantages flow from the binding molecules described herein. The natural ligand of the IL-27R, IL-27, causes gp130 and IL-27Ra to come into proximity (i.e., by their simultaneous binding of IL-27). However, when IL-27 is used as a therapeutic in mammalian, particularly human, subjects, it may also trigger a number of adverse and undesirable effects by a variety of mechanisms including the presence of gp130 and IL-27Ra on other cell types and the binding to gp130 and IL-27Ra on the other cell types may result in undesirable effects and/or undesired signaling on cells expressing gp130 and IL-27Ra. The present disclosure is directed to methods and compositions that modulate the multiple effects of gp130 and IL-27Ra binding so that desired therapeutic signaling occurs, particularly in a desired cellular or tissue subtype, while minimizing undesired activity and/or intracellular signaling.

In some embodiments, the IL-27R binding molecules described herein are partial agonists of the IL-27 receptor. In some embodiments, the binding molecules described herein are designed such that the binding molecules are full agonists. In some embodiments, the binding molecules described herein are designed such that the binding molecules are super agonists.

In some embodiments, the binding molecules provide the maximal desired IL-27 intracellular signaling from binding to gp130 and IL-27Ra on the desired cell types, while providing significantly less IL-27 signaling on other undesired cell types. This can be achieved, for example, by selection of binding molecules having differing affinities or causing different $E_{max}$ for gp130 and IL-27Ra as compared to the affinity of IL-27 for gp130 and IL-27Ra. Because different cell types respond to the binding of ligands to its cognate receptor with different sensitivity, by modulating the affinity of the dimeric ligand (or its individual binding moieties) for the IL-27 receptor relative to wild-type IL-27 binding may facilitate the stimulation of desired activities while reducing undesired activities on non-target cells.

The present disclosure provides bivalent binding molecules that are agonists of the IL-27 receptor, the bivalent binding molecule comprising:
a first single domain antibody (sdAb) that specifically binds to the extracellular domain of gp130 (an "anti-gp130 sdAb"), and
a second single domain antibody that specifically binds to extracellular domain IL-27Ra (an "anti-IL-27Ra sdAb"),
wherein the anti-gp130 sdAb and anti-IL-27Ra sdAb are stably associated and first wherein contacting a cell expressing gp130 and IL-27Ra with an effective amount of the bivalent binding molecule results the dimerization of gp130 and IL-27Ra and results in intracelullar signaling characteristic of the IL-27 receptor when activated by its natural cognate IL-27. In some embodiments, one or both of the sdAbs is an scFv. In some embodiments, one or both of the sdAbs is a VHH.

In some embodiments, one sdAb of the bivalent binding molecule is an scFv and the other sdAb is a VHH.

In some embodiments, the first and second sdAbs are covalently bound via a chemical linkage.

In some embodiments, the first and second sdAbs are provided as single continuous polypeptide.

In some embodiments, the first and second sdAbs are provided as single continuous polypeptide optionally comprising an intervening polypeptide linker between the amino acid sequences of the first and second sdAbs.

In some embodiments the bivalent binding molecule optionally comprising a linker, is optionally expressed as a fusion protein with an additional amino acid sequence. In some embodiments, the additional amino acid sequence is a purification handle such as a chelating peptide or an additional protein such as a subunit of an Fc molecule.

In one aspect, the disclosure provides an IL27 receptor (IL27R) binding protein that specifically binds to IL27Rα subunit (IL27Rα) and glycoprotein 130 subunit (gp130), wherein the binding protein causes the multimerization of IL27Rα and gp130 when bound to IL27Rα and gp130 and the multimerization results in the activation of JAK kinases associated with the intracellular domains of IL27Rα and gp130 and intraceullar signaling, and wherein the binding protein comprises a single-domain antibody (sdAb) that specifically binds to IL27Rα (an anti-IL27Rα sdAb) and a sdAb that specifically binds to gp130 (an anti-gp130 sdAb). In some embodiments, the multimerization of IL27Rα and gp130 can cause downstream signaling.

In some embodiments, the anti-IL27Rα sdAb is a $V_HH$ antibody (an anti IL27Rα $V_HH$ antibody) and/or the anti-gp130 sdAb is a $V_HH$ antibody (an anti gp130 $V_HH$ antibody). In some embodiments, the anti-IL27Rα sdAb and the anti-gp130 sdAb are joined directly or via a peptide linker. In some embodiments, the peptide linker comprises between 1 and 50 amino acids. In particular embodiments, the peptide linker comprises a sequence of GGGS (SEQ ID NO:108).

In some embodiments, the IL27R binding protein comprises:
  a first $V_HH$ antibody comprising a CDR1 having at least 90% (e.g., 91%, 92%, 93%, 94%, 95%, 96%, 97%, 98%, 99%, or 100%) sequence identity, or having 0, 1, 2, or 3 amino acid changes, optionally conservative amino acid changes relative, to the sequence of a CDR1 from a row of Table 1A; a CDR2 having at least 90% (e.g., 91%, 92%, 93%, 94%, 95%, 96%, 97%, 98%, 99%, or 100%) sequence identity, or having 0, 1, 2, or 3 amino acid changes, optionally conservative amino acid changes relative, to the sequence of a CDR2 from the same row of Table 1A; and a CDR3 having at least 90% (e.g., 91%, 92%, 93%, 94%, 95%, 96%, 97%, 98%, 99%, or 100%) sequence identity, or having 0, 1, 2, or 3 amino acid changes, optionally conservative amino acid changes relative, to the sequence of a CDR3 from the same row of Table 1A; and
  a second $V_HH$ antibody comprising a CDR1 having at least 90% (e.g., 91%, 92%, 93%, 94%, 95%, 96%, 97%, 98%, 99%, or 100%) sequence identity, or having 0, 1, 2, or 3 amino acid changes, optionally conservative amino acid changes relative, to the sequence of a CDR4 from the same row of Table 1A; a CDR2 having at least 90% (e.g., 91%, 92%, 93%, 94%, 95%, 96%, 97%, 98%, 99%, or 100%) sequence identity, or having 0, 1, 2, or 3 amino acid changes, optionally conservative amino acid changes relative, to the sequence of a CDR5 from the same row of Table 1A; and a CDR3 having at least 90% (e.g., 91%, 92%, 93%, 94%, 95%, 96%, 97%, 98%, 99%, or 100%) sequence identity, or having 0, 1, 2, or 3 amino acid changes optionally conservative amino acid changes relative, to the sequence of a CDR6 from the same row of Table 1A.

In some embodiments, the IL27R binding protein comprises a sequence at least 90% (e.g., 91%, 92%, 93%, 94%, 95%, 96%, 97%, 98%, 99%, or 100%) identical to any one of the dual VHH dimer sequences shown in Table 1A.

In certain embodiments, the anti IL27Rα $V_HH$ antibody comprises a CDR1 having 0, 1, 2, or 3 amino acid changes relative to the sequence of any one of SEQ ID NOS:193-198; a CDR2 having 0, 1, 2, or 3 amino acid changes relative to the sequence of any one of SEQ ID NOS:199-204; and a CDR3 having 0, 1, 2, or 3 amino acid changes relative to the sequence of any one of SEQ ID NOS:205-210. In further embodiments, the anti gp130 $V_HH$ antibody comprises a CDR1 having 0, 1, 2, or 3 amino acid changes relative to the sequence of any one of SEQ ID NOS:211-217; a CDR2 having 0, 1, 2, or 3 amino acid changes relative to the sequence of any one of SEQ ID NOS:218-224; and a CDR3 having 0, 1, 2, or 3 amino acid changes relative to the sequence of any one of SEQ ID NOS:225-231.

In particular embodiments, the IL27R binding protein comprises a CDR1, a CDR2, and a CDR3 in the anti IL27Rα VHH antibody and a CDR1, a CDR2, and a CDR3 in the anti gp130 VHH antibody as listed in a row of Table 1.

In some embodiments, the binding protein comprises an anti gp130 VHH antibody linked to the N-terminus of a linker and an anti IL27Rα VHH antibody linked to the C-terminus of the linker. In some embodiments, the anti gp130 $V_HH$ antibody comprises a sequence having at least 90% (e.g., 91%, 92%, 93%, 94%, 95%, 96%, 97%, 98%, 99%, or 100%) sequence identity to a sequence of any one of SEQ ID NOS:232-237. In some embodiments, the anti IL27Rα $V_HH$ antibody comprises a sequence having at least 90% (e.g., 91%, 92%, 93%, 94%, 95%, 96%, 97%, 98%, 99%, or 100%) sequence identity to a sequence of any one of SEQ ID NOS:238-244.

In particular embodiments, each of the anti-gp130 $V_HH$ antibody and the anti-IL27Rα $V_HH$ antibody comprises a sequence having at least 90% (e.g., 91%, 92%, 93%, 94%, 95%, 96%, 97%, 98%, 99%, or 100%) identity to a sequence listed in a row of Table 2A.

In certain embodiments, the binding protein comprises a sequence that is substantially identical to a sequence of any one of SEQ ID NOS:1-42. In certain embodiments, the binding protein comprises a sequence having at least 90% (e.g., 91%, 92%, 93%, 94%, 95%, 96%, 97%, 98%, 99%, or 100%) identity to a sequence of any one of SEQ ID NOS:1-42.

In some embodiments, the binding protein comprises an anti IL27Rα $V_HH$ antibody linked to the N-terminus of a linker and an anti gp130 $V_HH$ antibody linked to the C-terminus of the linker. In some embodiments, the anti IL27Rα $V_HH$ antibody comprises a sequence having at least 90% (e.g., 91%, 92%, 93%, 94%, 95%, 96%, 97%, 98%, 99%, or 100%) sequence identity to a sequence of any one of SEQ ID NOS:245-251. In certain embodiments, the anti gp130 $V_HH$ antibody comprises a sequence having at least 90% sequence identity to a sequence of any one of SEQ ID NOS:252-257.

In particular embodiments, each of the anti IL27Rα $V_HH$ antibody and the anti gp130 $V_HH$ antibody comprises a sequence having at least 90% (e.g., 91%, 92%, 93%, 94%, 95%, 96%, 97%, 98%, 99%, or 100%) identity to a sequence listed in a row of Table 3A.

In certain embodiments, the binding protein comprises a sequence that is substantially identical to a sequence of any one of SEQ ID NOS:43-84. In certain embodiments, the binding protein comprises a sequence having at least 90% (e.g., 91%, 92%, 93%, 94%, 95%, 96%, 97%, 98%, 99%, or 100%) identity to a sequence of any one of SEQ ID NOS:43-84.

In another aspect, the disclosure provides an isolated nucleic acid encoding the IL27R binding protein described herein. In certain embodiments, the isolated nucleic acid comprises a sequence having at least 90% (e.g., 91%, 92%, 93%, 94%, 95%, 96%, 97%, 98%, 99%, or 100%) sequence identity to a sequence of any one of SEQ ID NOS:109-192 or a sequence from Table 1B. The disclosure also provides an expression vector comprising the nucleic acid. The disclosure also provides an isolated host cell comprising the expression vector.

In another aspect, the disclosure provides a pharmaceutical composition comprising the IL27R binding protein described herein and a pharmaceutically acceptable carrier.

In another aspect, the disclosure provides a method of treating an autoimmune or inflammatory disease, disorder, or condition, a neoplastic disease, or a viral infection in a subject in need thereof, comprising administering to the subject a therapeutically effective amount of an IL27R binding protein described herein or a pharmaceutical composition described herein.

In some embodiments, the method further comprises administering one or more supplementary agents selected from the group consisting of a corticosteroid, a Janus kinase inhibitor, a calcineurin inhibitor, a mTor inhibitor, an IMDH inhibitor, a biologic, a vaccine, and a therapeutic antibody. In certain embodiments, the therapeutic antibody is an antibody that binds a protein selected from the group consisting of BLyS, CD11a, CD20, CD25, CD3, CD52, IgEIL12/IL23, IL17a, IL1β, IL4Rα, IL5, IL6R, integrin-α4β7, RANKL, TNFα, VEGF-A, and VLA-4.

In certain embodiments, the disease, disorder, or condition is selected from viral infections, *Heliobacter pylori* infection, HTLV, organ rejection, graft versus host disease, autoimmune thyroid disease, multiple sclerosis, allergy, asthma, neurodegenerative diseases including Alzheimer's disease, systemic lupus erythramatosis (SLE), autoinflammatory diseases, inflammatory bowel disease (IBD), Crohn's disease, diabetes, cartilage inflammation, arthritis, rheumatoid arthritis, juvenile arthritis, juvenile rheumatoid arthritis, juvenile rheumatoid arthritis, polyarticular juvenile rheumatoid arthritis, systemic onset juvenile rheumatoid arthritis, juvenile ankylosing spondylitis, juvenile enteropathic arthritis, juvenile reactive arthritis, juvenile Reiter's Syndrome, SEA Syndrome, juvenile dermatomyositis, juvenile psoriatic arthritis, juvenile scleroderma, juvenile systemic lupus erythematosus, juvenile vasculitis, pauciarticular rheumatoidarthritis, polyarticular rheumatoidarthritis, systemic onset rheumatoidarthritis, ankylosing spondylitis, enteropathic arthritis, reactive arthritis, Reiter's syndrome, SEA Syndrome, psoriasis, psoriatic arthritis, dermatitis (eczema), exfoliative dermatitis or atopic dermatitis, *Pityriasis rubra* pilaris, *Pityriasis rosacea*, parapsoriasis, *Pityriasis lichenoiders, Lichen planus, Lichen nitidus*, ichthyosiform dermatosis, keratodermas, dermatosis, alopecia areata, pyoderma gangrenosum, vitiligo, pemphigoid, urticaria, prokeratosis, rheumatoid arthritis; seborrheic dermatitis, solar dermatitis, seborrheic keratosis, senile keratosis, actinic keratosis, photo-induced keratosis, keratosis follicularis; acne vulgaris; keloids; nevi; warts including verruca, condyloma or condyloma acuminatum, and human papilloma viral (HPV) infections.

An IL27R binding proteins described herein are useful in the treatment of neoplastic diseases, such as cancer (e.g., a solid tumor cancer; e.g., non-small-cell lung carcinoma (NSCLC), renal cell carcinoma (RCC), or melanoma) and/or infectious diseases (e.g., bacterial infections and viral infections (e.g., viral infections caused by hepatitis C virus (HCV), human papillomavirus (HPV), or human immunodeficiency virus (HIV)) in a subject in need thereof. The IL27R binding protein binds to and activates CD8$^+$ T cells, CD4$^+$ T cells, and/or T regulatory (Treg) cells. The IL27R binding protein can trigger different levels of downstream signaling in different cell types. For example, by varying the length of the linker between the antiIL27Rα $V_HH$ antibody and the antigp130 $V_HH$ antibody in the IL27R binding protein, the IL27R binding protein can cause a higher level of downstream signaling in desired cell types compared to undesired cell types. In some embodiments, by varying the linker length, an IL27R binding protein can cause a higher level of downstream signaling in T cells (e.g., CD8$^+$ T cells) compared to the level of downstream signaling in other cells. In other embodiments, different antiIL27Rα $V_HH$ antibodies with different binding affinities and different antigp130 $V_HH$ antibodies with different binding affinities can be combined to make different IL27R binding proteins. Further, the orientation of the two antibodies in the binding protein can also be changed to make a different binding protein (i.e., antiIL27Rα $V_HH$ antibody-linker-antigp130 $V_HH$ antibody, or antigp130 $V_HH$ antibody-linker-antiIL27Rα $V_HH$ antibody). Different IL27R binding proteins can be screened to find the ideal binding protein that causes a higher level of downstream signaling in desired cell types compared to undesired cell types. In some embodiments, the level of downstream signaling in T cells (e.g., CD8$^+$ T cells) is at least 1.1, 1.5, 2, 3, 5, or 10 times of the level of downstream signaling in other cells.

In particular, the IL27R binding protein binds to and activates CD8$^+$ T cells. In some embodiments, the IL27R binding protein binds to and activates CXCR5$^+$ CD8$^+$ T cells. It is known that IL27 can promote and sustain a rapid division of memory-like CXCR5$^+$ CD8$^+$ T cells during, for example, viral infection. The CXCR5$^+$ CD8$^+$ T cells can sustain T cell responses during persistent infection or cancer and drive the proliferative burst of CD8$^+$ T cells after anti-PD1 treatment. Accordingly, an IL27R binding protein described herein is useful to sustain and augment self-renewing T cells in chronic infections and neoplastic diseases, such as cancer.

BRIEF DESCRIPTION OF THE FIGURES

FIG. 2A provides a schematic representation of an illustrative single polypeptide chain bivalent binding molecule comprising, from amino to carboxy, a first single domain antibody (1) and a second single domain antibody (3) and a linker (2). FIG. 2B provides a schematic representation of a bivalent binding molecule comprising a first single domain antibody (1) and a second single domain antibody (3) and a linker (2) and a knob-into-hole Fc domain, the Fc domain comprising a first subunit which is a Fc knob (13) and a second subunit which is a Fc hole (14) wherein the bivalent binding molecule is covalently linked to an Fc domain subunit via a IgG hinge sequence (12).

FIG. 3A provides a schematic representation of an illustrative bivalent binding molecule construct comprising two bivalent binding molecules each attached to a subunit of a knob-into-hole Fe domain, the construct comprising two polypeptide chains, the first polypeptide chain comprising, from amino to carboxy, a first single domain antibody (1), a linker (2) and a second single domain antibody (3), a IgG hinge sequence (12) and a Fc knob subunit (13) and a second polypeptide chain comprising, from amino to carboxy, a first single domain antibody (1), a linker (2) and a second single domain antibody (3), a IgG hinge sequence (12) and a Fc hole subunit (14) wherein the first and second polypeptides are in stable associate via the interaction of the knob-into-hole Fc domain. FIG. 3B provides schematic representation of a an alternative arrangement of a bivalent binding molecule construct comprising two polypeptides a first polypeptide chain comprising, from amino to carboxy, a first single domain antibody (1), a linker (2) and a second single domain antibody (3), an IgG hinge sequence (12) and a Fc knob subunit (13) and a second polypeptide chain comprising, from amino to carboxy, a first second domain antibody (3), a linker (2) and a first single domain antibody (1), a IgG hinge sequence (12) and a Fc hole subunit (14), wherein the first and second polypeptides are in stable association via the interaction of the knob-into-hole Fc domain.

DETAILED DESCRIPTION OF THE DISCLOSURE

I. Introduction

Figure 1:
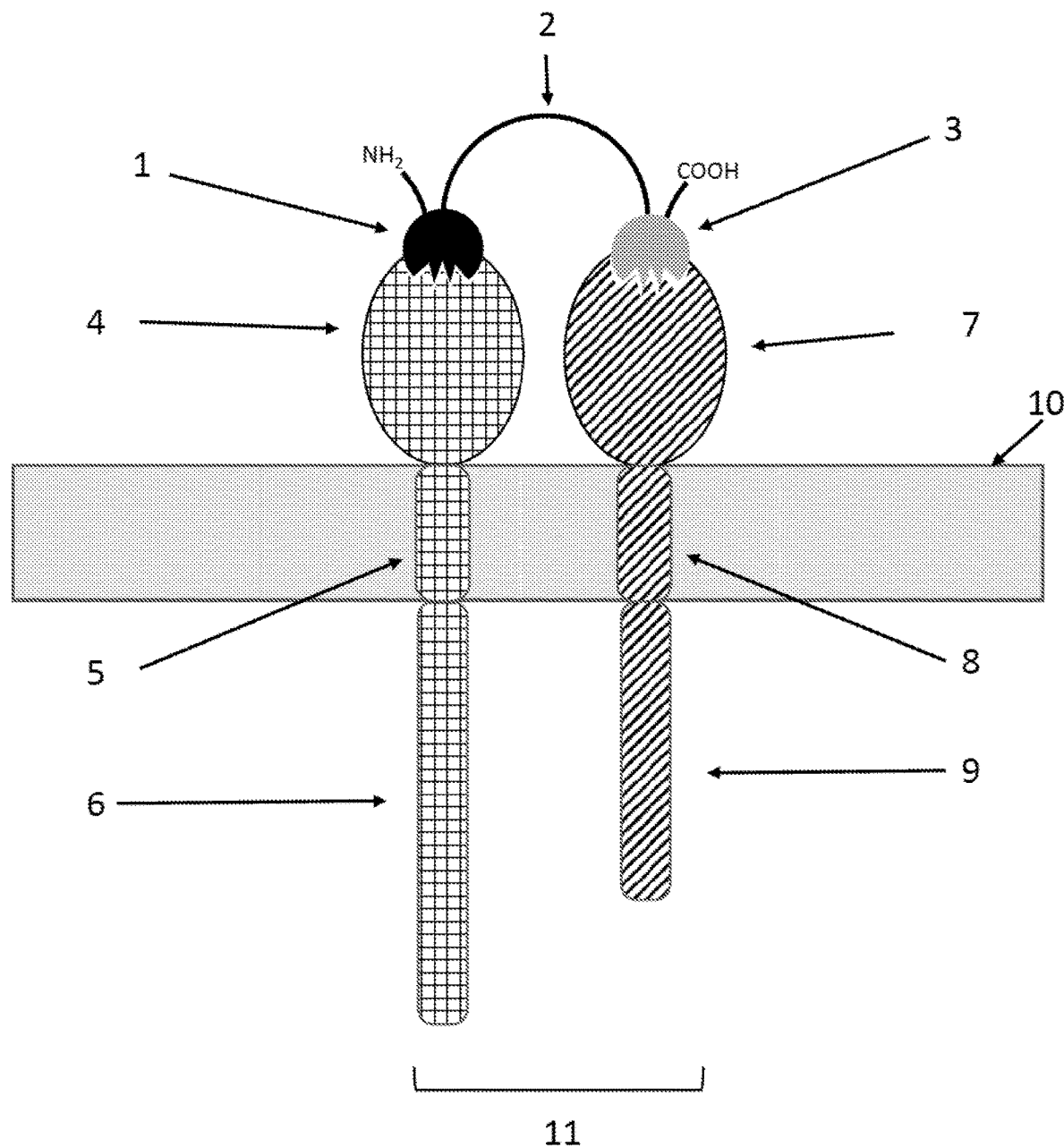
FIG. 1 of the attached drawings provides a schematic representation of one embodiment of the bivalent binding molecule of the present disclosure comprising a first single domain antibody (1) and a second single domain antibody (3) and a linker (2) depicted as interacting with a cell membrane (10) associated heterodimeric receptor comprising a first receptor subunit comprising an extracellular domain (4), and transmembrane domain (5) and an intracellular domain (6) interaction of a bivalent binding molecule and a second first receptor subunit comprising an extracellular domain (7), and transmembrane domain (8) and an intracellular domain (9) wherein the intracellular domain of the first receptor (6) and the intracellular domain of the second receptor (9) on of a bivalent binding molecule are within a proximal distance (11).
Figure 2A:
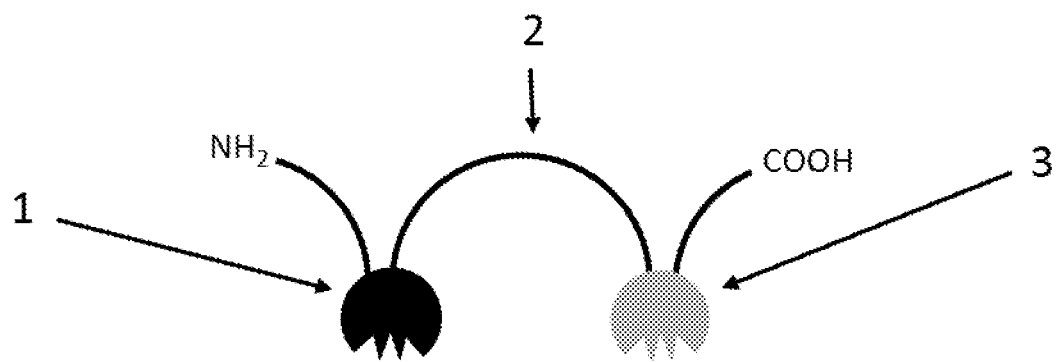
FIGS. 2A and 2B of the attached drawings provides a schematic representation of two illustrative configurations of bivalent binding molecules of the present disclosure.
Figure 2B:
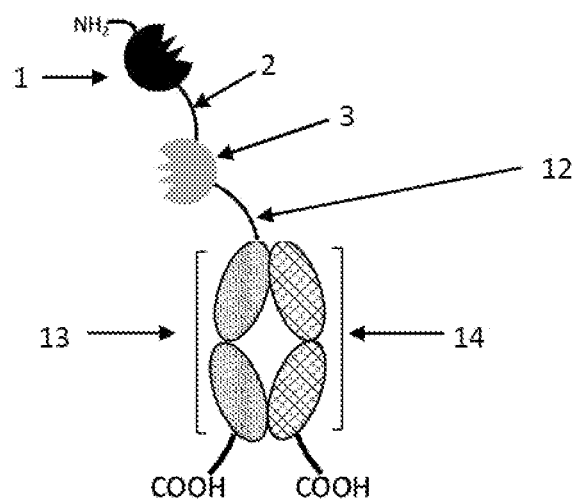
Figure 3A:
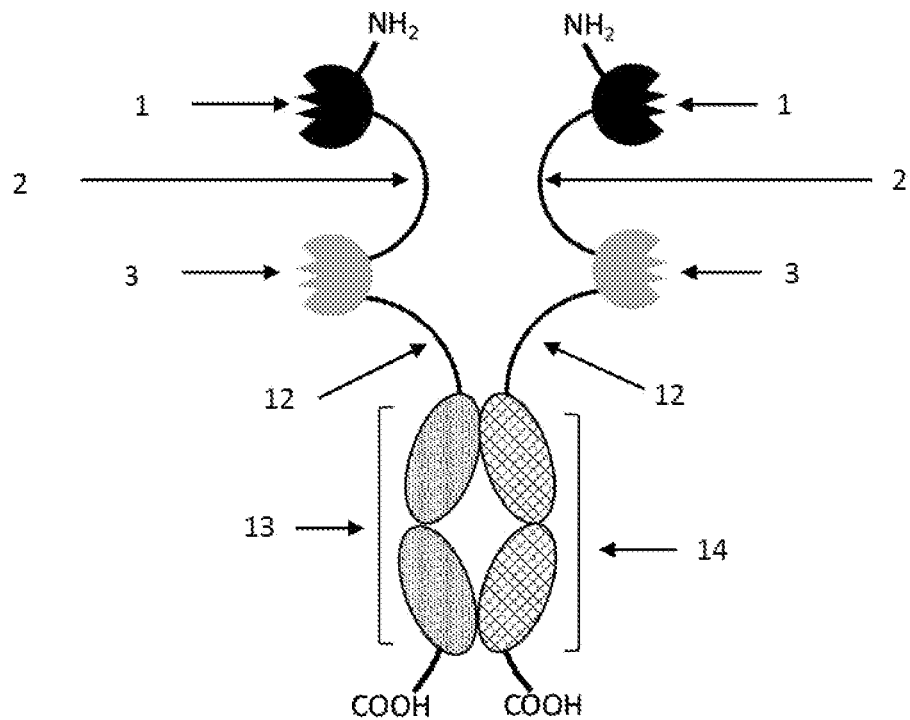
FIGS. 3A and 3B of the attached drawings provides a schematic representations of two illustrative configurations of bivalent binding molecules of the present disclosure.
Figure 3B:
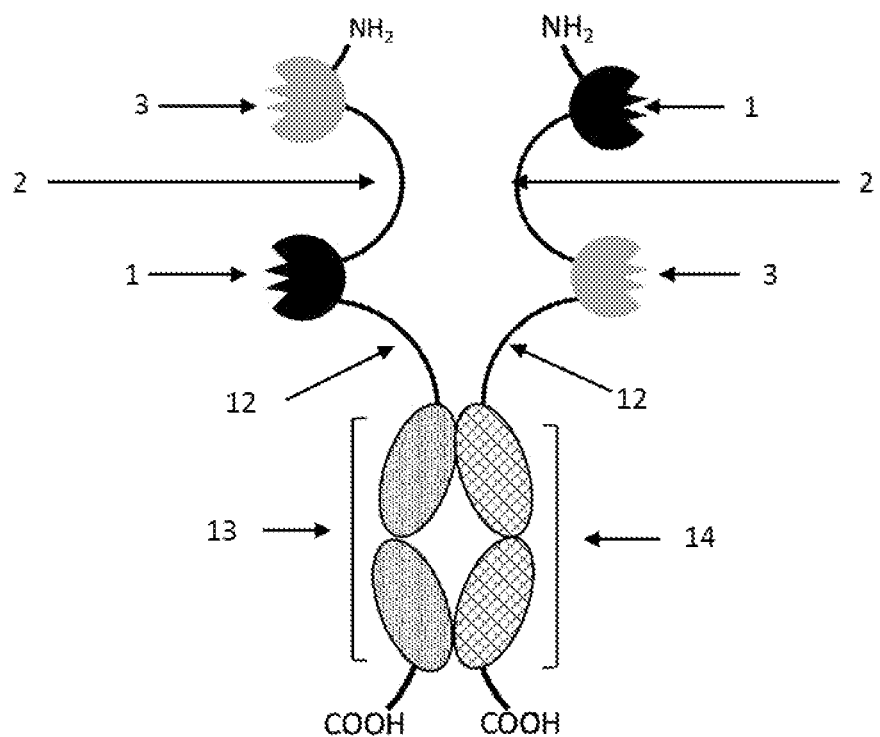
Figure 4A:
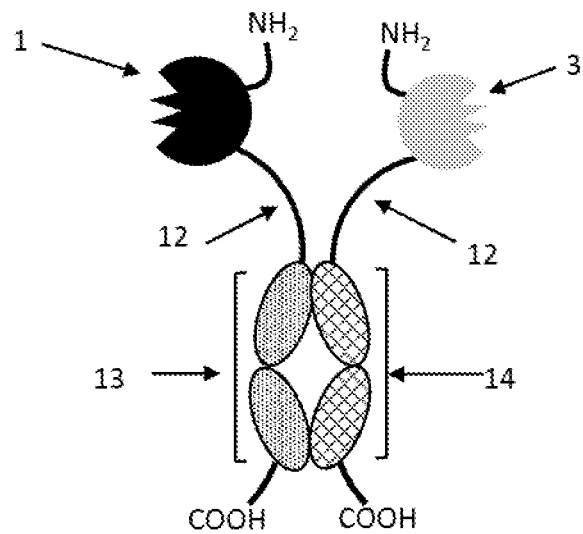
FIG. 4A provides alternative schematic representations of configurations of the bivalent binding molecules of the present disclosure where one single domain antibody is attached to each subunit of a knob-into-hole Fc domain comprising two polypeptides, the first polypeptide comprising from amino to carboxy, a first single domain antibody (1), an IgG hinge sequence (12) and a Fc knob subunit (13), the second polypeptide comprising from amino to carboxy, a second single domain antibody (3), an IgG hinge sequence (12) and a Fc hole subunit (13), wherein the first and second single domain antibodies are in stable associate via the interaction of the knob-into-hole Fc domain.
Figure 4B:
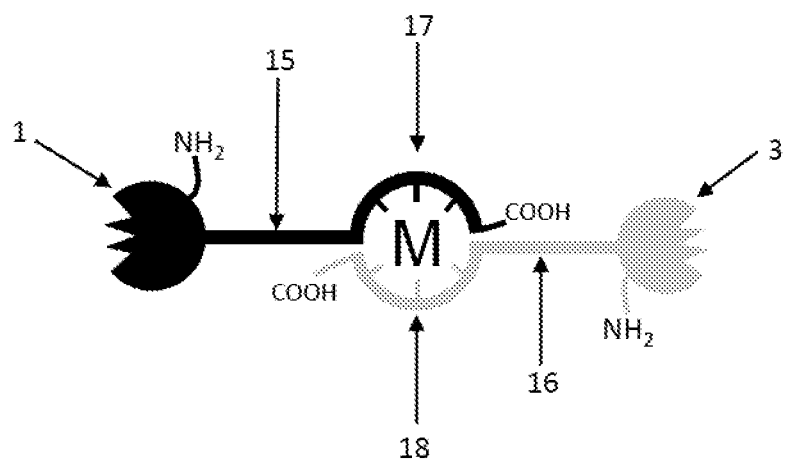
FIG. 4B provides a schematic representation of a binding molecule the binding domains are single domain antibodies associated via transition metal coordinate covalent complex. As illustrated, the binding molecules comprises two polypeptide subunits: the first subunit comprising a first single domain antibody (1) is attached via a first linker (15) to a first chelating peptide (17) and second subunit comprising a second single domain antibody (3) is attached via a second linker (16) to a second chelating peptide (18), wherein the first chelating peptide (17) and second chelating peptide (18) form a coordinate covalent complex with a single transition metal ion ("M"). The transition metal ion may be in a kinetically labile or kinetically inert oxidation state.

The present disclosure provides compositions useful in the pairing of cellular receptors to generate desirable effects useful in treatment of diseases. In general, binding proteins are provided that comprise a first domain that binds to IL27Rα and a second domain that binds to gp130, such that upon contacting with a cell expressing IL27Rα and gp130, the binding protein causes the functional association of IL27Rα and gp130, thereby resulting in functional dimerization of the receptors and downstream signaling.

Several advantages flow from the binding proteins described herein. The natural ligand of IL27R, IL27, causes IL27Rα and gp130 to come into proximity (i.e., by their simultaneous binding of IL27). However, when IL27 is used as a therapeutic in mammalian, particularly human, subjects, it may also trigger a number of adverse and undesirable effects by a variety of mechanisms including the presence of IL27Rα and gp130 on other cell types and the binding to IL27Rα and gp130 on the other cell types may result in undesirable effects and/or undesired signaling on cells expressing IL27Rα and gp130. The present disclosure is directed to methods and compositions that modulate the multiple effects of IL27Rα and gp130 binding so that desired therapeutic signaling occurs, particularly in a desired cellular or tissue subtype, while minimizing undesired activity and/or intracellular signaling.

In some embodiments, the binding proteins described herein are designed such that the binding proteins provide the maximal desired IL27 intracellular signaling from binding to IL27Rα and gp130 on the desired cell types, while providing significantly less IL27 signaling on other undesired cell types. This can be achieved, for example, by selection of binding proteins having differing affinities or causing different $E_{max}$ for IL27Rα and gp130 as compared to the affinity of IL27 for IL27Rα and gp130. Because different cell types respond to the binding of ligands to its cognate receptor with different sensitivity, by modulating the affinity of the dimeric ligand (or its individual binding moieties) for the IL27 receptor relative to wild-type IL27 binding facilitates the stimulation of desired activities while reducing undesired activities on non-target cells. To measure downstream signaling activity, a number of methods are available. For example, in some embodiments, one can measure JAK/STAT signaling by the presence of phosphorylated receptors and/or phosphorylated STATs. In other embodiments, the expression of one or more downstream genes, whose expression levels can be affected by the level of downstream signaling caused by the binding protein, can also be measured.

Interleukin 27 (IL27) Structure:

IL27 is a member of the IL-12 cytokine family. IL27 is a heterodimeric cytokine comprised of two subunits: IL27A (also referred to as IL-27p28) and IL27B (also referred to as Epstein-Barr Virus induced gene 3 or "EBI3"). The human p28 (hIL27A) is expressed as a 243 amino acid pre-protein comprising 28 amino acid signal sequence which is post-translationally removed to render a 215 amino acid mature protein. UniProtKB—Q8NEV9 (IL27A_HUMAN). The mature form of p28 (less the signal peptide) possesses the amino acid sequence;

(SEQ ID NO: 400)
FPRPPGRPQLSLQELRREFTVSLHLARKLLSEVRGQAHRFAESHLPGVN

LYLLPLGEQLPDVSLTFQAWRRLSDPERLCFISTTLQPFHALLGGLGTQ

GRWTNMERMQLWAMRLDLRDLQRHLRFQVLAAGFNLPEEEEEEEEE

EEEERKGLLPGALGSALQGPAQVSWPQLLSTYRLLHSLELVLSRAVRE

LLLLSKAGHSVWPLGFPTLSPQP

The human IL27B (hIL27B) is expressed as a 229 amino acid pre-protein comprising 20 amino acid signal sequence which is post-translationally removed to render a 209 amino acid mature protein. UniProtKB—Q14213 (IL27B_HUMAN). The mature form of hIL27B (less the signal peptide) possesses the amino acid sequence (SEQ ID NO: 401)
RKGPPAALTLPRVQCRASRYPIAVDCSWTLPPAPNSTSPVSFIATYRLG

MAARGHSWPCLQQTPTSTSCTITDVQLFSMAPYVLNVTAVHPWGSSS

SFVPFITEHIIKPDPPEGVRLSPLAERQLQVQWEPPGSWPFPEIFSLKY

WIRYKRQGAARFHRVGPIEATSFILRAVRPRARYYVQVAAQDLTDYGEL

SDWSLPATATMSLGK

Interleukin 27 (IL27) Receptor:

IL27 results in intracellular signaling via its interaction with a heterodimeric receptor consisting of: IL-27Rα (or IL27RA) and gp130. The binding of IL27 to IL27 receptor activates signaling pathways including the JAK/STAT and p38 MAPK pathways. IL27 stimulates both pro-inflammatory and anti-inflammatory response in different cell types such as macrophages, dendritic cells, T cells and B cells. The type of response is dependent on the environment.

The human IL27 receptor subunit alpha (hIL27RA) is expressed as a 636 amino acid pre-protein comprising 32 amino acid signal sequence which is post-translationally removed to render a 604 amino acid mature protein. UniProtKB—Q6UWB1 (127RA_HUMAN)

The mature form of hIL27RA (less the signal peptide) possesses the amino acid sequence:

(SEQ ID NO: 402)
QGSAGPLQCYGVGPLGDLNCSWEPLGDLGAPSELHLQSQKYRSNKTQ

TVAVAAGRSWVAIPREQLTMSDKLLVWGTKAGQPLWPPVFVNLETQ

MKPNAPRLGPDVDFSEDDPLEATVHWAPPTWPSHKVLICQFHYRRCQ

EAAWTLLEPELKTIPLTPVEIQDLELATGYKVYGRCRMEKEEDLWGE

WSPILSFQTPPSAPKDVWVSGNLCGTPGGEEPLLLWKAPGPCVQVSYK

VWFWVGGRELSPEGITCCCSLIPSGAEWARVSAVNATSWEPLTNLSLV

CLDSASAPRSVAVSSIAGSTELLVTWQPGPGEPLEHVVDWARDGDPLE

KLNWVRLPPGNLSALLPGNFTVGVPYRITVTAVSASGLASASSVWGFR

EELAPLVGPTLWRLQDAPPGTPAIAWGEVPRHQLRGHLTHYTLCAQS

GTSPSVCMNVSGNTQSVTLPDLPWGPCELWVTASTIAGQGPPGPILRL

HLPDNTLRWKVLPGILFLWGLFLLGCGLSLATSGRCYHLRHKVLPRW

VWEKVPDPANSSSGQPHMEQVPEAQPLGDLPILEVEEMEPPPVMESSQ

PAQATAPLDSGYEKHFLPTPEELGLLGPPRPQVLA

The extracellular domain of hIL27RA (IL27RA-ECD) is a 484 amino acid polypeptide corresponding to amino acids 33-516 of the hIL27RA preprotein and possesses the amino acid sequence:

(SEQ ID NO: 403)
QGSAGPLQCYGVGPLGDLNCSWEPLGDLGAPSELHLQSQKYRSNKTQ

TVAVAAGRSWVAIPREQLTMSDKLLVWGTKAGQPLWPPVFVNLETQ

MKPNAPRLGPDVDFSEDDPLEATVHWAPPTWPSHKVLICQFHYRRCQ

EAAWTLLEPELKTIPLTPVEIQDLELATGYKVYGRCRMEKEEDLWGE

WSPILSFQTPPSAPKDVWVSGNLCGTPGGEEPLLLWKAPGPCVQVSYK

VWFWVGGRELSPEGITCCCSLIPSGAEWARVSAVNATSWEPLTNLSLV

CLDSASAPRSVAVSSIAGSTELLVTWQPGPGEPLEHVVDWARDGDPLE

KLNWVRLPPGNLSALLPGNFTVGVPYRITVTAVSASGLASASSVWGFR

EELAPLVGPTLWRLQDAPPGTPAIAWGEVPRHQLRGHLTHYTLCAQS

GTSPSVCMNVSGNTQSVTLPDLPWGPCELWVTASTIAGQGPPGPILRL

HLPDNTLRWK

The human gp130 receptor subunit (hGP130) is also referred as the IL6 receptor beta subunit. UniProtKB—P40189 (IL6RB_HUMAN. hGP130 is expressed as a 918 amino acid pre-protein comprising 22 amino acid signal sequence which is post-translationally removed to render a 896 amino acid mature protein. The mature form of hGP130 possess the amino acid sequence:

(SEQ ID NO: 404)
ELLDPCGYISPESPVVQLHSNFTAVCVLKEKCMDYFHVNANYIVWKT

NHFTIPKEQYTIINRTASSVTFTDIASLNIQLTCNILTFGQLEQNVYGI

TIISGLPPEKPKNLSCIVNEGKKMRCEWDGGRETHLETNFTLKSEWATHK

FADCKAKRDTPTSCTVDYSTVYFVNIEVWVEAENALGKVTSDHINFD

PVYKVKPNPPHNLSVINSEELSSILKLTWTNPSIKSVIILKYNIQYRTKD

ASTWSQIPPEDTASTRSSFTVQDLKPFTEYVFRIRCMKEDGKGYWSDW

SEEASGITYEDRPSKAPSFWYKIDPSHTQGYRTVQLVWKTLPPFEANG

KILDYEVTLTRWKSHLQNYTVNATKLTVNLTNDRYLATLTVRNLVGK

SDAAVLTIPACDFQATHPVMDLKAFPKDNMLWVEWTTPRESVKKYIL

EWCVLSDKAPCITDWQQEDGTVHRTYLRGNLAESKCYLITVTPVYAD

GPGSPESIKAYLKQAPPSKGPTVRTKKVGKNEAVLEWDQLPVDVQNG

FIRNYTIFYRTIIGNETAVNVDSSHTEYTLSSLTSDTLYMVRMAAYTDE

GGKDGPEFTFTTPKFAQGEIEAIVVPVCLAFLLTTLLGVLFCFNKRDLI

KKHIWPNVPDPSKSHIAQWSPHTPPRHNFNSKDQMYSDGNFTDVSVV

EIEANDKKPFPEDLKSLDLFKKEKINTEGHSSGIGGSSCMSSSRPSISSS

DENESSQNTSSTVQYSTVVHSGYRHQVPSVQVFSRSESTQPLLDSEERPE

DLQLVDHVGGDGILPRQQYFKQNCSQHESSPDISHFERSKQVSSVNE

```
                                -continued
EDFVRLKQQISDHISQSCGSGQMKMFQEVSAADAFGPGTEGQVERFET

VGMEAATDEGMPKSYLPQTVRQGGYMPQ
```

The extracellular domain of hGP130 (hGP130-ECD) is a 597 amino acid polypeptide corresponding to amino acids 23-619 of the hGP130 preprotein and possesses the amino acid sequence:

```
                                                (SEQ ID NO: 405)
ELLDPCGYISPESPVVQLHSNFTAVCVLKEKCMDYFHVNANYIVWKT

NHFTIPKEQYTIINRTASSVTFTDIASLNIQLTCNILTFGQLEQNVYGIT

IISGLPPEKPKNLSCIVNEGKKMRCEWDGGRETHLETNFTLKSEWATHK

FADCKAKRDTPTSCTVDYSTVYFVNIEVWVEAENALGKVTSDHINFD

PVYKVKPNPPHNLSVINSEELSSILKLTWTNPSIKSVIILKYNIQYRTKD

ASTWSQIPPEDTASTRSSFTVQDLKPFTEYVFRIRCMKEDGKGYWSDW

SEEASGITYEDRPSKAPSFWYKIDPSHTQGYRTVQLVWKTLPPFEANG

KILDYEVTLTRWKSHLQNYTVNATKLTVNLTNDRYLATLTVRNLVGK

SDAAVLTIPACDFQATHPVMDLKAFPKDNMLWVEWTTPRESVKKYIL

EWCVLSDKAPCITDWQQEDGTVHRTYLRGNLAESKCYLITVTPVYAD

GPGSPESIKAYLKQAPPSKGPTVRTKKVGKNEAVLEWDQLPVDVQNG

FIRNYTIFYRTIIGNETAVNVDSSHTEYTLSSLTSDTLYMVRMAAYTDE

GGKDGPEFTFTTPKFAQGEIE
```

IL27 Activity

IL27 is expressed by antigen presenting cells. hIL27 induces differentiation of the diverse populations of T cells in the immune system and also upregulates IL10. hIL27 has pro- and anti-inflammatory properties, that can regulate T-helper cell development, suppress T-cell proliferation, stimulate cytotoxic T-cell activity, induce isotype switching in B-cells, and that have diverse effects on innate immune cells. Among its target cells are CD4 T-helper cells which can differentiate in type 1 effector cells (TH1), type 2 effector cells (TH2) and IL17 producing helper T-cells (TH17).

T Cell Differentiation

IL27 plays a significant role in the differentiation through inducing or suppressing of T cell subtypes including Th1, Th2, Th17, Tr1 and Treg cells. IL-27 is greatly involved in differentiation through inducing or suppressing of each T cell subset. Interferon gamma (IFNg) expressing Th1 cells are generated in response IL27 through STAT1 signaling via expression of T-bet and signature Th1 genes. IL4 expressing Th2 cells are inhibited by IL27 through the transcription factor GATA-3. Th17 cells, which express IL17, IL22, and GM-CSF, are inhibited by IL27 through STAT1 and expression of transcription factor RORγt. Treg cells are inhibited by IL27 through STAT1 and STAT3.

IL27 drives rapid clonal expansion of naive but not memory CD4 T-cells. IL27 also strongly synergizes with IL-12 to trigger interferon-gamma/IFN-gamma production of naive CD4 T-cells, binds to the cytokine receptor WSX-1/TCCR. Another important role of IL-27 is its antitumor activity as well as its antiangiogenic activity with activation of production of antiangiogenic chemokines Induction of IL10

Tr1 cells which express IL-10, are induced by IL-27 through the transcription factor c-Maf providing an anti-inflammatory response. A primary activity of IL-10 is the suppression of inflammatory responses. Also involved are the STAT1 and STAT3 transcription factors that bind specifically to the IL-27a. The activation of STAT3 by IL-27 leads to an increase of IL-10 secretion from Treg cells.

II. Definitions

To facilitate the understanding of present disclosure, certain terms and phrases are defined below as well as throughout the specification. The definitions provided herein are non-limiting and should be read in view of the knowledge of one of skill in the art would know.

Before the present methods and compositions are described, it is to be understood that this invention is not limited to a particular method or composition described, as such may, of course, vary. It is also to be understood that the terminology used herein is for the purpose of describing embodiments only and is not intended to be limiting.

Where a range of values is provided, it is understood that each intervening value, to the tenth of the unit of the lower limit unless the context clearly dictates otherwise, between the upper and lower limits of that range is also specifically disclosed. Each smaller range between any stated value or intervening value in a stated range and any other stated or intervening value in that stated range is encompassed within the invention. The upper and lower limits of these smaller ranges may independently be included or excluded in the range, and each range where either, neither or both limits are included in the smaller ranges is also encompassed within the invention, subject to any specifically excluded limit in the stated range. Where the stated range includes one or both of the limits, ranges excluding either or both of those included limits are also included in the invention.

Unless defined otherwise, all technical and scientific terms used herein have the same meaning as commonly understood by one of ordinary skill in the art to which this invention belongs. Although any methods and materials similar or equivalent to those described herein can be used in the practice or testing of the present invention, some potential and preferred methods and materials are now described. All publications mentioned herein are incorporated herein by reference to disclose and describe the methods and/or materials in connection with which the publications are cited.

It should be noted that as used herein and in the appended claims, the singular forms "a", "an", and "the" include plural referents unless the context clearly dictates otherwise. Thus, for example, reference to "a cell" includes a plurality of such cells and reference to "the peptide" includes reference to one or more peptides and equivalents thereof, e.g. polypeptides, known to those skilled in the art, and so forth.

The publications discussed herein are provided solely for their disclosure prior to the filing date of the present application. Nothing herein is to be construed as an admission that the present invention is not entitled to antedate such publication by virtue of prior invention. Further, the dates of publication provided may be different from the actual publication dates which may need to be independently confirmed.

Unless indicated otherwise, parts are parts by weight, molecular weight is weight average molecular weight, temperature is in degrees Celsius (° C.), and pressure is at or near atmospheric. Standard abbreviations are used, including the following: bp=base pair(s); kb=kilobase(s); pl=picoliter(s); s or sec=second(s); min=minute(s); h or hr=hour(s); AA or aa=amino acid(s); kb=kilobase(s);

nt=nucleotide(s); pg=picogram; ng=nanogram; g=microgram; mg=milligram; g=gram; kg=kilogram; dl or dL=deciliter; μl or μL=microliter; ml or mL=milliliter; l or L=liter; M=micromolar; mM=millimolar; M=molar; kDa=kilodalton; i.m.=intramuscular(ly); i.p.=intraperitoneal (ly); SC or SQ=subcutaneous(ly); QD=daily; BID=twice daily; QW=once weekly; QM=once monthly; HPLC=high performance liquid chromatography; BW=body weight; U=unit; ns=not statistically significant; PBS=phosphate-buffered saline; PCR=polymerase chain reaction; HSA=human serum albumin; MSA=mouse serum albumin; DMEM=Dulbeco's Modification of Eagle's Medium; EDTA=ethylenediaminetetraacetic acid.

It will be appreciated that throughout this disclosure reference is made to amino acids according to the single letter or three letter codes. For the reader's convenience, the single and three letter amino acid codes are provided in the Table below:

TABLE

Amino Acid Abbreviations

| G | Glycine | Gly |
|---|---|---|
| P | Proline | Pro |
| A | Alanine | Ala |
| V | Valine | Val |
| L | Leucine | Leu |
| I | Isoleucine | Ile |
| M | Methionine | Met |
| C | Cysteine | Cys |
| F | Phenylalanine | Phe |
| Y | Tyrosine | Tyr |
| W | Tryptophan | Trp |
| H | Histidine | His |
| K | Lysine | Lys |
| R | Arginine | Arg |
| Q | Glutamine | Gln |
| N | Asparagine | Asn |
| E | Glutamic Acid | Glu |
| D | Aspartic Acid | Asp |
| S | Serine | Ser |
| T | Threonine | Thr |

Standard methods in molecular biology are described in the scientific literature (see, e.g., Sambrook and Russell (2001) Molecular Cloning, 3rd ed., Cold Spring Harbor Laboratory Press, Cold Spring Harbor, N.Y.; and Ausubel, et al. (2001) Current Protocols in Molecular Biology, Vols. 1-4, John Wiley and Sons, Inc. New York, N.Y., which describes cloning in bacterial cells and DNA mutagenesis (Vol. 1), cloning in mammalian cells and yeast (Vol. 2), glycoconjugates and protein expression (Vol. 3), and bioinformatics (Vol. 4)). The scientific literature describes methods for protein purification, including immunoprecipitation, chromatography, electrophoresis, centrifugation, and crystallization, as well as chemical analysis, chemical modification, post-translational modification, production of fusion proteins, and glycosylation of proteins (see, e.g., Coligan, et al. (2000) Current Protocols in Protein Science, Vols. 1-2, John Wiley and Sons, Inc., NY).

Activate: As used herein the term "activate" is used in reference to a receptor or receptor complex to reflect a biological effect, directly and/or by participation in a multicomponent signaling cascade, arising from the binding of an agonist ligand to a receptor responsive to the binding of the ligand.

Activity: As used herein, the term "activity" is used with respect to a molecule to describe a property of the molecule with respect to a test system (e.g. an assay) or biological or chemical property (e.g. the degree of binding of the molecule to another molecule) or of a physical property of a material or cell (e.g. modification of cell membrane potential). Examples of such biological functions include but are not limited to catalytic activity of a biological agent, the ability to stimulate intracellular signaling, gene expression, cell proliferation, the ability to modulate immunological activity such as inflammatory response. "Activity" is typically expressed as a level of a biological activity per unit of agent tested such as [catalytic activity]/[mg protein], [immunological activity]/[mg protein], international units (IU) of activity, [STAT5 phosphorylation]/[mg protein], [T-cell proliferation]/[mg protein], plaque forming units (pfu), etc. As used herein, the term "proliferative activity" refers to an activity that promotes cell proliferation and replication.

Administer/Administration: The terms "administration" and "administer" are used interchangeably herein to refer the act of contacting a subject, including contacting a cell, tissue, organ, or biological fluid of the subject in vitro, in vivo or ex vivo with an agent (e.g. an ortholog, an IL2 ortholog, an engineered cell expressing an orthogonal receptor, an engineered cell expressing an orthogonal IL2 receptor, a CAR-T cell expressing an orthogonal IL2 receptor, a chemotherapeutic agent, an antibody, or a pharmaceutical formulation comprising one or more of the foregoing). Administration of an agent may be achieved through any of a variety of art recognized methods including but not limited to the topical administration, intravascular injection (including intravenous or intraarterial infusion), intradermal injection, subcutaneous injection, intramuscular injection, intraperitoneal injection, inhalation and the like. The term "administration" includes contact of an agent to the cell, tissue or organ as well as the contact of an agent to a fluid, where the fluid is in contact with the cell, tissue or organ.

Affinity: As used herein the term "affinity" refers to the degree of specific binding of a first molecule (e.g., a ligand) to a second molecule (e.g., a receptor) and is measured by the equilibrium dissociation constant (KD), a ratio of the dissociation rate constant between the molecule and its target (Koff) and the association rate constant between the molecule and its target (Kon).

Agonist: As used herein, the term "agonist" refers a first agent that specifically binds a second agent ("target") and interacts with the target to cause or promote an increase in the activation of the target. In some instances, agonists are activators of receptor proteins that modulate cell activation, enhance activation, sensitize cells to activation by a second agent, or up-regulate the expression of one or more genes, proteins, ligands, receptors, biological pathways, that may result in cell proliferation or pathways that result in cell cycle arrest or cell death such as by apoptosis. In some embodiments, an agonist is an agent that binds to a receptor and alters the receptor state, resulting in a biological response. The response mimics the effect of the endogenous activator of the receptor. The term "agonist" includes partial agonists, full agonists and superagonists. An agonist may be described as a "full agonist" when such agonist which leads to a substantially full biological response (i.e., the response associated with the naturally occurring ligand/receptor binding interaction) induced by receptor under study, or a partial agonist. In contrast to agonists, antagonists may specifically bind to a receptor but do not result the signal cascade typically initiated by the receptor and may to modify the actions of an agonist at that receptor. Inverse agonists are agents that produce a pharmacological response that is opposite in direction to that of an agonist. A "superagonist" is a type of agonist that is capable of producing a maximal response greater than the endogenous agonist for the target receptor, and thus has an activity of more than 100% of the native ligand. A super agonist is typically a synthetic molecule that exhibits greater than 110%, alternatively greater than 120%, alternatively greater than 130%, alternatively greater than 140%, alternatively greater than 150%, alternatively greater than 160%, or alternatively greater than 170% of the response in an evaluable quantitative or qualitative parameter of the naturally occurring form of the molecule when evaluated at similar concentrations in a comparable assay.

Antagonist: As used herein, the term "antagonist" or "inhibitor" refers a molecule that opposes the action(s) of an agonist. An antagonist prevents, reduces, inhibits, or neutralizes the activity of an agonist, and an antagonist can also prevent, inhibit, or reduce constitutive activity of a target, e.g., a target receptor, even where there is no identified agonist. Inhibitors are molecules that decrease, block, prevent, delay activation, inactivate, desensitize, or down-regulate, e.g., a gene, protein, ligand, receptor, biological pathway, or cell.

Antibody: As used herein, the term "antibody" refers collectively to: (a) glycosylated and non-glycosylated immunoglobulins (including but not limited to mammalian immunoglobulin classes IgG1, IgG2, IgG3 and IgG4) that specifically binds to target molecule and (b) immunoglobulin derivatives including but not limited to IgG(1-4)del-ta$C_H$2, F(ab')$_2$, Fab, ScFv, $V_H$, $V_L$, tetrabodies, triabodies, diabodies, dsFv, F(ab')$_3$, scFv-Fc and (scFv)$_2$ that competes with the immunoglobulin from which it was derived for binding to the target molecule. The term antibody is not restricted to immunoglobulins derived from any particular mammalian species and includes murine, human, equine, and camelids antibodies (e.g., human antibodies). The term "antibody" encompasses antibodies isolatable from natural sources or from animals following immunization with an antigen and as well as engineered antibodies including monoclonal antibodies, bispecific antibodies, trispecific, chimeric antibodies, humanized antibodies, human antibodies, CDR-grafted, veneered, or deimmunized (e.g., to remove T-cell epitopes) antibodies. The term "human antibody" includes antibodies obtained from human beings as well as antibodies obtained from transgenic mammals comprising human immunoglobulin genes such that, upon stimulation with an antigen the transgenic animal produces antibodies comprising amino acid sequences characteristic of antibodies produced by human beings. The term "antibody" should not be construed as limited to any particular means of synthesis and includes naturally occurring antibodies isolatable from natural sources and as well as engineered antibodies molecules that are prepared by "recombinant" means including antibodies isolated from transgenic animals that are transgenic for human immunoglobulin genes or a hybridoma prepared therefrom, antibodies isolated from a host cell transformed with a nucleic acid construct that results in expression of an antibody, antibodies isolated from a combinatorial antibody library including phage display libraries.

Binding molecule: As used herein, the term "binding molecule" refers to a bivalent molecule that can bind to the extracellular domain of two cell surface receptors. In some embodiments, a binding molecule specifically binds to two different receptors (or domains or subunits thereof) such that the receptors (or domains or subunits) are maintained in proximity to each other such that the receptors (or domains or subunits), including domains thereof (e.g., intracellular domains) interact with each other and result in downstream signaling.

CDR: As used herein, the term "CDR" or "complementarity determining region" is intended to mean the non-contiguous antigen combining sites found within the variable region of both heavy and light chain immunoglobulin polypeptides. CDRs have been described by Kabat et al., J Biol. Chem. 252:6609-6616 (1977); Kabat, et al., U.S. Dept. of Health and Human Services publication entitled "Sequences of proteins of immunological interest" (1991) (also referred to herein as "Kabat 1991" or "Kabat"); by Chothia, et al. (1987) J. Mol. Biol. 196:901-917 (also referred to herein as "Chothia"); and MacCallum, et al. (1996) J. Mol. Biol. 262:732-745, where the definitions include overlapping or subsets of amino acid residues when compared against each other. Nevertheless, application of either definition to refer to a CDR of an antibody or grafted antibodies or variants thereof is intended to be within the scope of the term as defined and used herein. The term "Chothia Numbering" as used herein is recognized in the arts and refers to a system of numbering amino acid residues based on the location of the structural loop regions (Chothia et al. 1986, Science 233:755-758; Chothia & Lesk 1987, JMB 196:901-917; Chothia et al. 1992, JMB 227:799-817). For purposes of the present disclosure, unless otherwise specifically identified, the positioning of CDRs2 and 3 in the variable region of an antibody follows Kabat numbering or simply, "Kabat." The positioning of CDR1 in the variable region of an antibody follows a hybrid of Kabat and Chothia numbering schemes.

Clonotype: A clonotype is defined as a collection of binding molecules that originate from the same B-cell progenitor cell. The term "clonotype" is used herein to refer to a collection of antigen binding molecules that belong to the same germline family, have the same CDR3 lengths, and have 70% or greater homology in CDR3 sequence Comparable: As used herein, the term "comparable" is used to describe the degree of difference in two measurements of an evaluable quantitative or qualitative parameter. For example, where a first measurement of an evaluable quantitative parameter and a second measurement of the evaluable parameter do not deviate beyond a range that the skilled artisan would recognize as not producing a statistically significant difference in effect between the two results in the circumstances, the two measurements would be considered "comparable." In some instances, measurements may be considered "comparable" if one measurement deviates from another by less than 30%, alternatively by less than 25%, alternatively by less than 20%, alternatively by less than 15%, alternatively by less than 10%, alternatively by less than 7%, alternatively by less than 5%, alternatively by less than 4%, alternatively by less than 3%, alternatively by less than 2%, or by less than 1%. In particular embodiments, one measurement is comparable to a reference standard if it deviates by less than 15%, alternatively by less than 10%, or alternatively by less than 5% from the reference standard.

As used herein, the term "downstream signaling" refers to the cellular signaling process that is caused by the interaction of two or more cell surface receptors that are brought into proximity of each other.

Effective Concentration (EC): As used herein, the terms "effective concentration" or its abbreviation "EC" are used interchangeably to refer to the concentration of an agent (e.g., an hIL2 mutein) in an amount sufficient to effect a change in a given parameter in a test system. The abbreviation "E" refers to the magnitude of a given biological effect observed in a test system when that test system is exposed to a test agent. When the magnitude of the response is expressed as a factor of the concentration ("C") of the test agent, the abbreviation "EC" is used. In the context of biological systems, the term Emax refers to the maximal magnitude of a given biological effect observed in response to a saturating concentration of an activating test agent. When the abbreviation EC is provided with a subscript (e.g., $EC_{40}$, $EC_{50}$, etc.) the subscript refers to the percentage of the Emax of the biological observed at that concentration. For example, the concentration of a test agent sufficient to result in the induction of a measurable biological parameter in a test system that is 30% of the maximal level of such measurable biological parameter in response to such test agent, this is referred to as the "$EC_{30}$" of the test agent with respect to such biological parameter. Similarly, the term "$EC_{100}$" is used to denote the effective concentration of an agent that results the maximal (100%) response of a measurable parameter in response to such agent. Similarly, the term $E_{50}$ (which is commonly used in the field of pharmacodynamics) refers to the concentration of an agent sufficient to results in the half-maximal (50%) change in the measurable parameter. The term "saturating concentration" refers to the maximum possible quantity of a test agent that can dissolve in a standard volume of a specific solvent (e.g., water) under standard conditions of temperature and pressure. In pharmacodynamics, a saturating concentration of a drug is typically used to denote the concentration sufficient of the drug such that all available receptors are occupied by the drug, and $EC_{50}$ is the drug concentration to give the half-maximal effect. The EC of a particular effective concentration of a test agent may be abbreviated with respect to the with respect to particular parameter and test system.

Extracellular Domain: As used herein the term "extracellular domain" or its abbreviation "ECD" refers to the portion of a cell surface protein (e.g. a cell surface receptor) which is outside of the plasma membrane of a cell. The term "ECD" may include the extra-cytoplasmic portion of a transmembrane protein or the extra-cytoplasmic portion of a cell surface (or membrane associated protein).

Identity: As used herein, the term "percent (%) sequence identity" or "substantially identical" used in the context of nucleic acids or polypeptides, refers to a sequence that has at least 50% sequence identity with a reference sequence. Alternatively, percent sequence identity can be any integer from 50% to 100%. In some embodiments, a sequence has at least 50%, 55%, 60%, 65%, 70%, 75%, 80%, 85%, 90%, 91%, 92%, 93%, 94%, 95%, 96%, 97%, 98%, or 99% sequence identity to the reference sequence as determined with BLAST using standard parameters, as described below. For sequence comparison, typically one sequence acts as a reference sequence, to which test sequences are compared. When using a sequence comparison algorithm, test and reference sequences are entered into a computer, subsequence coordinates are designated, if necessary, and sequence algorithm program parameters are designated. Default program parameters can be used, or alternative parameters can be designated. The sequence comparison algorithm then calculates the percent sequence identities for the test sequences relative to the reference sequence, based on the program parameters. A comparison window includes reference to a segment of any one of the number of contiguous positions, e.g., a segment of at least 10 residues. In some embodiments, the comparison window has from 10 to 600 residues, e.g., about 10 to about 30 residues, about 10 to about 20 residues, about 50 to about 200 residues, or about 100 to about 150 residues, in which a sequence may be compared to a reference sequence of the same number of contiguous positions after the two sequences are optimally aligned. Algorithms that are suitable for determining percent sequence identity and sequence similarity are the BLAST and BLAST 2.0 algorithms, which are described in Altschul et al. (1990) J Mol. Biol. 215: 403-410 and Altschul et al. (1977) Nucleic Acids Res. 25: 3389-3402, respectively. Software for performing BLAST analyses is publicly available through the National Center for Biotechnology Information (NCBI) web site. The algorithm involves first identifying high scoring sequence pairs (HSPs) by identifying short words of length W in the query sequence, which either match or satisfy some positive-valued threshold score T when aligned with a word of the same length in a database sequence. T is referred to as the neighborhood word score threshold (Altschul et al, supra). These initial neighborhood word hits act as seeds for initiating searches to find longer HSPs containing them. The word hits are then extended in both directions along each sequence for as far as the cumulative alignment score can be increased. Cumulative scores are calculated using, for nucleotide sequences, the parameters M (reward score for a pair of matching residues; always >0) and N (penalty score for mismatching residues; always <0). For amino acid sequences, a scoring matrix is used to calculate the cumulative score. Extension of the word hits in each direction are halted when: the cumulative alignment score falls off by the quantity X from its maximum achieved value; the cumulative score goes to zero or below, due to the accumulation of one or more negative-scoring residue alignments; or the end of either sequence is reached. The BLAST algorithm parameters W, T, and X determine the sensitivity and speed of the alignment. The BLASTN program (for nucleotide sequences) uses as defaults a word size (W) of 28, an expectation (E) of 10, M=1, N=−2, and a comparison of both strands. For amino acid sequences, the BLASTP program uses as defaults a word size (W) of 3, an expectation (E) of 10, and the BLOSUM62 scoring matrix (see Henikoff& Henikoff, *Proc. Natl. Acad. Sci. USA* 89:10915 (1989)). The BLAST algorithm also performs a statistical analysis of the similarity between two sequences (see, e.g., Karlin & Altschul, *Proc. Nat'l. Acad. Sci. USA* 90:5873-5787 (1993)). One measure of similarity provided by the BLAST algorithm is the smallest sum probability (P(N)), which provides an indication of the probability by which a match between two nucleotide or amino acid sequences would occur by chance. For example, an amino acid sequence is considered similar to a reference sequence if the smallest sum probability in a comparison of the test amino acid sequence to the reference amino acid sequence is less than about 0.01, more preferably less than about $10^{-5}$, and most preferably less than about $10^{-20}$.

As used herein, the term "interleukin 27 receptor" or "IL27R" refers to a heterodimeric receptor formed by subunits IL27Rα (IL27Rα) and glycoprotein 130 (gp130) and bound by the ligand IL27. The human sequence of IL27Rα is listed as UniProt ID NO. Q6UWB1. The human sequence of gp130 is listed as UniProt ID NO. Q13514.

Intracellular Signaling: As used herein, the terms "intracellular signaling" and "downstream signaling" are used interchangeably to refer to the to the cellular signaling process that is caused by the interaction of the intracellular domains (ICDs) of two or more cell surface receptors that are in proximity of each other. In receptor complexes via the JAK/STAT pathway, the association of the ICDS of the receptor subunits brings the JAK domains of the ICDs into proximity which initiates a phosphorylation cascade in which STAT molecules are phosphorylated and translocate to the nucleus associating with particular nucleic acid sequences resulting in the activation and expression of particular genes in the cell. The binding molecules of the present disclosure provide intracelluar signaling characteristic of the IL-27 receptor when activated by its natural cognate IL27. To measure downstream signaling activity, a number of methods are available. For example, in some embodiments, one can measure JAK/STAT signaling by the presence of phosphorylated receptors and/or phosphorylated STATs. In other embodiments, the expression of one or more downstream genes, whose expression levels can be affected by the level of downstream signaling caused by the binding molecule, can also be measured.

Ligand: As used herein, the term "ligand" refers to a molecule that exhibits specific binding to a receptor and results in a change in the biological activity of the receptor so as to effect a change in the activity of the receptor to which it binds. In one embodiment, the term "ligand" refers to a molecule, or complex thereof, that can act as an agonist or antagonist of a receptor. As used herein, the term "ligand" encompasses natural and synthetic ligands. "Ligand" also encompasses small molecules, e.g., peptide mimetics of cytokines and peptide mimetics of antibodies. The complex of a ligand and receptor is termed a "ligand-receptor complex."

As used herein, the term "linker" refers to a linkage between two elements, e.g., protein domains. A linker can be a covalent bond or a peptide linker. The term "bond" refers to a chemical bond, e.g., an amide bond or a disulfide bond, or any kind of bond created from a chemical reaction, e.g., chemical conjugation. The term "peptide linker" refers to an amino acid or polypeptide that may be employed to link two protein domains to provide space and/or flexibility between the two protein domains.

Modulate: As used herein, the terms "modulate", "modulation" and the like refer to the ability of a test agent to affect a response, either positive or negative or directly or indirectly, in a system, including a biological system or biochemical pathway.

Multimerization: As used herein, the term "multimerization" refers to two or more cell surface receptors, or domains or subunits thereof, being brought in close proximity to each other such that the receptors, or domains or subunits thereof, can interact with each other and cause intracellular signaling.

N-Terminus: As used herein in the context of the structure of a polypeptide, "N-terminus" (or "amino terminus") and "C-terminus" (or "carboxyl terminus") refer to the extreme amino and carboxyl ends of the polypeptide, respectively, while the terms "N-terminal" and "C-terminal" refer to relative positions in the amino acid sequence of the polypeptide toward the N-terminus and the C-terminus, respectively, and can include the residues at the N-terminus and C-terminus, respectively. The terms "immediately N-terminal" or "immediately C-terminal" are used to refers to a position of a first amino acid residue relative to a second amino acid residue where the first and second amino acid residues are covalently bound to provide a contiguous amino acid sequence.

Nucleic Acid: The terms "nucleic acid", "nucleic acid molecule", "polynucleotide" and the like are used interchangeably herein to refer to a polymeric form of nucleotides of any length, either deoxyribonucleotides or ribonucleotides, or analogs thereof. Non-limiting examples of polynucleotides include linear and circular nucleic acids, messenger RNA (mRNA), complementary DNA (cDNA), recombinant polynucleotides, vectors, probes, primers and the Operably Linked: The term "operably linked" is used herein to refer to the relationship between nucleic acid sequences encoding differing functions when combined into a single nucleic acid sequence that, when introduced into a cell, provides a nucleic acid which is capable of effecting the transcription and/or translation of a particular nucleic acid sequence in a cell. For example, DNA for a signal sequence is operably linked to DNA for a polypeptide if it is expressed as a preprotein that participates in the secretion of the polypeptide; a promoter or enhancer is operably linked to a coding sequence if it affects the transcription of the sequence; or a ribosome binding site is operably linked to a coding sequence if it is positioned so as to facilitate translation. Generally, "operably linked" means that the DNA sequences being linked are contiguous, and, in the case of a secretory leader, contiguous and in reading phase. However, certain genetic elements such as enhancers need not be contiguous with respect to the sequence to which they provide their effect.

Partial Agonist: As used herein, the term "partial agonist" refers to a molecule that specifically binds that bind to and activate a given receptor but possess only partial activation the receptor relative to a full agonist. Partial agonists may display both agonistic and antagonistic effects. For example, when both a full agonist and partial agonist are present, the partial agonist acts as a competitive antagonist by competing with the full agonist for the receptor binding resulting in net decrease in receptor activation relative to the contact of the receptor with the full agonist in the absence of the partial agonist. Clinically, partial agonists can be used to activate receptors to give a desired submaximal response when inadequate amounts of the endogenous ligand are present, or they can reduce the overstimulation of receptors when excess amounts of the endogenous ligand are present. The maximum response (Emax) produced by a partial agonist is called its intrinsic activity and may be expressed on a percentage scale where a full agonist produced a 100% response. A In some embodiments, the IL-27 binding molecule has a reduced $E_{max}$ compared to the $E_{max}$ caused by IL-27. $E_{max}$ reflects the maximum response level in a cell type that can be obtained by a ligand (e.g., a binding molecule described herein or the native cytokine (e.g., IL-27)). In some embodiments, the IL-27 binding molecule described herein has at least 1% (e.g., between 1% and 100%, between 10% and 100%, between 20% and 100%, between 30% and 100%, between 40% and 100%, between 50% and 100%, between 60% and 100%, between 70% and 100%, between 80% and 100%, between 90% and 100%, between 1% and 90%, between 1% and 80%, between 1% and 70%, between 1% and 60%, between 1% and 50%, between 1% and 40%, between 10% and 30%, between 10% and 20%, or between 10% and 10%) of the $E_{max}$ caused by IL-27. In other embodiments, the $E_{max}$ of the IL-27 binding molecule described herein is greater (e.g., at least 1%, 5%, 10%, 15%, 20%, 25%, 30%, 35%, 40%, 45%, or 50% greater) than the $E_{max}$ of the natural ligand, IL-27. In some embodiments, by varying the linker length of the IL-27 binding molecule, the $E_{max}$ of the IL-27 binding molecule can be changed. The IL-27 binding molecule can cause $E_{max}$ in the most desired cell types, and a reduced $E_{max}$ in other cell types.

Polypeptide: As used herein the terms "polypeptide," "peptide," and "protein", used interchangeably herein, refer to a polymeric form of amino acids of any length, which can include genetically coded and non-genetically coded amino acids, chemically or biochemically modified or derivatized amino acids, and polypeptides having modified polypeptide backbones. The terms include fusion proteins, including, but not limited to, fusion proteins with a heterologous amino acid sequence; fusion proteins with heterologous and homologous leader sequences; fusion proteins with or without N-terminus methionine residues; fusion proteins with immunologically tagged proteins; fusion proteins of immunologically active proteins (e.g. antigenic diphtheria or tetanus toxin fragments) and the like.

As used herein the terms "prevent", "preventing", "prevention" and the like refer to a course of action initiated with respect to a subject prior to the onset of a disease, disorder, condition or symptom thereof so as to prevent, suppress, inhibit or reduce, either temporarily or permanently, a subject's risk of developing a disease, disorder, condition or the like (as determined by, for example, the absence of clinical symptoms) or delaying the onset thereof, generally in the context of a subject predisposed due to genetic, experiential or environmental factors to having a particular disease, disorder or condition. In certain instances, the terms "prevent", "preventing", "prevention" are also used to refer to the slowing of the progression of a disease, disorder or condition from a present its state to a more deleterious state.

Proximity: As used herein, the term "proximity" refers to the spatial proximity or physical distance between two cell surface receptors, or domains or subunits thereof, after a binding molecule described herein binds to the two cell surface receptors, or domains or subunits thereof. In some embodiments, after the binding molecule binds to the cell surface receptors, or domains or subunits thereof, the spatial proximity between the cell surface receptors, or domains or subunits thereof, can be, e.g., less than about 500 angstroms, such as e.g., a distance of about 5 angstroms to about 500 angstroms. In some embodiments, the spatial proximity amounts to less than about 5 angstroms, less than about 20 angstroms, less than about 50 angstroms, less than about 75 angstroms, less than about 100 angstroms, less than about 150 angstroms, less than about 250 angstroms, less than about 300 angstroms, less than about 350 angstroms, less than about 400 angstroms, less than about 450 angstroms, or less than about 500 angstroms. In some embodiments, the spatial proximity amounts to less than about 100 angstroms. In some embodiments, the spatial proximity amounts to less than about 50 angstroms. In some embodiments, the spatial proximity amounts to less than about 20 angstroms. In some embodiments, the spatial proximity amounts to less than about 10 angstroms. In some embodiments, the spatial proximity ranges from about 10 to 100 angstroms, from about 50 to 150 angstroms, from about 100 to 200 angstroms, from about 150 to 250 angstroms, from about 200 to 300 angstroms, from about 250 to 350 angstroms, from about 300 to 400 angstroms, from about 350 to 450 angstroms, or about 400 to 500 angstroms. In some embodiments, the spatial proximity amounts to less than about 250 angstroms, alternatively less than about 200 angstroms, alternatively less than about 150 angstroms, alternatively less than about 120 angstroms, alternatively less than about 100 angstroms, alternatively less than about 80 angstroms, alternatively less than about 70 angstroms, or alternatively less than about 50 angstroms.

Receptor: As used herein, the term "receptor" refers to a polypeptide having a domain that specifically binds a ligand that binding of the ligand results in a change to at least one biological property of the polypeptide. In some embodiments, the receptor is a "soluble" receptor that is not associated with a cell surface. In some embodiments, the receptor is a cell surface receptor that comprises an extracellular domain (ECD) and a membrane associated domain which serves to anchor the ECD to the cell surface. In some embodiments of cell surface receptors, the receptor is a membrane spanning polypeptide comprising an intracellular domain (ICD) and extracellular domain (ECD) linked by a membrane spanning domain typically referred to as a transmembrane domain (TM). The binding of the ligand to the receptor results in a conformational change in the receptor resulting in a measurable biological effect. In some instances, where the receptor is a membrane spanning polypeptide comprising an ECD, TM and ICD, the binding of the ligand to the ECD results in a measurable intracellular biological effect mediated by one or more domains of the ICD in response to the binding of the ligand to the ECD. In some embodiments, a receptor is a component of a multi-component complex to facilitate intracellular signaling. For example, the ligand may bind a cell surface molecule having not associated with any intracellular signaling alone but upon ligand binding facilitates the formation of a multimeric complex that results in intracellular signaling.

Recombinant: As used herein, the term "recombinant" is used as an adjective to refer to the method by a polypeptide, nucleic acid, or cell that was modified using recombinant DNA technology. A recombinant protein is a protein produced using recombinant DNA technology and may be designated as such using the abbreviation of a lower case "r" (e.g., rhIL2) to denote the method by which the protein was produced. Similarly, a cell is referred to as a "recombinant cell" if the cell has been modified by the incorporation (e.g., transfection, transduction, infection) of exogenous nucleic acids (e.g., ssDNA, dsDNA, ssRNA, dsRNA, mRNA, viral or non-viral vectors, plasmids, cosmids and the like) using recombinant DNA technology. The techniques and protocols for recombinant DNA technology are well known in the art such as those can be found in Sambrook, et al. (1989) Molecular Cloning: A Laboratory Manual (2d ed., Cold Spring Harbor Laboratory Press, Plainview, N.Y.) and other standard molecular biology laboratory manuals.

Response: The term "response," for example, of a cell, tissue, organ, or organism, encompasses a quantitative or qualitative change in a evaluable biochemical or physiological parameter, (e.g., concentration, density, adhesion, proliferation, activation, phosphorylation, migration, enzymatic activity, level of gene expression, rate of gene expression, rate of energy consumption, level of or state of differentiation, where the change is correlated with activation, stimulation, or treatment, or with internal mechanisms such as genetic programming. In certain contexts, the terms "activation", "stimulation", and the like refer to cell activation as regulated by internal mechanisms, as well as by external or environmental factors. In contrast, the terms "inhibition", "down-regulation" and the like refer to the opposite effects.

Single Domain Antibody (sdAb): The term "single-domain antibody" or "sdAbs," refers to an antibody having a single (only one) monomeric variable antibody domain. A sdAb is able to bind selectively to a specific antigen. A $V_HH$ antibody, further defined below, is an example of a sdAb.

Specifically Binds: As used herein, the term "specifically bind" refers to the degree of selectivity or affinity for which one molecule binds to another. In the context of binding pairs (e.g., a binding molecule described herein/receptor, a ligand/receptor, antibody/antigen, antibody/ligand, antibody/receptor binding pairs), a first molecule of a binding pair is said to specifically bind to a second molecule of a binding pair when the first molecule of the binding pair does not bind in a significant amount to other components present in the sample. A first molecule of a binding pair is said to specifically bind to a second molecule of a binding pair when the affinity of the first molecule for the second molecule is at least two-fold greater, alternatively at least five times greater, alternatively at least ten times greater, alternatively at least 20-times greater, or alternatively at least 100-times greater than the affinity of the first molecule for other components present in the sample.

Stably Associated: As used herein, the term "stably associated" or "in stable association with" are used to refer to the various means by which one molecule (e.g., a polypeptide) may be associated with another molecule over an extended period of time. The stable association of one molecule to another may be effected by a variety of means, including covalent bonding and non-covalent interactions. In some embodiments, stable association of two molecules may be effected by covalent bonds such as peptide bonds. In other embodiments, stable association of two molecules may be effected b non-covalent interactions. Examples of non-covalent interactions which may provide a stable association between two molecules include electrostatic interactions (e.g., hydrogen bonding, ionic bonding, halogen binding, dipole-dipole interactions, Van der Waals forces and π-effects including cation-π interactions, anion-π interactions and π-π interactions) and hydrophobic/hydrophilic interactions. In some embodiments, the stable association of sdAbs of the bivalent binding molecules of the present disclosure may be effected by non-covalent interactions. In one embodiment, the non-covalent stable association of the sdAbs of the bivalent binding molecules may be achieved by conjugation of the sdAbs to "knob-into-hole" modified Fc monomers. An Fe "knob" monomer stably associates non-covalently with an Fe "hole" monomer. Conjugation of a first sdAb which specifically binds to the extracellular domain of a first subunit of a heterodimeric receptor to an "Fc knob" monomer and conjugation of an second sdAb which specifically binds to the extracellular domain of a second subunit of a heterodimeric receptor to an "Fe hole" monomer provides stable association of the first and second sdAbs. The knob-into-hole modification is more fully described in Ridgway, et al. (1996) Protein Engineering 9(7):617-621 and U.S. Pat. No. 5,731,168, issued Mar. 24, 1998, U.S. Pat. No. 7,642,228, issued Jan. 5, 2010, U.S. Pat. No. 7,695,936, issued Apr. 13, 2010, and U.S. Pat. No. 8,216,805, issued Jul. 10, 2012. The knob-into-hole modification refers to a modification at the interface between two immunoglobulin heavy chains in the CH3 domain, wherein: i) in a CH3 domain of a first heavy chain, an amino acid residue is replaced with an amino acid residue having a larger side chain (e.g., tyrosine or tryptophan) creating a projection from the surface ("knob") and ii) in the CH3 domain of a second heavy chain, an amino acid residue is replaced with an amino acid residue having a smaller side chain (e.g., alanine or threonine), thereby generating a cavity ("hole") within at interface in the second CH3 domain within which the protruding side chain of the first CH3 domain ("knob") is received by the cavity in the second CH3 domain. In one embodiment, the "knob-into-hole modification" comprises the amino acid substitution T366W and optionally the amino acid substitution S354C in one of the antibody heavy chains, and the amino acid substitutions T366S, L368A, Y407V and optionally Y349C in the other one of the antibody heavy chains. Furthermore, the Fc domains may be modified by the introduction of cysteine residues at positions S354 on one chain and Y349 on the second chain which results in a stabilizing disulfide bridge between the two antibody heavy chains in the Fc region (Carter, et al. (2001) Immunol Methods 248, 7-15). The knob-into-hole format is used to facilitate the expression of a first polypeptide (e.g., an IL27Rα binding sdAb) on a first Fe monomer with a "knob" modification and a second polypeptide on the second Fc monomer possessing a "hole" modification to facilitate the expression of heterodimeric polypeptide conjugates.

Subject: The terms "recipient", "individual", "subject", and "patient", are used interchangeably herein and refer to any mammalian subject for whom diagnosis, treatment, or therapy is desired, particularly humans. "Mammal" for purposes of treatment refers to any animal classified as a mammal, including humans, domestic and farm animals, and zoo, sports, or pet animals, such as dogs, horses, cats, cows, sheep, goats, pigs, etc. In some embodiments, the mammal is a human being.

Substantially: As used herein, the term "substantially" refers to a quantity, level, value, number, frequency, percentage, dimension, size, amount, weight or length that is 80%, 85%, 90%, 91%, 92%, 93%, 94%, 95%, 96%, 97%, 98%, 99% or higher of a reference quantity, level, value, number, frequency, percentage, dimension, size, amount, weight or length. In one embodiment, "substantially the same" refers to a quantity, level, value, number, frequency, percentage, dimension, size, amount, weight or length that produces an effect, e.g., a physiological effect, that is approximately the same as a reference quantity, level, value, number, frequency, percentage, dimension, size, amount, weight or length.

Suffering From: As used herein, the term "suffering from" refers to a determination made by a physician with respect to a subject based on the available information accepted in the field for the identification of a disease, disorder or condition including but not limited to X-ray, CT-scans, conventional laboratory diagnostic tests (e.g., blood count), genomic data, protein expression data, immunohistochemistry, that the subject requires or will benefit from treatment. The term suffering from is typically used in conjunction with a particular disease state such as "suffering from a neoplastic disease" refers to a subject which has been diagnosed with the presence of a neoplasm.

Therapeutically Effective Amount: As used herein, the term The phrase "therapeutically effective amount" is used in reference to the administration of an agent to a subject, either alone or as part of a pharmaceutical composition or treatment regimen, in a single dose or as part of a series of doses in an amount capable of having any detectable, positive effect on any symptom, aspect, or characteristic of a disease, disorder or condition when administered to the subject. The therapeutically effective amount can be ascertained by measuring relevant physiological effects, and it may be adjusted in connection with a dosing regimen and in response to diagnostic analysis of the subject's condition, and the like. The parameters for evaluation to determine a therapeutically effective amount of an agent are determined by the physician using art accepted diagnostic criteria including but not limited to indicia such as age, weight, sex, general health, ECOG score, observable physiological parameters, blood levels, blood pressure, electrocardiogram, computerized tomography, X-ray, and the like. Alternatively, or in addition, other parameters commonly assessed in the clinical setting may be monitored to determine if a therapeutically effective amount of an agent has been administered to the subject such as body temperature, heart rate, normalization of blood chemistry, normalization of blood pressure, normalization of cholesterol levels, or any symptom, aspect, or characteristic of the disease, disorder or condition, modification of biomarker levels, increase in duration of survival, extended duration of progression free survival, extension of the time to progression, increased time to treatment failure, extended duration of event free survival, extension of time to next treatment, improvement objective response rate, improvement in the duration of response, and the like that that are relied upon by clinicians in the field for the assessment of an improvement in the condition of the subject in response to administration of an agent.

Treat: The terms "treat", "treating", treatment" and the like refer to a course of action (such as administering a binding molecule described herein, or a pharmaceutical composition comprising same) initiated with respect to a subject after a disease, disorder or condition, or a symptom thereof, has been diagnosed, observed, or the like in the subject so as to eliminate, reduce, suppress, mitigate, or ameliorate, either temporarily or permanently, at least one of the underlying causes of such disease, disorder, or condition afflicting a subject, or at least one of the symptoms associated with such disease, disorder, or condition. The treatment includes a course of action taken with respect to a subject suffering from a disease where the course of action results in the inhibition (e.g., arrests the development of the disease, disorder or condition or ameliorates one or more symptoms associated therewith) of the disease in the subject.

VHH: As used herein, the term "$V_HH$" is a type of sdAb that has a single monomeric heavy chain variable antibody domain. Such antibodies can be found in or produced from Camelid mammals (e.g., camels, llamas) which are naturally devoid of light chains $V_H$Hs can be obtained from immunization of camelids (including camels, llamas, and alpacas (see, e.g., Hamers-Casterman, et al. (1993) Nature 363:446-448) or by screening libraries (e.g., phage libraries) constructed in $V_H$H frameworks. Antibodies having a given specificity may also be derived from non-mammalian sources such as $V_H$Hs obtained from immunization of cartilaginous fishes including, but not limited to, sharks. In a particular embodiment, a $V_H$H in a bispecific $V_HH^2$ binding molecule described herein binds to a receptor (e.g., the first receptor or the second receptor of the natural or non-natural receptor pairs) if the equilibrium dissociation constant between the $V_H$H and the receptor is greater than about $10^{-6}$M, alternatively greater than about $10^{-8}$ M, alternatively greater than about $10^{-10}$ M, alternatively greater than about $10^{-11}$ M, alternatively greater than about $10^{-10}$ M, greater than about $10^{-12}$ M as determined by, e.g., Scatchard analysis (Munsen, et al. 1980 Analyt. Biochem. 107:220-239). Standardized protocols for the generation of single domain antibodies from camelids are well known in the scientific literature. See, e.g., Vincke, et al (2012) Chapter 8 in Methods in Molecular Biology, Walker, J. editor (Humana Press, Totowa NJ). Specific binding may be assessed using techniques known in the art including but not limited to competition ELISA, BIACORE® assays and/or KINEXA® assays. In some embodiments, a $V_H$H described herein can be humanized to contain human framework regions. Examples of human germlines that could be used to create humanized $V_H$Hs include, but are not limited to, VH3-23 (e.g., UniProt ID: P01764), VH3-74 (e.g., UniProt ID: A0A0B4J1X5), VH3-66 (e.g., UniProt ID: A0A0C4DH42), VH3-30 (e.g., UniProt ID: P01768), VH3-11 (e.g., UniProt ID: P01762), and VH3-9 (e.g., UniProt ID: P01782).

$V_HH2$: As used herein, the term "$V_HH2$" and "bispecific $V_HH2$" and "$V_H$H dimer" refers to are used interchangeably to refer to a subtype of the binding molecules of the present disclosure wherein the first and second sdAbs are both VHHs and first $V_H$H binding to a first receptor, or domain or subunit thereof, and a second $V_H$H binding to a second receptor, or domain or subunit thereof.

Wild Type: As used herein, the term "wild type" or "WT" or "native" is used to refer to an amino acid sequence or a nucleotide sequence that is found in nature and that has not been altered by the hand of man.

III. IL27 Receptor Binding Proteins

The IL27 receptor (IL27R) includes IL27Rα subunit (IL27Rα) and glycoprotein 130 subunit (gp130). Provided herein is an IL27R binding protein that specifically binds to IL27Rα and gp130. In some embodiments, the IL27R binding protein binds to a mammalian cell expressing both IL27Rα and gp130. In some embodiments, the IL27R binding protein can be a bispecific $V_HH^2$ as described below.

The IL27R binding protein can be a bispecific $V_HH^2$ that has a first $V_H$H binding to IL27Rα (an anti-IL27Rα $V_H$H antibody) and a second $V_H$H binding to gp130 (an anti-gp130 $V_H$H antibody) and causes the dimerization of the two receptor subunits and downstream signaling when bound to a cell expressing IL27Rα and gp130, e.g., a CD8$^+$ T cells, a CD4$^+$ T cells, and/or a T regulatory (Treg) cell.

A $V_H$H is a type of single-domain antibody (sdAb) containing a single monomeric variable antibody domain. Like a full-length antibody, it is able to bind selectively to a specific antigen. The complementary determining regions (CDRs) of $V_H$Hs are within a single-domain polypeptide. VHHs can be engineered from heavy-chain antibodies found in camelids.

An exemplary $V_H$H has a molecular weight of approximately 12-15 kDa which is much smaller than traditional mammalian antibodies (150-160 kDa) composed of two heavy chains and two light chains. VHHs can be found in or produced from Camelidae mammals (e.g., camels, llamas, dromedary, alpaca, and guanaco) which are naturally devoid of light chains. Descriptions of sdAbs and $V_H$HS can be found in, e.g., De Greve et al., *Curr Opin Biotechnol.* 61:96-101, 2019; Ciccarese, et al., Front Genet. 10:997, 2019; Chanier and Chames, *Antibodies (Basel)* 8(1), 2019; and De Vlieger et al., *Antibodies (Basel)* 8(1), 2018.

To prepare a binding protein that is a bispecific $V_HH^2$, in some embodiments, the two VHHs can be synthesized separately, then joined together by a linker. Alternatively, the bispecific $V_HH^2$ can be synthesized as a fusion protein. $V_H$Hs having different binding activities and receptor targets can be paired to make a bispecific $V_HH^2$. The binding proteins can be screened for signal transduction on cells carrying one or both relevant receptors.

In some embodiments, a bispecific $V_HH^2$ comprises:

A first $V_H$H antibody comprising a CDR1 having at least 90% (e.g., 91%, 92%, 93%, 94%, 95%, 96%, 97%, 98%, 99%, or 100%) sequence identity, or having 0, 1, 2, or 3 amino acid changes, optionally conservative amino acid changes relative, to the sequence of a CDR1 from a row of Table 1A; a CDR2 having at least 90% (e.g., 91%, 92%, 93%, 94%, 95%, 96%, 97%, 98%, 99%, or 100%) sequence identity, or having 0, 1, 2, or 3 amino acid changes, optionally conservative amino acid changes relative, to the sequence of a CDR2 from the same row of Table 1A; and a CDR3 having at least 90% (e.g., 91%, 92%, 93%, 94%, 95%, 96%, 97%, 98%, 99%, or 100%) sequence identity, or having 0, 1, 2, or 3 amino acid changes, optionally conservative amino acid changes relative, to the sequence of a CDR3 from the same row of Table 1A; and a second V$_H$H antibody comprising a CDR1 having at least 90% (e.g., 91%, 92%, 93%, 94%, 95%, 96%, 97%, 98%, 99%, or 100%) sequence identity, or having 0, 1, 2, or 3 amino acid changes, optionally conservative amino acid changes relative, to the sequence of a CDR4 from the same row of Table 1A; a CDR2 having at least 90% (e.g., 91%, 92%, 93%, 94%, 95%, 96%, 97%, 98%, 99%, or 100%) sequence identity, or having 0, 1, 2, or 3 amino acid changes, optionally conservative amino acid changes relative, to the sequence of a CDR5 from the same row of Table 1A; and a CDR3 having at least 90% (e.g., 91%, 92%, 93%, 94%, 95%, 96%, 97%, 98%, 99%, or 100%) sequence identity, or having 0, 1, 2, or 3 amino acid changes optionally conservative amino acid changes relative, to the sequence of a CDR6 from the same row of Table TA. In some embodiments, the bispecific V$_H$H comprises a sequence at least 90% (e.g., 91%, 92%, 93%, 94%, 95%, 96%, 97%, 98%, 99%, or 100%) identical to any one of the dual V$_H$H dimer sequences shown in Table TA.

In some embodiments, a V$_H$H described herein can be humanized to contain human framework regions. Examples of human germlines that could be used to create humanized VHHs include, but are not limited to, VH43-23 (e.g., UniProt ID: P01764), VH43-74 (e.g., UniProtID: A0A0B4J1X5), VH43-66 (e.g., UniProtID: A0A0C4DH42), VH43-30 (e.g., UniProt ID: P01768), VH43-11 (e.g., UniProt ID: P01762), and VH43-9 (e.g., UniProt ID: P01782). Table 1A:

TABLE 1A

| Name | SEQ ID NO: | Sequence of dual VHH dimer | SEQ ID NO: | CDR1 | SEQ ID NO: | CDR2 | SEQ ID NO: | CDR3 | SEQ ID NO: | CDR4 | SEQ ID NO: | CDR5 | SEQ ID NO: | CDR6 |
|---|---|---|---|---|---|---|---|---|---|---|---|---|---|---|
| hIL27Ra-VHH1-DR591 | 406 | QVQLQESGGGLVQPGGSLRLSCAASGFTFSSYPMSWVRQAPGKGLEWISTISAGGDTTLYADSVKGRFTSSRDNAKNTLYLQLNSLKTEDAAIYYCAKRIDCNSGYCYRRNYWQGTQVTVSSGGGSQVQLQESGGGSVQAGGSLRLSCTASGAIASGYIDSRWCMAWFRQAPGKEREGVAAIWPGGGLTVYADSVKGRFTISRDHAKNTLYLQMNNLKPEDTAMYYCAAGSPRMCPSLEFGFDYWGQGTQVTVSS | 211 | FTFSSYPMSFS | 218 | TISAGGDTLYAPDSMVKG | 947 | RIDCNSGYCRRNY | 943 | AIASGYIDSRWCMA | 199 | AIWPGGGLTVYADSVKG | 205 | GSPRMCPSLEFGFDY |
| hIL27Ra-VHH2-DR591 | 407 | QVQLQESGGGLVQPGGSLRLSCAASGFTFSLSGMSWVRQAPGKGLEWVSAISSGGASTYYTDSVKGRFTISRDNAKNILYLQLNSLKTEDTAMYYCAKGGSGYGDASRMTSPGSQGTQVTVSSGGGSQVQLQESGGGSVQAGGSLRLSCTASGAIASGYIDSRWCMAWFRQAPGKEREGVAAIWPGGGLTVYADSVKGRFTISRDHAKNTLYLQMNNLKPEDTAMYYCAAGSPRMCPSLEFGFDYWGQGTQVTVSS | 940 | FTFSLSGMSLS | 224 | AISSGGASTYLSG | 231 | GGSGYGDASRMTSP | 943 | AIASGYIDSRWCMA | 199 | AIWPGGGLTVYADSVKG | 205 | GSPRMCPSLEFGFDY |
| hIL27Ra-VHH3-DR591 | 408 | QVQLQESGGGSVQAGGSLRLSCVASGYVSCDYFLPSWYRQAPGKEREFVSIIDGTGSTSYAASVKGRFTASEDKGKNIAYLQMNSLKPEDTAMYYCKASCVRGRAVSEYWGQGTQVTVSSGGGSQVQLQESGGGSVQAGGSLRLSCTASGAIASGYIDSRWCMAWFRQAPGKEREGVAAIWPGGGLTVYADSVKGRFTISRDHAKNTLYLQMNNLKPEDTAMYYCAAGSPRMCPSLEFGFDYWGQGTQVTVSS | 215 | YVSCDYFLPS | 222 | IIDGTGSTSYAASVKG | 948 | SCVRGRAVSEY | 943 | AIASGYIDSRWCMA | 199 | AIWPGGGLTVYADSVKG | 205 | GSPRMCPSLEFGFDY |
| hIL27Ra-VHH4-DR591 | 409 | QVQLQESGGGLVQPGESLRLSCTASGFTFSNYAMSWVRQAPGKGLEWVSGINVAYGITSYADSVKGRFTISRDNTKNTLYLQLNSLKTEDTAIYYCVKHSGTTIPRGFISYTKRGQGTQVTVSSGGGSQVQLQESGGGSVQAGG | 212 | FTFSNYAMSNYA | 219 | GINVAYGITSYADS | 226 | HSGTTIPRGFISYTK | 943 | AIASGYIDSRWCMA | 199 | AIWPGGGLTVYADSVKG | 205 | GSPRMCPSLEFGFDY |

TABLE 1A-continued

| Name | SEQ ID NO: | Sequence of dual VHH dimer | SEQ ID NO: | CDR1 | SEQ ID NO: | CDR2 | SEQ ID NO: | CDR3 | SEQ ID NO: | CDR4 | SEQ ID NO: | CDR5 | SEQ ID NO: | CDR6 |
|---|---|---|---|---|---|---|---|---|---|---|---|---|---|---|
| | | SLRLSCTASGAIASGYID SRWCMAWFRQAPGKEREG VAAIWPGGGLTVYADSVK GRFTISRDHAKNTLYLQM NNLKPEDTAMYYCAAGSP RMCPSLEFGFDYWGQGTQ VTVSS | | S | | G | | | | | | | | |
| hIL27Ra-VHH5-DR591 | 410 | QVQLQESGGGSVQAGGSL RLSCTASGYVSCDYFLPS WYRQAPGKEREFVSVIDG TGSTSYAASVKGRFTASQ DKGKNIAYLQMNSLKPED TAMYYCKASCVRGRAISE YWGQGTQVTVSSGGGSQV QLQESGGGSVQAGGSLRL SCTASGAIASGYIDSRWC MAWFRQAPGKEREGVAAI WPGGGLTVYADSVKGRFT ISRDHAKNTLYLQMNNLK PEDTAMYYCAAGSPRMCP SLEFGFDYWGQGTQVTVS S | 215 | YVSCDYFLPS | 944 | VIDGTGSTSYAASVKG | 229 | SCVRGRAISEY | 943 | AIASGYIDSRWCMA | 199 | AIWPGGGLTVYADSVKG | 205 | GSPRMCPSLEFGFDY |
| hIL27Ra-VHH6-DR591 | 411 | QVQLQESGGGLVQPGGSL RLSCAASGFSFSSYAMKW VRQAPGKGLEWVSTISSG GSSTNYADSVKGRFTISR DNKNTLYLQLNSLKIED TAMYYCAKAIVPTGATME RGQGTQVTVSSGGGSQVQ LQESGGGSVQAGGSLRLS CTASGAIASGYIDSRWCM AWFRQAPGKEREGVAAIW PGGGLTVYADSVKGRFTI SRDHAKNTLYLQMNNLKP EDTAMYYCAAGSPRMCPS LEFGFDYWGQGTQVTVSS | 213 | FSFSSYAMK | 220 | TISSGGSSTNYADSVK G | 227 | AIVPTGATMERG | 943 | AIASGYIDSRWCMA | 199 | AIWPGGGLTVYADSVKG | 205 | GSPRMCPSLEFGFDY |
| hIL27Ra-VHH7-DR591 | 412 | QVQLQESGGGLVQPGGSL RLSCAASGFTFSSYPMSW VRQAPGKGLEWISTISAG GDTTLYADSVKGRFTSSR DNAKNTLYLQLNSLKTED TAIYYCAKRIDCNSGYCY RRNYWGQGTQVTVSSGGG SQVQLQESGGGSVQAGGS LRLSCTASGAIASGYIDS RWCMAWFRQAPGKEREGV AAIWPGGGLTVYADSVKG RFTISRDHAKNTLYLQMN NLKPEDTAMYYCAAGSPR MCPSLEFGFDYWGQGTQV TVSS | 211 | FTFSSYPMS | 218 | TISAGGDTIYADSVKG | 947 | RIDCNSGYCYRRNY | 943 | AIASGYIDSRWCMA | 199 | AIWPGGGLTVYADSVKG | 205 | GSPRMCPSLEFGFDY |
| hIL27Ra-VHH8-DR591 | 413 | QVQLQESGGGSVQVGGSL RLSCAASGFTFSSYPMSW VRQAPGKGLEWISTISAG GDTTLYADSVKGRFTSSR DNAKNTLYLQLNSLKTED TAIYYCAKRIDCNSGYCY RRNYWGQGTQVTVSSGGG SQVQLQESGGGSVQAGGS LRLSCTASGAIASGYIDS RWCMAWFRQAPGKEREGV AAIWPGGGLTVYADSVKG RFTISRDHAKNTLYLQMN NLKPEDTAMYYCAAGSPR MCPSLEFGFDYWGQGTQV TVSS | 211 | FTFSSYPMS | 218 | TISAGGDTLYADSVKG | 947 | RIDCNSGYCYRRNY | 943 | AIASGYIDSRWCMA | 199 | AIWPGGGLTVYADSVKG | 205 | GSPRMCPSLEFGFDIY |
| hIL27Ra-VHH9-DR591 | 414 | QVQLQESGGGSVQSGGSL RLSCAASGFTYSTSNSWM AWFRQAPGKEREGVAAIY TVGGSIFYADSVRGRFTI SQDATKNMFYLQMNTLKP | 214 | FTYSTSNSWM | 221 | AIYTVGGSIFYADSVR G | 228 | ASGRLRGKWF | 943 | AIASGYIDSRWCMA | 199 | AIWPGGGLTVYADSVKG | 205 | GSPRMCPSLE |

TABLE 1A-continued

| Name | SEQ ID NO: | Sequence of dual VHH dimer | SEQ ID NO: | CDR1 | SEQ ID NO: | CDR2 | SEQ ID NO: | CDR3 | SEQ ID NO: | CDR4 | SEQ ID NO: | CDR5 | SEQ ID NO: | CDR6 |
|---|---|---|---|---|---|---|---|---|---|---|---|---|---|---|
| | | EDTAMYYCAAASGRLRGK WFWPYEYNYWGQGTQVTV SSGGGSQVQLQESGGGSV QAGGSLRLSCTASGAIAS GYIDSRWCMAWFRQAPGK EREGVAAIWPGGGLTVYA DSVKGRFTISRDHAKNTL YLQMNNLKPEDTAMYYCA AGSPRMCPSLEFGFDYWG QGTQVTVSS | | S N S W M A | | YA DS VR G | | WP YE YN Y | | | | KG | | FG FD Y |
| hIL27Ra-VHH10-DR591 | 415 | QVQLQESGGGSVQAGGSL RLSCRASGSTYSNYCLGW FRQITGKEREGVAVINWV GGMLYFADSVKGRFTVSQ DQAKNTLYLQMNSLKPED TAMYYCAAESVSSFSCGG WLTRPDRVPYWGQGTQVT VSSGGGSQVQLQESGGGS VQAGGSLRLSCTASGAIA SGYIDSRWCMAWFRQAPG KEREGVAAIWPGGGLTVY ADSVKGRFTISRDHAKNT LYLQMNNLKPEDTAMYYC AAGSPRMCPSLEFGFDYW GQGTQVTVSS | 216 | S T Y S N Y C L G | 223 | VI NW VG GM LY FA DS VK G | 230 | ES VS SF SC GG WL TR PD RV PY | 943 | AIA SGY IDS RWC MA | 199 | AIW PGG GLT VYA DSV KG | 205 | GS PR MC PS LE FG FD Y |
| hIL27Ra-VHH11-DR591 | 416 | QVQLQESGGGSVQAGGSL RLSCRASGSTYSNYCLGW FRQSTGKEREGVAVINWV GGMLYFADSVKGRFTVSQ DHAKNTVTLQMNSLKPED TAMYYCAAESVSSFSCGG WLTRPGRVPYWGQGTQVT VSSGGGSQVQLQESGGGS VQAGGSLRLSCTASGAIA SGYIDSRWCMAWFRQAPG KEREGVAAIWPGGGLTVY ADSVKGRFTISRDHAKNT LYLQMNNLKPEDTAMYYC AAGSPRMCPSLEFGFDYW GQGTQVTVSS | 216 | S T Y S N Y C L G | 223 | VI NW VG GM LY FA DS VK G | 949 | ES VS SF SC GG WL TR PG RV PY | 943 | AIA SGY IDS RWC MA | 199 | AIW PGG GLT VYA DSV KG | 205 | GS PR MC PS LE FG FD Y |
| hIL27Ra-VHH12-DR591 | 417 | QVQLQESGGGSVQAGESL RLSCRASGSTYSNYCLGW FRQITGKEREGVAVINWV GGMLYFADSVKGRFTVSQ DQAKNTVYLEMNSLKPED TAMYYCATESVSSFSCGG WLTRPDRVPYWGQGTQVT VSSGGGSQVQLQESGGGS VQAGGSLRLSCTASGAIA SGYIDSRWCMAWFRQAPG KEREGVAAIWPGGGLTVY ADSVKGRFTISRDHAKNT LYLQMNNLKPEDTAMYYC AAGSPRMCPSLEFGFDYW GQGTQVTVSS | 216 | S T Y S N Y C L G | 223 | VI NW VG GM LY FA DS VF G | 230 | ES VS SF SC GG WL TR PD RV PY | 943 | AIA SGY IDS RWC MA | 199 | AIW PGG GLT VYA DSV KG | 205 | GS PR MC PS LE FG FD Y |
| hIL27Ra-VHH13-DR591 | 418 | QVQLQESGGGSVQAGGSL RLSCVASGYVSCDYFLPS WYRQAPGKEREFVSIIDG TGSTSYAASVKGRFTASQ DRGKNIAYLQMNSLKPED TAMYYCKASCVRGRTISE YWGQGTQVTVSSGGGSQV QLQESGGGSVQAGGSLRL SCTASGAIASGYIDSRWC MAWFRQAPGKEREGVAAI WPGGGLTVYADSVKGRFT ISRDHAKNTLYLQMNNLK PEDTAMYYCAAGSPRMCP SLEFGFDYWGQGTQVTVS S | 215 | Y V S C D Y F L P S | 222 | II DG TG ST SY AA SV KG | 950 | SC VR GR TI SE Y | 943 | AIA SGY IDS RWC MA | 199 | AIW PGG GLT VYA DSV KG | 205 | GS PR MC PS LE FG FD Y |

TABLE 1A-continued

| Name | SEQ ID NO: | Sequence of dual VHH dimer | SEQ ID NO: | CDR1 | SEQ ID NO: | CDR2 | SEQ ID NO: | CDR3 | SEQ ID NO: | CDR4 | SEQ ID NO: | CDR5 | SEQ ID NO: | CDR6 |
|---|---|---|---|---|---|---|---|---|---|---|---|---|---|---|
| hIL27Ra-VHH14-DR591 | 419 | QVQLQESGGGSVQAGGSLRLSCVASGYVSCDYFLPSWYRQAPGKEREFVSIIDGTGSTSYAASVKGRFTASQDKGKNIAYLQMNSLKPEDTAMYYCKASCVRGRAISEYWGQGTQVTVSSGGGSQVQLQESGGGSVQAGGSLRLSCTASGAIASGYIDSRWCMAWFRQAPGKEREGVAAIWPGGGLTVYADSVKGRFTISRDHAKNTLYLQMNNLKPEDTAMYYCAAGSPRMCPSLEFGFDYWGQGTQVTVSS | 215 | YVSCDYFLPS | 222 | IIDGTGSTSYAAFL | 229 | SCVRGRAISEY | 943 | AIASGYIDSRWCMA | 199 | AIWPGGGLTVYADSVKG | 205 | GSPRMCPSLEFGFDY |
| hIL27Ra-VHH15-DR591 | 420 | QVQLQESGGGSVQAGGSLRLSCVASGYVSCDYFLPSWYRQAPGKEREFVSIIDGTGSTSYAASVKGRFTASQDKGKNIAYLQMNTLKPEDTAMYYCKASCVRGRAISEYWGQGTQVTVSSGGGSQVQLQESGGGSVQAGGSLRLSCTASGAIASGYIDSRWCMAWFRQAPGKEREGVAAIWPGGGLTVYADSVKGRFTISRDHAKNTLYLQMNNLKPEDTAMYYCAAGSPRMCPSLEFGFDYWGQGTQVTVSS | 215 | YVSCDYFLPS | 222 | IIDGTGSTSYAASVKG | 229 | SCVRGRAISEY | 943 | AIASGYIDSRWCMA | 199 | AIWPGGGLTVYADSVKG | 205 | GSPRMCPSLEFGFDY |
| hIL27Ra-VHH16-DR591 | 421 | QVQLQESGGGSVQAGGSLRLSCRASGSTYSNYCLGWFRQITGKEREGVAVINWVGGMLYFADSVKGRFTVSQDQAKNTVYLQMNSLKPEDTAMYYCAAESASSFSCGGWLTRPDRVPYWGQGTQVTVSSGGGSQVQLQESGGGSVQAGGSLRLSCTASGAIASGYIDSRWCMAWFRQAPGKEREGVAAIWPGGGLTVYADSVKGRFTISRDHAKNTLYLQMNNLKPEDTAMYYCAAGSPRMCPSLEFGFDYWGQGTQVTVSS | 216 | STYSNYCLG | 223 | VINWVGGMLYFADSVKG | 951 | ESASSFSCGGWLTRPDRVPY | 943 | AIASGYIDSRWCMA | 199 | AIWPGGGLTVYADSVKG | 205 | GSPRMCPSLEFGFDY |
| hIL27Ra-VH17-DR591 | 422 | QVQLQESGGGLVQPGGSLRLSCAASGFTFSLSGMSWVRQAPGKGLEWVSAISSGGASTYYTDSVKGRFTISRDNAKNMLYLQLNSLKTEDTAMYYCAKGGSGYGDASRMTSPGSQGTQVTVSSGGGSQVQLQESGGGSVQAGGSLRLSCTASGAIASGYIDSRWCMAWFRQAPGKEREGVAAIWPGGGLTVYADSVKGRFTISRDHAKNTLYLQMNNLKPEDTAMYYCAAGSPRMCPSLEFGFDYWGQGTQVTVSS | 940 | FTFSLSGMS | 224 | AISSGGASTYYDSVKG | 231 | GGSGYGDASRMTSPG | 943 | AIASGYIDSRWCMA | 199 | AIWPGGGLTVYADSVKG | 205 | GSPRMCPSLEFGFDY |
| hIL27Ra-VHH18-DR591 | 423 | QVQLQESGGGSVQAGGSLRLSCVASGYVSCDYFLPSWYRQAPGKEREFVSIIDGTGSTSYAASVKGRFTASQDKGKNIAYLQMNSLKPEDTAMYYCKASCVRGRGISEYWGQGTQVTVSSGGGSQVQLQESGGGSVQAGGSLRLSCTASGAIASGYIDSRWC | 215 | YVSCDYFLPS | 222 | IIDGTGSTSYAASVKG | 952 | SCVRGRGISEY | 943 | AIASGYIDSRWCMA | 199 | AIWPGGGLTVYADSVKG | 205 | GSPRMCPSLEFGFDY |

TABLE 1A-continued

| Name | SEQ ID NO: | Sequence of dual VHH dimer | SEQ ID NO: CDR1 | CDR1 | SEQ ID NO: CDR2 | CDR2 | SEQ ID NO: CDR3 | CDR3 | SEQ ID NO: CDR4 | CDR4 | SEQ ID NO: CDR5 | CDR5 | SEQ ID NO: CDR6 | CDR6 |
|---|---|---|---|---|---|---|---|---|---|---|---|---|---|---|
| | | MAWFRQAPGKEREGVAAI WPGGGLTVYADSVKGRFT ISRDHAKNTLYLQMNNLK PEDTAMYYCAAGSPRMCP SLEFGFDYWGQGTQVTVS S | | S | | | | | | | | | | |
| hIL27Ra-VHH19-DR591 | 424 | QVQLQESGGGSVQAGGSL RLSCRASGSTYSNYCLGW FRQITGKEREGVAVINWV GGMLYFADSVKGRFTVSQ DQAKNTVYLQMNSLKPED TAMYYCAAESVSSFSCGG WLTRPDRVPYWGQGTQVT VSSGGGSQVQLQESGGGS VQAGGSLRLSCTASGAIA SGYIDSRWCMAWFRQAPG KEREGVAAIWPGGGLTVY ADSVKGRFTISRDHAKNT LYLQMNNLKPEDTAMYYC AAGSPRMCPSLEFGFDYW GQGTQVTVSS | 216 | S T Y S N Y C L G | 223 | VI NW VG GM LY FA DS VK G | 230 | ES VS SE SC GG WL TR PD RV PY | 943 | AIA SGY IDS RWC MA | 199 | AIW PGG GLT VYA DSV KG | 205 | GS PR MC PS LE FG FD Y |
| hIL27Ra-VHH20-DR591 | 425 | QVQLQESGGGLVQPGGSL RLSCAASGFTFSSYPMSW VRQAPGKGLEWVSTISSG GDTTLYADSVKGRFTSSR DNAKNTLYLQLNSLKTED TAMYYCAKRIDCNSGYCY KRSYWGQGTQVTVSSGGG SQVQLQESGGGSVQAGGS LRLSCTASGAIASGYIDS RWCMAWFRQAPGKEREGV AAIWPGGGLTVYADSVKG RFTISRDHAKNTLYLQMN NLKPEDTAMYYCAAGSPR MCPSLEFGFDYWGQGTQV TVSS | 211 | F T S S S Y P M S | 945 | TI SS GG DT TL YA DS VK G | 953 | RI DC NS GY CY KR SY | 943 | AIA SGY IDS RWC MA | 199 | AIW PGG GLT VYA DSV KG | 205 | GS PR MC PS LE FG FD Y |
| hIL27Ra-VHH21-DR591 | 426 | QVQLQESGGGLVQPGGSL RLSCAASGFTFSLSSMSW VRQAPGKGLEWVSAISSG GASTYYTDSVKGRFTISR DNAKNMLYLQLNSLKTED TAMYYCAKGGSGYGDASR MTSPGSQGTQVTVSSGGG SQVQLQESGGGSVQAGGS LRLSCTASGAIASGYIDS RWCMAWFRQAPGKEREGV AAIWPGGGLTVYADSVKG RFTISRDHAKNTLYLQMN NLKPEDTAMYYCAAGSPR MCPSLEFGFDYWGQGTQV TVSS | 217 | F T F S L S S M S | 224 | AI SS GG AS TY YT DS VK G | 231 | GG SG YG DA SR MT SP | 943 | AIA SGY IDS RWC MA | 199 | AIW PGG GLT VYA DSV KG | 205 | GS PR MC PS LE FG FD Y |
| hIL27Ra-VHH22-DR591 | 427 | QVQLQESGGGSVQAGGSL RLSCRASGSTYSNYCLGW FRQTTGKEREGVAVINWV GGMLYFADSVKGRFTVSQ DQAKNTVYLQMNSLKPED TAMYYCAAESVSSFSCGG WLTRPDRVPYWGQGTQVT VSSGGGSQVQLQESGGGS VQAGGSLRLSCTASGAIA SGYIDSRWCMAWFRQAPG KEREGVAAIWPGGGLTVY ADSVKGRFTISRDHAKNT LYLQMNNLKPEDTAMYYC AAGSPRMCPSLEFGFDYW GQGTQVTVSS | 216 | S T Y S N Y C L G | 223 | VI NW VG GM LY FA DS VK G | 230 | ES VS SF SC GG WL TR PD RV PY | 943 | AIA SGY IDS RWC MA | 199 | AIW PGG GLT VYA DSV KG | 205 | GS PR MC PS LE FG FD Y |
| hIL27Ra-VHH23-DR591 | 428 | QVQLQESGGGSVQAGGSL RLSCRASRSPYGNYCLGW FRQSTGKEREGVAVINWV GGMLYFADSVKGRFTVSQ DHAKNTVTLQMNSLKPED | 941 | S P Y G N | 223 | VI NW VG GM LY | 230 | ES VS SF SC GG | 943 | AIA SGY IDS RWC MA | 199 | AIW PGG GLT VYA DSV | 205 | GS PR MC PS LE |

TABLE 1A-continued

| Name | SEQ ID NO: | Sequence of dual VHH dimer | SEQ ID NO: | CDR1 | SEQ ID NO: | CDR2 | SEQ ID NO: | CDR3 | SEQ ID NO: | CDR4 | SEQ ID NO: | CDR5 | SEQ ID NO: | CDR6 |
|---|---|---|---|---|---|---|---|---|---|---|---|---|---|---|
| | | TAMYYCAAESVSSFSCGG WLTRPDRVPYWGQGTQVT VSSGGGSQVQLQESGGGS VQAGGSLRLSCTASGAIA SGYIDSRWCMAWFRQAPG KEREGVAAIWPGGGLTVY ADSVKGRFTISRDHAKNT LYLQMNNLKPEDTAMYYC AAGSPRMCPSLEFGFDYW GQGTQVTVSS | | Y C L G | | FA DS VK G | | WL TR PD RV PY | | | | KG | | FG FD Y |
| hIL27Ra-VHH24-DR591 | 429 | QVQLQESGGGLVQPGGSL RLSCAASGFTFSHSGMSW VRQAPGKGLEWVSTINSG GASTYYTDSVKGRFTISR DNAKNMLYLQLNSLKTED TAMYYCAKGGSGYGDASR MTSPGSQGTQVTVSSGGG SQVQLQESGGGSVQAGGS LRLSCTASGAIASGYIDS RWCMAWFRQAPGKEREGV AAIWPGGGLTVYADSVKG RFTISRDHAKNTLYLQMN NLKPEDTAMYYCAAGSPR MCPSLEFGFDYWGQGTQV TVSS | 942 | F T F S H S G M S | 946 | TI NS GG AS TY YT DS VK G | 231 | GG SG YG DA SR MT SP | 943 | AIA SGY IDS RWC MA | 199 | AIW PGG GLT VYA DSV KG | 205 | GS PR MC PS LE FG FD Y |
| hIL27Ra-VHH1-DR592 | 430 | QVQLQESGGGLVQPGGSL RLSCAASGFTFSSYPMSW VRQAPGKGLEWISTISAG GDTTLYADSVKGRFTSSR DNAKNTLYLQLNSLKTED AAIYYCAKRIDCNSGYCY RRNYWGQGTQVTVSSGGG SQVQLQESGGGSVQAGGS LRLSCTAPGFTSNSCGMD WYRQAPGKEREFVSSIST DGTTGYADSVKGRFTISK DKAKDTVYLQMNSLKPED TGMYSCKTKDGTIATMEL CDFGYWGQGTQVTVSS | 211 | F T F S S Y P M S | 218 | TI SA GG DT TL YA DS VK G | 947 | RI DC NS GY CY RR NY | 194 | FTS NSC GMD | 200 | SIS TDG TTG YAD SVK G | 206 | KD GT IA TM EL CD |
| hIL27Ra-VHH2-DR592 | 431 | QVQLQESGGGLVQPGGSL RLSCAASGFTFSLSGMSW VRQAPGKGLEWVSAISSG GASTYYTDSVKGRFTISR DNAKNILYLQLNSLKTED TAMYYCAKGGSGYGDASR MTSPGSQGTQVTVSSGGG SQVQLQESGGGSVQAGGS LRLSCTAPGFTSNSCGMD WYRQAPGKEREFVSSIST DGTTGYADSVKGRFTISK DKAKDTVYLQMNSLKPED TGMYSCKTKDGTIATMEL CDFGYWGQGTQVTVSS | 940 | F T F S L S G M S | 224 | AI SS GG AS TY YT DS VK G | 231 | GG SG YG DA SR MT SP | 194 | FTS NSC GMD | 200 | SIS TDG TTG YAD SVK G | 206 | KD GT IA TM EL CD FG Y |
| hIL27Ra-VHH3-DR592 | 432 | QVQLQESGGGSVQAGGSL RLSCVASGYVSCDYFLPS WYRQAPGKEREFVSIIDG TGSTSYAASVKGRFTASE DKGKNIAYLQMNSLKPED TAMYYCKASCVRGRAVSE YWGQGTQVTVSSGGGSQV QLQESGGGSVQAGGSLRL SCTAPGFTSNSCGMDWYR QAPGKEREFVSSISTDGT TGYADSVKGRFTISKDKA KDTVYLQMNSLKPEDTGM YSCKTKDGTIATMELCDF GYWGQGTQVTVSS | 215 | Y V S C D Y F L P S | 222 | II DG TG ST SY AA SV KG | 948 | SC VR GR AV SE Y | 194 | FTS NSC GMD | 200 | SIS TDG TTG YAD SVK G | 206 | KD GT IA TM EL CD FG Y |
| hIL27Ra-VHH4-DR592 | 433 | QVQLQESGGGLVQPGESL RLSCTASGFTFSNYAMSW VRQAPGKGLEWSGINVA YGITSYADSVKGRFTISR | 212 | F T F S N Y A M S | 219 | GI NV AY GI | 226 | HS GT TI PR | 194 | FTS NSC GMD | 200 | SIS TDG TTG YAD | 206 | KD GT IA TM |

TABLE 1A-continued

| Name | SEQ ID NO: | Sequence of dual VHH dimer | SEQ ID NO: | CDR1 | SEQ ID NO: | CDR2 | SEQ ID NO: | CDR3 | SEQ ID NO: | CDR4 | SEQ ID NO: | CDR5 | SEQ ID NO: | CDR6 |
|---|---|---|---|---|---|---|---|---|---|---|---|---|---|---|
| | | DNTKNTLYLQLNSLKTED TAIYYCVKHSGTTIPRGF ISYTKRGQGTQVTVSSGG GSQVQLQESGGGSVQAGG SLRLSCTAPGFTSNSCGM DWYRQAPGKEREFVSSIS TDGTTGYADSVKGRFTIS KDKAKDTVYLQMNSLKPE DTGMYSCKTKDGTIATME LCDFGYWGQGTQVTVSS | | N Y A M S | | TS YA DS VK G | | GF IS YT K | | | | SVK G | | EL CD FG Y |
| hIL27Ra-VHH5-DR592 | 434 | QVQLQESGGGSVQAGGSL RLSCTASGYVSCDYFLPS WYRQAPGKEREFVSVIDG TGSTSYAASVKGRFTASQ DKGKNIAYLQMNSLKPED TAMYYCKASCVRGRAISE YWGQGTQVTVSSGGGSQV QLQESGGGSVQAGGSLRL SCTAPGFTSNSCGMDWYR QAPGKEREFVSSISTDGT TGYADSVKGRFTISKDKA KDTVYLQMNSLKPEDTGM YSCKTKDGTIATMELCDF GYWGQGTQVTVSS | 215 | YVCDYFLPS | 944 | VI DG TG ST SY AA SV KG | 229 | SC VR GR AI SE Y | 194 | FTS NSC GMD | 200 | SIS TDG TTG YAD SVK G | 206 | KD GT IA TM EL CD FG Y |
| hIL27Ra-VHH6-DR592 | 435 | QVQLQESGGGLVQPGGSL RLSCAASGFSFSSYAMKW VRQAPGKGLEWVSTISSG GSSTNYADSVKGRFTISR DNAKNTLYLQLNSLKIED TAMYYCAKAIVPTGATME RGQGTQVTVSSGGGSQVQ LQESGGGSVQAGGSLRLS CTAPGFTSNSCGMDWYRQ APGKEREFVSSISTDGTT GYADSVKGRFTISKDKAK DTVYLQMNSLKPEDTGMY SCKTKDGTIATMELCDFG YWGQGTQVTVSS | 213 | F S F S S Y A M K | 220 | TI SS GG SS TN YA DS VK G | 227 | AI VP TG AT ME | 194 | FTS NSC GMD | 200 | SIS TDG TTG YAD SVK G | 206 | KD GT IA TM EL CD FG Y |
| hIL27Ra-VHH7-DR592 | 436 | QVQLQESGGGLVQPGGSL RLSCAASGFTFSSYPMSW VRQAPGKGLEWISTISAG GDTTLYADSVKGRFTSSR DNAKNTLYLQLNSLKTED TAIYYCAKRIDCNSGYCY RRNYWGQGTQVTVSSGGG SQVQLQESGGGSVQAGGS LRLSCTAPGFTSNSCGMD WYRQAPGKEREFVSSIST DGTTGYADSVKGRFTISK DKAKDTVYLQMNSLKPED TGMYSCKTKDGTIATMEL CDFGYWGQGTQVTVSS | 211 | F T F S S Y P M S | 218 | TI SA GG DT TL YA DS VK G | 947 | RI DC NS GY CY RR NY | 194 | FTS NSC GMD | 200 | SIS TDG TTG YAD SVK G | 206 | KD GT IA TM EL CD FG Y |
| hIL27Ra-VHH8-DR592 | 437 | QVQLQESGGGSVQVGGSL RLSCAASGFTFSSYPMSW VRQAPGKGLEWISTISAG GDTTLYADSVKGRFTSSR DNAKNTLYLQLNSLKTED TAIYYCAKRIDCNSGYCY RRNYWGQGTQVTVSSGGG SQVQLQESGGGSVQAGGS LRLSCTAPGFTSNSCGMD WYRQAPGKEREFVSSIST DGTTGYADSVKGRFTISK DKAKDTVYLQMNSLKPED TGMYSCKTKDGTIATMEL CDFGYWGQGTQVTVSS | 211 | F T F S S Y P M S | 218 | TI SA GG DT TL YA DS VK G | 947 | RI DC NS GY CY RR NY | 194 | FTS NSC GMD | 200 | SIS TDG TTG YAD SVK G | 206 | KD GT IA TM EL CD FG Y |
| hIL27Ra-VHH9-DR592 | 438 | QVQLQESGGSVQSGGSL RLSCAASGFTYSTSNSWM AWFRQAPGKEREGVAAIY TVGGSIFYADSVRGRFTI SQDATKNMFYLQMNTLKP | 214 | F T Y S T | 221 | AI YT VG GS IF | 228 | AS GR LR GK WE | 194 | FTS NSC GMD | 200 | SIS TDG TTG YAD SVK | 206 | KD GT IA TM EL |

TABLE 1A-continued

| Name | SEQ ID NO: | Sequence of dual VHH dimer | SEQ ID NO: | CDR1 | SEQ ID NO: | CDR2 | SEQ ID NO: | CDR3 | SEQ ID NO: | CDR4 | SEQ ID NO: | CDR5 | SEQ ID NO: | CDR6 |
|---|---|---|---|---|---|---|---|---|---|---|---|---|---|---|
| | | EDTAMYYCAAASGRLRGK WFWPYEYNYWGQGTQVTV SSGGGSQVQLQESGGGSV QAGGSLRLSCTAPGFTSN SCGMDWYRQAPGKEREFV SSISTDGTTGYADSVKGR FTISKDKAKDTVYLQMNS LKPEDTGMYSCKTKDGTI ATMELCDFGYWGQGTQVT VSS | | S N S W M A | | YA DS VR G | | WP YE YN Y | | | | G | | CD FG Y |
| hIL27Ra-VHH10-DR592 | 439 | QVQLQESGGGSVQAGGSL RLSCRASGSTYSNYCLGW FRQITGKEREGVAVINWV GGMLYFADSVKGRFTVSQ DQAKNTLYLQMNSLKPED TAMYYCAAESVSSFSCGG WLTRPDRVPYWGQGTQVT VSSGGGSQVQLQESGGGS VQAGGSLRLSCTAPGFTS NSCGMDWYRQAPGKEREF VSSISTDGTTGYADSVKG RFTISKDKAKDTVYLQMN SLKPEDTGMYSCKTKDGT IATMELCDFGYWGQGTQV TVSS | 216 | S T Y S N Y C L G | 223 | VI NW VG GM LY FA DS VK G | 230 | ES VS SF SC GG WL TR PD RV PY | 194 | FTS NSC GMD | 200 | SIS TDG TTG YAD SVK G | 206 | KD GT IA TM EL CD FG Y |
| hIL27Ra-VHH11-DR592 | 440 | QVQLQESGGGSVQAGGSL RLSCRASGSTYSNYCLGW FRQSTGKEREGVAVINWV GGMLYFADSVKGRFTVSQ DHAKNTVTLQMNSLKPED TAMYYCAAESVSSFSCGG WLTRPGRVPYWGQGTQVT VSSGGGSQVQLQESGGGS VQAGGSLRLSCTAPGFTS NSCGMDWYRQAPGKEREF VSSISTDGTTGYADSVKG RFTISKDKAKDTVYLQMN SLKPEDTGMYSCKTKDGT IATMELCDFGYWGQGTQV TVSS | 216 | S T Y S N Y C L G | 223 | VI NW VG GM LY FA DS VK G | 949 | ES VS SF SC GG WL TR PG RV PY | 194 | FTS NSC GMD | 200 | SIS TDG TTG YAD SVK G | 206 | KD GT IA TM EL CD FG Y |
| hIL27Ra-VHH12-DR592 | 441 | QVQLQESGGGSVQAGESL RLSCRASGSTYSNYCLGW FRQITGKEREGVAVINWV GGMLYFADSVKGRFTVSQ DQAKNTVYLEMNSLKPED TAMYYCATESVSSFSCGG WLTRPDRVPYWGQGTQVT VSSGGGSQVQLQESGGGS VQAGGSLRLSCTAPGFTS NSCGMDWYRQAPGKEREF VSSISTDGTTGYADSVKG RFTISKDKAKDTVYLQMN SLKPEDTGMYSCKTKDGT IATMELCDFGYWGQGTQV TVSS | 216 | S T Y S N Y C L G | 223 | VI NW VG GN LY FA DS VK G | 230 | ES VS SF SC GG WL TR PD RV PY | 194 | FTS NSC GMD | 200 | SIS TDG TTG YAD SVK G | 206 | KD GT IA TM EL CD FG Y |
| hIL27Ra-VHH13-DR592 | 442 | QVQLQESGGGSVQAGGSL RLSCVASGYVSCDYFLPS WYRQAPGKEREFVSIIDG TGSTSYAASVKGRFTASQ DRGKNIAYLQMNSLKPED TAMYYCKASCVRGRTISE YWGQGTQVTVSSGGGSQV QLQESGGGSVQAGGSLRL SCTAPGFTSNSCGMDWYR QAPGKEREFVSSISTDGT TGYADSVKGRFTISKDKA KDTVYLQMNSLKPEDTGM YSCKTKDGTIATMELCDF GYWGQGTQVTVSS | 215 | Y V S C D Y F L P S | 222 | II DG TG ST SY AA SV KG | 950 | SC VR GR TI SE Y | 194 | FTS NSC GMD | 200 | SIS TDG TTG YAD SVK G | 206 | KD GT IA TM EL CD FG Y |

TABLE 1A-continued

| Name | SEQ ID NO: | Sequence of dual VHH dimer | SEQ ID NO: | CDR1 | SEQ ID NO: | CDR2 | SEQ ID NO: | CDR3 | SEQ ID NO: | CDR4 | SEQ ID NO: | CDR5 | SEQ ID NO: | CDR6 |
|---|---|---|---|---|---|---|---|---|---|---|---|---|---|---|
| hIL27Ra-VHH14-DR592 | 443 | QVQLQESGGGSVQAGGSLRLSCVASGYVSCDYFLPSWYRQAPGKEREFVSIIDGTGSTSYAASVKGRFTASQDKGKNIAYLQMNSLKPEDTAMYYCKASCVRGRAISEYWGQGTQVTVSSGGGSQVQLQESGGGSVQAGGSLRLSCTAPGFTSNSCGMDWYRQAPGKEREFVSSISTDGTTGYADSVKGRFTISKDKAKDTVYLQMNSLKPEDTGMYSCKTKDGTIATMELCDFGYWGQGTQVTVSS | 215 | YVSCDYFLPS | 222 | IIDGTGSTSYAAS VKG | 2 | SCVRGRAISEY | 194 | FTSNSCGMD | 200 | SISTDGTTGYADSVKG | 206 | KDGTIATMELCDFGY |
| | | | | | | | 2 | SCVRGRAISEY | | | | | | |
| | | | | | | | 9 | SCVRGAISEY | | | | | | |
| hIL27Ra-VHH15-DR592 | 444 | QVQLQESGGGSVQAGGSLRLSCVASGYVSCDYFLPSWYRQAPGKEREFVSIIDGTGSTSYAASVKGRFTASQDKGKNIAYLQMNTLKPEDTAMYYCKASCVRGRAISEYWGQGTQVTVSSGGGSQVQLQESGGGSVQAGGSLRLSCTAPGFTSNSCGMDWYRQAPGKEREFVSSISTDGTTGYADSVKGRFTISKDKAKDTVYLQMNSLKPEDTGMYSCKTKDGTIATMELCDFGYWGQGTQVTVSS | 215 | YVSCDYFLPS | 222 | IIDGTGSTSYAAS VKG | 229 | SCVRGRAISEY | 194 | FTSNSCGMD | 200 | SISTDGTTGYADSVKG | 206 | KDGTIATMELCDFGY |
| hIL27Ra-VHH16-DR592 | 445 | QVQLQESGGGSVQAGGSLRLSCRASGSTYSNYCLGWFRQITGKEREGVAVINWVGGMLYFADSVKGRFTVSQDQAKNTVYLQMNSLKPEDTAMYYCAAESASSFSCGGWLTRPDRVPYWGQGTQVTVSSGGGSQVQLQESGGGSVQAGGSLRLSCTAPGFTSNSCGMDWYRQAPGKEREFVSSISTDGTTGYADSVKGRFTISKDKAKDTVYLQMNSLKPEDTGMYSCKTKDGTIATMELCDFGYWGQGTQVTVSS | 216 | STYSNYCLG | 223 | VINWVGGNLYFA DSVKG | 951 | ESASSFSCGGWLTRPDRVPY | 194 | FTSNSCGMD | 200 | SISTDGTTGYADSVKG | 206 | KDGTIATMELCDFGY |
| hIL27Ra-VHH17-DR592 | 446 | QVQLQESGGGLVQPGGSLRLSCAASGFTFSLSGMSWVRQAPGKGLEWVSAISSGGASTYYTDSVKGRFTISRDNAKNMLYLQLNSLKTEDTAMYYCAKGGGSYGDASRMTSPGSQGTQVTVSSGGGSQVQLQESGGGSVQAGGSLRLSCTAPGFTSNSCGMDWYRQAPGKEREFVSSISTDGTTGYADSVKGRFTISKDKAKDTVYLQMNSLKPEDTGMYSCKTKDGTIATMELCDFGYWGQGTQVTVSS | 940 | FTFSLSGMS | 224 | AISSGGASTYYT DSVKG | 231 | GGSGYGDASRMTSP | 194 | FTSNSCGMD | 200 | SISTDGTTGYADSVKG | 206 | KDGTIATMELCDFGY |
| hIL27Ra-VHH18-DR592 | 447 | QVQLQESGGGSVQAGGSLRLSCVASGYVSCDYFLPSWYRQAPGKEREFVSIIDGTGSTSYAASVKGRFTASQDKGKNIAYLQMNSLKPEDTAMYYCKASCVRGRGISEYWGQGTQVTVSSGGGSQVQLQESGGGSVQAGGSLRLSCTAPGFTSNSCGMDWYRQAPGKEREFVSSISTDGTTGYADSVKGRFTISKDKAKDTVYLQMNSLKPEDTGMYSCKTKDGTIATMELCDFGYWGQGTQVTVSS | 215 | YVSCDYFLPS | 222 | IIDGTGSTSYAAS VKG | 952 | SCVRGRGISEY | 194 | FTSNSCGMD | 200 | SISTDGTTGYADSVKG | 206 | KDGTIATMELCDFGY |

TABLE 1A-continued

| Name | SEQ ID NO: | Sequence of dual VHH dimer | SEQ ID NO: | CDR1 | SEQ ID NO: | CDR2 | SEQ ID NO: | CDR3 | SEQ ID NO: | CDR4 | SEQ ID NO: | CDR5 | SEQ ID NO: | CDR6 |
|---|---|---|---|---|---|---|---|---|---|---|---|---|---|---|
| hIL27Ra-VHH19-DR592 | 448 | QVQLQESGGGSVQAGGSL RLSCRASGSTYSNYCLGW FRQITGKEREGVAVINWV GGMLYFADSVKGRFTVSQ DQAKNTVYLQMNSLKPED TAMYYCAAESVSSFSCGG WLTRPDRVPYWGQGTQVT VSSGGGSQVQLQESGGGS VQAGGSLRLSCTAPGFTS NSCGMDWYRQAPGKEREF VSSISTDGTTGYADSVKG RFTISKDKAKDTVYLQMN SLKPEDTGMYSCKTKDGT IATMELCDFGYWGQGTQV TVSS | 216 | S T Y S N Y C L G | 223 | VI NW VG GM LY FA DS VK G | 230 | ES VS SF SC GG WL TR PD RV PY | 194 | FTS NSC GMD | 200 | SIS TDG TTG YAD SVK G | 206 | KD GT IA TM EL CD FG Y |
| hIL27Ra-VHH20-DR592 | 449 | QVQLQESGGGLVQPGGSL RLSCAASGFTFSSYPMSW VRQAPGKGLEWVSTISSG GDTTLYADSVKGRFTSSR DNAKNTLYLQLNSLKTED TAMYYCAKRIDCNSGYCY KRSYWGQGTQVTVSSGGG SQVQLQESGGGSVQAGGS LRLSCTAPGFTSNSCGMD WYRQAPGKEREFVSSIST DGTTGYADSVKGRFTISK DKAKDTVYLQMNSLKPED TGMYSCKTKDGTIATMEL CDFGYWGQGTQVTVSS | 211 | F T F S S Y P M S | 945 | TI SS GG DT TL YA DS VK G | 953 | RI DC NS GY CY KR SY | 194 | FTS NSC GMD | 200 | SIS TDG TTG YAD SVK G | 206 | KD GT IA TM EL CD FG Y |
| hIL27Ra-VHH21-DR592 | 450 | QVQLQESGGGLVQPGGSL RLSCAASGFTFSLSSMSW VRQAPGKGLEWVSAISSG GASTYYTDSVKGRFTISR DNAKNMLYLQLNSLKTED TAMYYCAKGGSGYGDASR MTSPGSQGTQVTVSSGGG SQVQLQESGGGSVQAGGS LRLSCTAPGFTSNSCGMD WYRQAPGKEREFVSSIST DGTTGYADSVKGRFTISK DKAKDTVYLQMNSLKPED TGMYSCKTKDGTIATMEL CDFGYWGQGTQVTVSS | 217 | F T F S L S S M S | 224 | AI SS GG AS TY YT DS VK G | 231 | GG SG YG DA SR MT SP | 194 | FTS NSC GMD | 200 | SIS TDG TTG YAD SVK G | 206 | KD GT IA TM CI CD FG Y |
| hIL27Ra-VHH22-DR592 | 451 | QVQLQESGGGSVQAGGSL RLSCRASGSTYSNYCLGW FRQTTGKEREGVAVINWV GGMLYFADSVKGRFTVSQ DQAKNTVYLQMNSLKPED TAMYYCAAESVSSFSCGG WLTRPDRVPYWGQGTQVT VSSGGGSQVQLQESGGGS VQAGGSLRLSCTAPGFTS NSCGMDWYRQAPGKEREF VSSISTDGTTGYADSVKG RFTISKDKAKDTVYLQMN SLKPEDTGMYSCKTKDGT IATMELCDFGYWGQGTQV TVSS | 216 | S T Y S N Y C L G | 223 | VI NW VG GM LY FA DS VK G | 230 | ES VS SF SC GG WL TR PD RV PY | 194 | FTS NSC GMD | 200 | SIS TDG TTG YAD SVK G | 206 | KD GT IA TM EL CD FG Y |
| hIL27Ra-VHH23-DR592 | 452 | QVQLQESGGGSVQAGGSL RLSCRASRSPYGNYCLGW FRQSTGKEREGVAVINWV GGMLYFADSVKGRFTVSQ DHAKNTVTLQMNSLKPED TAMYYCAAESVSSFSCGG WLTRPDRVPYWGQGTQVT VSSGGGSQVQLQESGGGS VQAGGSLRLSCTAPGFTS | 941 | S P Y G N Y C L G | 223 | VI NW VG GM LY FA DS VK G | 230 | ES VS SE SC GG WL TR PD RV | 194 | FTS NSC GMD | 200 | SIS TDG TTG YAD SVK G | 206 | KD GT IA TM EL CD FG Y |

TABLE 1A-continued

| Name | SEQ ID NO: | Sequence of dual VHH dimer | SEQ ID NO: CDR1 | CDR1 | SEQ ID NO: CDR2 | CDR2 | SEQ ID NO: CDR3 | CDR3 | SEQ ID NO: CDR4 | CDR4 | SEQ ID NO: CDR5 | CDR5 | SEQ ID NO: CDR6 | CDR6 |
|---|---|---|---|---|---|---|---|---|---|---|---|---|---|---|
| | | NSCGMDWYRQAPGKEREF VSSISTDGTTGYADSVKG RFTISKDKAKDTVYLQMN SLKPEDTGMYSCKTKDGT IATMELCDFGYWGQGTQV TVSS | | | | | | PY | | | | | | |
| hIL27Ra-VHH24-DR592 | 453 | QVQLQESGGGLVQPGGSL RLSCAASGFTFSHSGMSW VRQAPGKGLEWVSTINSG GASTYYTDSVKGRFTISR DNAKNMLYLQLNSLKTED TAMYYCAKGGSGYGDASR MTSPGSQGTQVTVSSGGG SQVQLQESGGGSVQAGGS LRLSCTAPGFTSNSCGMD WYRQAPGKEREFVSSIST DGTTGYADSVKGRFTISK DKAKDTVYLQMNSLKPED TGMYSCKTKDGTIATMEL CDFGYWGQGTQVTVSS | 942 | FTFSHSGMS | 946 | TINSGGASTYTDSVKG | 231 | GGSGYGDASRMTSPSVIG | 194 | FTSNSCGMD | 200 | SISTDGTTGYADSVKG | 206 | KDGTIATMELCDFGY |
| hIL27Ra-VHH1-DR593 | 454 | QVQLQESGGGLVQPGGSL RLSCAASGFTFSSYPMSW VRQAPGKGLEWISTISAG GDTTLYADSVKGRFTSSR DNAKNTLYLQLNSLKTED AAIYYCAKRIDCNSGYCY RRNYWGQGTQVTVSSGGG SQVQLQESGGGSVQAGGS LRLSCAASGYPYSNGYMG WFRQAPGKEREGVATIYT GDGRTYYADSVKGRFTIS RDNAKNTVDLQMSSLKPE DTAMYYCAARAAPLYSSG SPLTRARYNVWGQGTQVT VSS | 942 | FTFSSYPMS | 946 | TISAGGDTTLYADSVKG | 231 | GGSGYGDASRMTSPSVKG | 195 | YPYSNGYMG | 201 | TIYTGDGRTYYADSVKG | 207 | RAAPLYSSGSPLTRARYNV |
| hIL27Ra-VHH2-DR593 | 455 | QVQLQESGGGLVQPGGSL RLSCAASGFTFSLSGMSW VRQAPGKGLEWVSAISSG GASTYYTDSVKGRFTISR DNAKNILYLQLNSLKTED TAMYYCAKGGSGYGDASR MTSPGSQGTQVTVSSGGG SQVQLQESGGGSVQAGGS LRLSCAASGYPYSNGYMG WFRQAPGKEREGVATIYT GDGRTYYADSVKGRFTIS RDNAKNTVDLQMSSLKPE DTAMYYCAARAAPLYSSG SPLTRARYNVWGQGTQVT VSS | 942 | FTFSLSGMS | 946 | AISSGGASTYTDSVKG | 231 | GGSGYGDASRMTSPSVKG | 195 | YPYSNGYMG | 201 | TIYTGDGRTYYADSVKG | 207 | RAAPLYSSGSPLTRARYNV |
| hIL27Ra-VHH3-DR593 | 456 | QVQLQESGGGSVQAGGSL RLSCVASGYVSCDYFLPS WYRQAPGKEREFVSIIDG TGSTSYAASVKGRFTASE DKGKNIAYLQMNSLKPED TAMYYCKASCVRGRAVSE YWGQGTQVTVSSGGGSQV QLQESGGGSVQAGGSLRL SCAASGYPYSNGYMGWFR QAPGKEREGVATIYTGDG RTYYADSVKGRFTISRDN AKNTVDLQMSSLKPEDTA MYYCAARAAPLYSSGSPL TRARYNVWGQGTQVTVSS | 942 | YVSCDYFLPS | 946 | IIDGTGSTSYAASVKG | 231 | GGSGYGDASRMTSPSVKG | 195 | YPYSNGYMG | 201 | TIYTGDGRTYYADSVKG | 207 | RAAPLYSSGSPLTRARYNV |
| hIL27Ra-VHH4-DR593 | 457 | QVQLQESGGGLVQPGESL RLSCTASGFTFSNYAMSW VRQAPGKGLEWVSGINVA YGITSYADSVKGRFTISR DNTKNTLYLQLNSLKTED TAIYYCVKHSGTTIPRGF ISYTKRGQGTQVTVSSGG | 942 | FTFSNYAMS | 946 | GINVAYGITSYADSVKG | 231 | GGSGYGDASRMTSPSVKG | 195 | YPYSNGYMG | 201 | TIYTGDGRTYYADSVKG | 207 | RAAPLYSSGSPLTR |

TABLE 1A-continued

| Name | SEQ ID NO: | Sequence of dual VHH dimer | SEQ ID NO: CDR1 | SEQ ID NO: CDR2 | SEQ ID NO: CDR3 | SEQ ID NO: CDR4 | SEQ ID NO: CDR5 | SEQ ID NO: CDR6 |
|---|---|---|---|---|---|---|---|---|
| | | GSQVQLQESGGGSVQAGG SLRLSCAASGYPYSNGYM GWFRQAPGKEREGVATIY TGDGRTYYADSVKGRFTI SRDNAKNTVDLQMSSLKP EDTAMYYCAARAAPLYSS GSPLTRARYNVWGQGTQV TVSS | | M S | | V G | | | AR YN V |
| hIL27Ra-VHH5-DR593 | 458 | QVQLQESGGGSVQAGGSL RLSCTASGYVSCDYFLPS WYRQAPGKEREFVSVIDG TGSTSYAASVKGRFTASQ DKGKNIAYLQMNSLKPED TAMYYCKASCVRGRAISE YWGQGTQVTVSSGGGSQV QLQESGGGSVQAGGSLRL SCAASGYPYSNGYMGWFR QAPGKEREGVATIYTGDG RTYYADSVKGRFTISRDN AKNTVDLQMSSLKPEDTA MYYCAARAAPLYSSGSPL TRARYNVWGQGTQVTVSS | 942 | 946 | 231 | 195 | 201 | 207 |
| | | | F T F S H S G M S | TI NS GG AS TY YT DS VK G | GG SG YG DA SR MT SP | YPY SNG YMG | TIY TGD GRT YYA DSV KG | RA AP LY SS GS PL TR AR YN V |
| hIL27Ra-VHH6-DR593 | 459 | QVQLQESGGGLVQPGGSL RLSCAASGFSFSSYAMKW VRQAPGKGLEWVSTISSG GSSTNYADSVKGRFTISR DNAKNTLYLQLNSLKIED TAMYYCAKAIVPTGATME RGQGTQVTVSSGGGSQVQ LQESGGGSVQAGGSLRLS CAASGYPYSNGYMGWFRQ APGKEREGVATIYTGDGR TYYADSVKGRFTISRDNA KNTVDLQMSSLKPEDTAM YYCAARAAPLYSSGSPLT RARYNVWGQGTQVTVSS | 942 | 946 | 231 | 195 | 201 | 207 |
| | | | F T F S H S G M S | TI NS GG AS TY YT DS VK G | GG SG YG DA SR MT SP | YPY SNG YMG | TIY TGD GRT YYA DSV KG | RA AP LY SS GS PL TR AR YN V |
| hIL27Ra-VHH7-DR593 | 460 | QVQLQESGGGLVQPGGSL RLSCAASGFTFSSYPMSW VRQAPGKGLEWISTISAG GDTTLYADSVKGRFTSSR DNAKNTLYLQLNSLKTED TAIYYCAKRIDCNSGYCY RRNYWGQGTQVTVSSGGG SQVQLQESGGGSVQAGGS LRLSCAASGYPYSNGYMG WFRQAPGKEREGVATIYT GDGRTYYADSVKGRFTIS RDNAKNTVDLQMSSLKPE DTAMYYCAARAAPLYSSG SPLTRARYNVWGQGTQVT VSS | 942 | 946 | 231 | 195 | 201 | 207 |
| | | | F T F S H S G M S | TI NS GG AS TY VK G | GG SG YG DA SR MT SP | YPY SNG YMG | TIY TGD GRT YYA DSV KG | RA AP LY SS GS PL TR AR YN V |
| hIL27Ra-VHH8-DR593 | 461 | QVQLQESGGGSVQVGGSL RLSCAASGFTFSSYPMSW VRQAPGKGLEWISTISAG GDTTLYADSVKGRFTSSR DNAKNTLYLQLNSLKTED TAIYYCAKRIDCNSGYCY RRNYWGQGTQVTVSSGGG SQVQLQESGGGSVQAGGS LRLSCAASGYPYSNGYMG WFRQAPGKEREGVATIYT GDGRTYYADSVKGRFTIS RDNAKNTVDLQMSSLKPE DTAMYYCAARAAPLYSSG SPLTRARYNVWGQGTQVT VSS | 942 | 946 | 231 | 195 | 201 | 207 |
| | | | F T F S H S G M S | TI NS GG AS TY YT DS VK G | GG SG YG DA SR MT SP | YPY SNG YMG | TIY TGD GRT YYA DSV KG | RA AP LY SS GS PL TR AR YN V |
| hIL27Ra-VHH9-DR593 | 462 | QVQLQESGGGSVQSGGSL RLSCAASGFTYSTSNSWM AWFRQAPGKEREGVAAIY TVGGSIFYADSVRGRFTI SQDATKNMFYLQMNTLKP | 942 | 946 | 231 | 195 | 201 | 207 |
| | | | F T F S H | TI NS GG AS TY | GG SG YG DA SR | YPY SNG YMG | TIY TGD GRT YYA DSV | RA AP LY SS GS |

TABLE 1A-continued

| Name | SEQ ID NO: | Sequence of dual VHH dimer | SEQ ID NO: | CDR1 | SEQ ID NO: | CDR2 | SEQ ID NO: | CDR3 | SEQ ID NO: | CDR4 | SEQ ID NO: | CDR5 | SEQ ID NO: | CDR6 |
|---|---|---|---|---|---|---|---|---|---|---|---|---|---|---|
| | | EDTAMYYCAAASGRLRGK WFWPYEYNYWGQGTQVTV SSGGGSVQLQESGGGSV QAGGSLRLSCAASGYPYS NGYMGWFRQAPGKEREGV ATIYTGDGRTYYADSVKG RFTISRDNAKNTVDLQMS SLKPEDTAMYYCAARAAP LYSSGSPLTRARYNVWGQ GTQVTVSS | | S G M S | | YT DS VK G | | MT SP | | | | KG | | PL TR AR YN V |
| hIL27Ra-VHH10-DR593 | 463 | QVQLQESGGGSVQAGGSL RLSCRASGSTYSNYCLGW FRQITGKEREGVAVINWV GGMLYFADSVKGRFTVSQ DQAKNTLYLQMNSLKPED TAMYYCAAESVSSFSCGG WLTRPDRVPYWGQGTQVT VSSGGGSQVQLQESGGGS VQAGGSLRLSCAASGYPY SNGYMGWFRQAPGKEREG VATIYTGDGRTYYADSVK GRFTISRDNAKNTVDLQM SSLKPEDTAMYYCAARAA PLYSSGSPLTRARYNVWG QGTQVTVSS | 942 | F T F S H S G M S | 946 | TI NS GG AS TY YT DS VK G | 231 | GG SG YG DA SR MT SP | 195 | YPY YMG | 201 | TIY SNG GRT YYA DSV KG | 207 | RA AP LY SS GS PL TR AR YN V |
| hIL27Ra-VHH11-DR593 | 464 | QVQLQESGGGSVQAGGSL RLSCRASGSTYSNYCLGW FRQSTGKEREGVAVINWV GGMLYFADSVKGRFTVSQ DHAKNTVTLQMNSLKPED TAMYYCAAESVSSFSCGG WLTRPGRVPYWGQGTQVT VSSGGGSQVQLQESGGGS VQAGGSLRLSCAASGYPY SNGYMGWFRQAPGKEREG VATIYTGDGRTYYADSVK GRFTISRDNAKNTVDLQM SSLKPEDTAMYYCAARAA PLYSSGSPLTRARYNVWG QGTQVTVSS | 942 | F T F S H S G M S | 946 | TI NS GG AS TY YT DS VK G | 231 | GG SG YG DA SR MT SP | 195 | YPY V YMG | 201 | TIY SNG GRT YYA DSV KG | 207 | RA AP LY SS GS PL TR AR YN V |
| hIL27Ra-VHH12-DR593 | 465 | QVQLQESGGGSVQAGESL RLSCRASGSTYSNYCLGW FRQITGKEREGVAVINWV GGMLYFADSVKGRFTVSQ DQAKNTVYLEMNSLKPED TAMYYCATESVSSFSCGG WLTRPDRVPYWGQGTQVT VSSGGGSQVQLQESGGGS VQAGGSLRLSCAASGYPY SNGYMGWFRQAPGKEREG VATIYTGDGRTYYADSVK GRFTISRDNAKNTVDLQM SSLKPEDTAMYYCAARAA PLYSSGSPLTRARYNVWG QGTQVTVSS | 942 | F T F S H S G M S | 946 | TI NS GG AS TY YT DS VK G | 231 | GG SG YG DA SR MT SP | 195 | YPY YMG | 201 | TIY SNG GRT YYA DSV KG | 207 | RA AP LY SS GS PL TR AR YN V |
| hIL27Ra-VHH13-DR593 | 466 | QVQLQESGGGSVQAGGSL RLSCVASGYVSCDYFLPS WYRQAPGKEREFVSIIDG TGSTSYAASVKGRFTASQ DRGKNIAYLQMNSLKPED TAMYYCKASCVRGRTISE YWGQGTQVTVSSGGGSQV QLQESGGGSVQAGGSLRL SCAASGYPYSNGYMGWFR QAPGKEREGVATIYTGDG RTYYADSVKGRFTISRDN AKNTVDLQMSSLKPEDTA MYYCAARAAPLYSSGSPL TRARYNVWGQGTQVTVSS | 942 | F T F S H S G M S | 946 | TI NS GG AS TY YT DS VK G | 231 | GG SG YG DA SR MT SP | 195 | YPY YMG | 201 | TIY SNG GRT YYA DSV KG | 207 | RA AP LY SS GS PL TR AR YN V |

TABLE 1A-continued

| Name | SEQ ID NO: | Sequence of dual VHH dimer | SEQ ID NO: | CDR1 | SEQ ID NO: | CDR2 | SEQ ID NO: | CDR3 | SEQ ID NO: | CDR4 | SEQ ID NO: | CDR5 | SEQ ID NO: | CDR6 |
|---|---|---|---|---|---|---|---|---|---|---|---|---|---|---|
| hIL27Ra-VHH14-DR593 | 467 | QVQLQESGGGSVQAGGSLRLSCVASGYVSCDYFLPSWYRQAPGKEREFVSIIDGTGSTSYAASVKGRFTASQDKGKNIAYLQMNSLKPEDTAMYYCKASCVRGRAISEYWGQGTQVTVSSGGGSQVQLQESGGGSVQAGGSLRLSCAASGYPYSNGYMGWFRQAPGKEREGVATIYTGDGRTYYADSVKGRFTISRDNAKNTVDLQMSSLKPEDTAMYYCAARAAPLYSSGSPLTRARYNVWGQGTQVTVSS | 942 | FTFSHSGMS | 946 | TINSGGASTYYTDSVKG | 231 | GGSGYGDASRMTSP | 195 | YPYSNGYMG | 201 | TIYTGDGRTYYADSVKG | 207 | RAAPLYSSGSPLTRARYN |
| hIL27Ra-VHH15-DR593 | 468 | QVQLQESGGGSVQAGGSLRLSCVASGYVSCDYFLPSWYRQAPGKEREFVSIIDGTGSTSYAASVKGRFTASQDKGKNIAYLQMNTLKPEDTAMYYCKASCVRGRAISEYWGQGTQVTVSSGGGSQVQLQESGGGSVQAGGSLRLSCAASGYPYSNGYMGWFRQAPGKEREGVATIYTGDGRTYYADSVKGRFTISRDNAKNTVDLQMSSLKPEDTAMYYCAARAAPLYSSGSPLTRARYNVWGQGTQVTVSS | 942 | FTFSHSGMS | 946 | TINSGGASTYYTDSVKG | 231 | GGSGYGDASRMTSP | 195 | YPYSNGYMG | 201 | TIYTGDGRTYYADSVKG | 207 | RAAPLYSSGSPLTRARYNV |
| hIL27Ra-VHH16-DR593 | 469 | QVQLQESGGGSVQAGGSLRLSCRASGSTYSNYCLGWFRQITGKEREGVAVINWVGGMLYFADSVKGRFTVSQDQAKNTVYLQMNSLKPEDTAMYYCAAESASSFSCGGWLTRPDRVPYWGQGTQVTVSSGGGSQVQLQESGGGSVQAGGSLRLSCAASGYPYSNGYMGWFRQAPGKEREGVATIYTGDGRTYYADSVKGRFTISRDNAKNTVDLQMSSLKPEDTAMYYCAARAAPLYSSGSPLTRARYNVWGQGTQVTVSS | 942 | FTFSHSGMS | 946 | TINSGGASTYYTDSVKG | 231 | GGSGYGDASRMTSP | 195 | YPYSNGYMG | 201 | TIYTGDGRTYYADSVKG | 207 | RAAPLYSSGSPLTRARYNV |
| hIL27Ra-VHH17-DR593 | 470 | QVQLQESGGGLVQPGGSLRLSCAASGFTFSLSGMSWVRQAPGKGLEWVSAISSGGASTYYTDSVKGRFTISRDNAKNMLYLQLNSLKTEDTAMYYCAKGGSGYGDASRMTSPGSQGTQVTVSSGGGSQVQLQESGGGSVQAGGSLRLSCAASGYPYSNGYMGWFRQAPGKEREGVATIYTGDGRTYYADSVKGRFTISRDNAKNTVDLQMSSLKPEDTAMYYCAARAAPLYSSGSPLTRARYNVWGQGTQVTVSS | 942 | FTFSLSGMS | 946 | TINSGGASTKG | 231 | GGSGYGDASRMTSP | 195 | YPYSNGYMG | 201 | TIYTGDGRTYYADSVKG | 207 | RAAPLYSSGSPLTRARYNV |
| hIL27Ra-VHH18-DR593 | 471 | QVQLQESGGGSVQAGGSLRLSCVASGYVSCDYFLPSWYRQAPGKEREFVSIIDGTGSTSYAASVKGRFTASQDKGKNIAYLQMNSLKPEDTAMYYCKASCVRGRGISEYWGQGTQVTVSSGGGSQVQLQESGGGSVQAGGSLRLSCAASGYPYSNGYMGWFRQAPGKEREGVATIYTGDGRTYYADSVKGRFTISRDNAKNTVDLQMSSLKPEDTAMYYCAARAAPLYSSGSPLTRARYNVWGQGTQVTVSS | 942 | FTFSHSGMS | 946 | TINSGGASTYEDSVKG | 231 | GGSGYGDASRMTSP | 195 | YPYSNGYMG | 201 | TIYTGDGRTYYADSVKG | 207 | RAAPLYSSGSPLTRARYNV |

TABLE 1A-continued

| Name | SEQ ID NO: | Sequence of dual VHH dimer | SEQ ID NO: | CDR1 | SEQ ID NO: | CDR2 | SEQ ID NO: | CDR3 | SEQ ID NO: | CDR4 | SEQ ID NO: | CDR5 | SEQ ID NO: | CDR6 |
|---|---|---|---|---|---|---|---|---|---|---|---|---|---|---|
| hIL27Ra-VHH19-DR593 | 472 | QVQLQESGGGSVQAGGSLRLSCRASGSTYSNYCLGWFRQITGKEREGVAVINWVGGMLYFADSVKGRFTVSQDQAKNTVYLQMNSLKPEDTAMYYCAAESVSSFSCGGWLTRPDRVPYWGQGTQVTVSSGGGSQVQLQESGGGSVQAGGSLRLSCAASGYPYSNGYMGWFRQAPGKEREGVATIYTGDGRTYYADSVKGRFTISRDNAKNTVDLQMSSLKPEDTAMYYCAARAAPLYSSGSPLTRARYNVWGQGTQVTVSS | 942 | FTFSHSGMS | 946 | TINSGGASTYYTDSVKG | 231 | GGSGYGDASRMTSP | 195 | YPYSNGYMG | 201 | TIYTGDGRTYYADSVKG | 207 | RAAPLYSSGSPLTRARYNV |
| hIL27Ra-VHH20-DR593 | 473 | QVQLQESGGGLVQPGGSLRLSCAASGFTFSSYPMSWVRQAPGKGLEWVSTISSGGDTTLYADSVKGRFTSSRDNAKNTLYLQLNSLKTEDTAMYYCAKRIDCNSGYCYKRSYWGQGTQVTVSSGGGSQVQLQESGGGSVQAGGSLRLSCAASGYPYSNGYMGWFRQAPGKEREGVATIYTGDGRTYYADSVKGRFTISRDNAKNTVDLQMSSLKPEDTAMYYCAARAAPLYSSGSPLTRARYNVWGQGTQVTVSS | 942 | FTFSHSGMS | 946 | TINSGGASTYYTDSVKG | 231 | GGSGYGDASRMTSP | 195 | YPYSNGYMG | 201 | TIYTGDGRTYYADSVKG | 207 | RAAPLYSSGSPLTRARYNV |
| hIL27Ra-VHH21-DR593 | 474 | QVQLQESGGGLVQPGGSLRLSCAASGFTFSLSSMSWVRQAPGKGLEWVSAISSGGASTYYTDSVKGRFTISRDNAKNMLYLQLNSLKTEDTAMYYCAKGGSGYGDASRMTSPGSQGTQVTVSSGGGSQVQLQESGGGSVQAGGSLRLSCAASGYPYSNGYMGWFRQAPGKEREGVATIYTGDGRTYYADSVKGRFTISRDNAKNTVDLQMSSLKPEDTAMYYCAARAAPLYSSGSPLTRARYNVWGQGTQVTVSS | 942 | FTFSHSGMS | 946 | TINSGGASTYYTDSVKG | 231 | GGSGYGDASRMTSP | 195 | YPYSNGYMG | 201 | TIYTGDGRTYYADSVKG | 207 | RAAPLYSSGSPLTRARYNV |
| hIL27Ra-VHH22-DR593 | 475 | QVQLQESGGGSVQAGGSLRLSCRASGSTYSNYCLGWFRQTTGKEREGVAVINWVGGMLYFADSVKGRFTVSQDQAKNTVYLQMNSLKPEDTAMYYCAAESVSSFSCGGWLTRPDRVPYWGQGTQVTVSSGGGSQVQLQESGGGSVQAGGSLRLSCAASGYPYSNGYMGWFRQAPGKEREGVATIYTGDGRTYYADSVKGRFTISRDNAKNTVDLQMSSLKPEDTAMYYCAARAAVATIYTGDGRTYYADSVKPLYSSGSPLTRARYNVWGQGTQVTVSS | 942 | FTFSHSGMS | 946 | TINSGGASTYYTDSVKG | 231 | GGSGYGDASRMTSP | 195 | YPYSNGYMG | 201 | TIYTGDGRTYYADSVKG | 207 | RAAPLYSSGSPLTRARYNV |
| hIL27Ra-VHH23-DR593 | 476 | QVQLQESGGGSVQAGGSLRLSCRASRSPYGNYCLGWFRQSTGKEREGVAVINWVGGMLYFADSVKGRFTVSQDHAKNTVTLQMNSLKPEDTAMYYCAAESVSSFSCGGWLTRPDRVPYWGQGTQVTVSSGGGSQVQLQESGGGSVQAGGSLRLSCAASGYPYSNGYMGWFRQAPGKEREGVATIYTGDGRTYYADSVKGRFTISRDNAKNTVDLQM | 942 | FTFSHSGMS | 946 | TINSGGASTYYTDSVKG | 231 | GGSGYGDASRMTSP | 195 | YPYSNGYMG | 201 | TIYTGDGRTYYADSVKG | 207 | RAAPLYSSGSPLTRARYNV |

TABLE 1A-continued

| Name | SEQ ID NO: | Sequence of dual VHH dimer | SEQ ID NO: CDR1 | CDR1 | SEQ ID NO: CDR2 | CDR2 | SEQ ID NO: CDR3 | CDR3 | SEQ ID NO: CDR4 | CDR4 | SEQ ID NO: CDR5 | CDR5 | SEQ ID NO: CDR6 | CDR6 |
|---|---|---|---|---|---|---|---|---|---|---|---|---|---|---|
| | | SSLKPEDTAMYYCAARAA PLYSSGSPLTRARYNVWG QGTQVTVSS | | | | | | | | | | | | |
| hIL27Ra-VHH24-DR593 | 477 | QVQLQESGGGLVQPGGSL RLSCAASGFTFSHSGMSW VRQAPGKGLEWVSTINSG GASTYYTDSVKGRFTISR DNAKNMLYLQLNSLKTED TAMYYCAKGGSGYGDASR MTSPGSQGTQVTVSSGGG SQVQLQESGGGSVQAGGS LRLSCAASGYPYSNGYMG WFRQAPGKEREGVATIYT GDGRTYYADSVKGRFTIS RDNAKNTVDLQMSSLKPE DTAMYYCAARAAPLYSSG SPLTRARYNVWGQGTQVT VSS | 942 | F T F S H S G M S | 946 | TI NS GG AS TY YT VK G | 231 | GG SG YG DA SR MT SP | 195 | YPY SNG YMG | 201 | TIY TGD GRT YYA DSV KG | 207 | RA AP LY SS GS PL TR AR YN V |
| hIL27Ra-VHH1-DR594 | 478 | QVQLQESGGGLVQPGGSL RLSCAASGFTFSSYPMSW VRQAPGKGLEWISTISAG GDTTLYADSVKGRFTSSR DNAKNTLYLQLNSLKTED AAIYYCAKRIDCNSGYCY RRNYWGQGTQVTVSSGGG SQVQLQESGGGSVQAGGS LRLSCVASASTYCTYDMH WYRQAPGKREFVSAIDS DGTTRYADSVKGRFTISQ GTAKNTVYLQMNSLQPED TAMYYCKTVCVVGSRWSD YWGQGTQVTVSS | 942 | F T F S H S G M S | 946 | TI NS GG AS TY YT DS VK G | 231 | GG SG YG DA SR MT SP | 196 | STY CTY DMH | 202 | AID SDG TTR YAD SVK G | 954 | VC VV GS RW SD Y |
| hIL27Ra-VHH2-DR594 | 479 | QVQLQESGGGLVQPGGSL RLSCAASGFTFSLSGMSW VRQAPGKGLEWVSAISSG GASTYYTDSVKGRFTISR DNAKNILYLQLNSLKTED TAMYYCAKGGSGYGDASR MTSPGSQGTQVTVSSGGG SQVQLQESGGGSVQAGGS LRLSCVASASTYCTYDMH WYRQAPGKREFVSAIDS DGTTRYADSVKGRFTISQ GTAKNTVYLQMNSLQPED TAMYYCKTVCVVGSRWSD YWGQGTQVTVSS | 942 | F T F S H S G M S | 946 | TI NS GG AS TY YT DS VK G | 231 | GG SG YG DA SR MT SP | 196 | STY CTY DMH | 202 | AID SDG TTR YAD SVK G | 954 | VC VV GS RW SD Y |
| hIL27Ra-VHH3-DR594 | 480 | QVQLQESGGGSVQAGGSL RLSCVASGYVSCDYFLPS WYRQAPGKEREFVSIIDG TGSTSYAASVKGRFTASE DKGKNIAYLQMNSLKPED TAMYYCKASCVRGRAVSE YWGQGTQVTVSSGGGSQV QLQESGGGSVQAGGSLRL SCVASASTYCTYDMHWYR QAPGKGREFVSAIDSDGT TRYADSVKGRFTISQGTA KNTVYLQMNSLQPEDTAM YYCKTVCVVGSRWSDYWG QGTQVTVSS | 942 | F T F S H S G M S | 946 | TI NS GG AS TY DS VK G | 231 | GG SG YG DA SR MT SP | 196 | STY CTY DMH | 202 | AID SDG TTR YAD SVK G | 954 | VC VV GS RW SD Y |
| hIL27Ra-VHH4-DR594 | 481 | QVQLQESGGGLVQPGESL RLSCTASGFTFSNYAMSW VRQAPGKGLEWVSGINVA YGITSYADSVKGRFTISR DNTKNTLYLQLNSLKTED TAIYYCVKHSGTTIPRGF ISYTKRGQGTQVTVSSGG GSQVQLQESGGGSVQAGG SLRLSCVASASTYCTYDM HWYRQAPGKGREFVSAID SDGTTRYADSVKGRFTIS | 942 | F T F S H S G M S | 946 | TI NS GG AS TY YT DS VK G | 231 | GG SG YG DA SR MT SP | 196 | STY CTY DMH | 202 | AID SDG TTR YAD SVK G | 954 | VC VV GS RW SD Y |

TABLE 1A-continued

| Name | SEQ ID NO: | Sequence of dual VHH dimer | SEQ ID NO: CDR1 | CDR1 | SEQ ID NO: CDR2 | CDR2 | SEQ ID NO: CDR3 | CDR3 | SEQ ID NO: CDR4 | CDR4 | SEQ ID NO: CDR5 | CDR5 | SEQ ID NO: CDR6 | CDR6 |
|---|---|---|---|---|---|---|---|---|---|---|---|---|---|---|
| | | QGTAKNTVYLQMNSLQPE DTAMYYCKTVCVVGSRWS DYWGQGTQVTVSS | | | | | | | | | | | | |
| hIL27Ra-VHH5-DR594 | 482 | QVQLQESGGGSVQAGGSL RLSCTASGYVSCDYFLPS WYRQAPGKEREFVSVIDG TGSTSYAASVKGRFTASQ DKGKNIAYLQMNSLKPED TAMYYCKASCVRGRAISE YWGQGTQVTVSSGGGSQV QLQESGGGSVQAGGSLRL SCVASASTYCTYDMHWYR QAPGKGREFVSAIDSDGT TRYADSVKGRFTISQGTA KNTVYLQMNSLQPEDTAM YYCKTVCVVGSRWSDYWG QGTQVTVSS | 942 | F T F S H S G M S | 946 | TI NS GG AS TY YT DS VK G | 231 | GG SG YG DA SR MT SP | 196 | STY CTY DMH | 202 | AID SDG TTR YAD SVK G | 954 | VC VV GS RW SD Y |
| hIL27Ra-VHH6-DR594 | 483 | QVQLQESGGGLVQPGGSL RLSCAASGFSFSSYAMKW VRQAPGKGLEWVSTISSG GSSTNYADSVKGRFTISR DNAKNTLYLQLNSLKIED TAMYYCAKAIVPTGATME RGQGTQVTVSSGGGSQVQ LQESGGGSVQAGGSLRLS CVASASTYCTYDMHWYRQ APGKGREFVSAIDSDGTT RYADSVKGRFTISQGTAK NTVYLQMNSLQPEDTAMY YCKTVCVVGSRWSDYWGQ GTQVTVSS | 942 | F T F S H S G M S | 946 | TI NS GG AS TY YT DS VK G | 231 | GG SG YG DA SR MT SP | 196 | STY CTY DMH | 202 | AID SDG TTR YAD SVK G | 954 | VC VV GS RW SD Y |
| hIL27Ra-VHH7-DR594 | 484 | QVQLQESGGGLVQPGGSL RLSCAASGFTFSSYPMSW VRQAPGKGLEWISTISAG GDTTLYADSVKGRFTSSR DNAKNTLYLQLNSLKTED TAIYYCAKRIDCNSGYCY RRNYWGQGTQVTVSSGGG SQVQLQESGGGSVQAGGS LRLSCVASASTYCTYDMH WYRQAPGKGREFVSAIDS DGTTRYADSVKGRFTISQ GTAKNTVYLQMNSLQPED TAMYYCKTVCVVGSRWSD YWGQGTQVTVSS | 942 | F T F S H S G M 5 | 946 | TI NS GG AS TY YT DS VK G | 231 | GG SG YG DA SR MT SP | 196 | STY CTY DMH | 202 | AID SDG TTR YAD SVK G | 954 | VC VV GS RW SD Y |
| hIL27Ra-VHH8-DR594 | 485 | QVQLQESGGGSVQVGGSL RLSCAASGFTFSSYPMSW VRQAPGKGLEWISTISAG GDTTLYADSVKGRFTSSR DNAKNTLYLQLNSLKTED TAIYYCAKRIDCNSGYCY RRNYWGQGTQVTVSSGGG SQVQLQESGGGSVQAGGS LRLSCVASASTYCTYDMH WYRQAPGKGREFVSAIDS DGTTRYADSVKGRFTISQ GTAKNTVYLQMNSLQPED TAMYYCKTVCVVGSRWSD YWGQGTQVTVSS | 942 | F T F S H S G M S | 946 | TI NS GG AS TY YT DS VK G | 231 | GG SG YG DA SR MT SP | 196 | STY CTY DMH | 202 | AID SDG TTR YAD SVK G | 954 | VC VV GS RW SD Y |
| hIL27Ra-VHH9-DR594 | 486 | QVQLQESGGGSVQSGGSI RLSCAASGFTYSTSNSWM AWFRQAPGKEREGVAAIY TVGGSIFYADSVRGRFTI SQDATKNMFYLQMNTLKP EDTAMYYCAAASGRLGK WFWPYEYNYWGQGTQVTV SSGGGSQVQLQESGGGSV QAGGSLRLSCVASASTYC TYDMHWYRQAPGKGREFV SAIDSDGTTRYADSVKGR FTISQGTAKNTVYLQMNS | 942 | F T F S H S G M S | 946 | TI NS GG AS TY YT DS VK G | 231 | GG SG YG DA SR MT SP | 196 | STY CTY DMH | 202 | AID SDG TTR YAD SVK G | 954 | VC VV GS RW SD Y |

TABLE 1A-continued

| Name | SEQ ID NO: | Sequence of dual VHH dimer | SEQ ID NO: CDR1 | CDR1 | SEQ ID NO: CDR2 | CDR2 | SEQ ID NO: CDR3 | CDR3 | SEQ ID NO: CDR4 | CDR4 | SEQ ID NO: CDR5 | CDR5 | SEQ ID NO: CDR6 | CDR6 |
|---|---|---|---|---|---|---|---|---|---|---|---|---|---|---|
| | | LQPEDTAMYYCKTVCVVG SRWSDYWGQGTQVTVSS | | | | | | | | | | | | |
| hIL27Ra-VHH10-DR594 | 487 | QVQLQESGGGSVQAGGSL RLSCRASGSTYSNYCLGW FRQITGKEREGAVAINWV GGMLYFADSVKGRFTVSQ DQAKNTLYLQMNSLKPED TAMYYCAAESVSSFSCGG WLTRPDRVPYWGQGTQVT VSSGGGSQVQLQESGGGS VQAGGSLRLSCVASASTY CTYDMHWYRQAPGKGREF VSAIDSDGTTRYADSVKG RFTISQGTAKNTVYLQMN SLQPEDTAMYYCKTVCVV GSRWSDYWGQGTQVTVSS | 942 | F T F S H S G M S | 946 | TI NS GG AS TY YT DES VK G | 231 | GG SG YG DA SR MT SP | 196 | STY CTY DMH | 202 | AID SDG TTR YAD SVK G | 954 | VC VI GS RW SD Y |
| hIL27Ra-VHH11-DR594 | 488 | QVQLQESGGGSVQAGGSL RLSCRASGSTYSNYCLGW FRQSTGKEREGAVAINWV GGMLYFADSVKGRFTVSQ DHAKNTVTLQMNSLKPED TAMYYCAAESVSSFSCGG WLTRPGRVPYWGQGTQVT VSSGGGSQVQLQESGGGS VQAGGSLRLSCVASASTY CTYDMHWYRQAPGKGREF VSAIDSDGTTRYADSVKG RFTISQGTAKNTVYLQMN SLQPEDTAMYYCKTVCVV GSRWSDYWGQGTQVTVSS | 942 | F T F S H S G M S | 946 | TI NS GG AS TY YT DS VK G | 231 | GG SG YG DA SR MT SP | 196 | STY CTY DMH | 202 | AID SDG TTR YAD SVK G | 954 | VC VV GS RW SD Y |
| hIL27Ra-VHH12-DR594 | 489 | QVQLQESGGGSVQAGESL RLSCRASGSTYSNYCLGW FRQITGKEREGAVAINWV GGMLYFADSVKGRFTVSQ DQAKNTVYLEMNSLKPED TAMYYCATESVSSFSCGG WLTRPDRVPYWGQGTQVT VSSGGGSQVQLQESGGGS VQAGGSLRLSCVASASTY CTYDMHWYRQAPGKGREF VSAIDSDGTTRYADSVKG RFTISQGTAKNTVYLQMN SLQPEDTAMYYCKTVCVV GSRWSDYWGQGTQVTVSS | 942 | F T F S H S G M S | 946 | TI NS GG AS TY YT DS VK G | 231 | GG SG YG DA SR MT SP | 196 | STY CTY DMH | 202 | AID SDG TTR YAD SVK G | 954 | VC VV GS RW SD Y |
| hIL27Ra-VHH13-DR594 | 490 | QVQLQESGGGSVQAGGSL RLSCVASGYVSCDYFLPS WYRQAPGKEREFVSIIDG TGSTSYAASVKGRFTASQ DRGKNIAYLQMNSLKPED TAMYYCKASCVRGRTISE YWGQGTQVTVSSGGGSQV QLQESGGGSVQAGGSLRL SCVASASTYCTYDMHWYR QAPGKGREFVSAIDSDGT TRYADSVKGRFTISQGTA KNTVYLQMNSLQPEDTAM YYCKTVCVVGSRWSDYWG QGTQVTVSS | 942 | F T F S H S G M S | 946 | TI NS GG AS TY YT DS VK G | 231 | GG SG YG DA SR MT SP | 196 | STY CTY DMH | 202 | AID SDG TTR YAD SVK G | 954 | VC VV GS RW SD Y |
| hIL27Ra-VHH14-DR594 | 491 | QVQLQESGGGSVQAGGSL RLSCVASGYVSCDYFLPS WYRQAPGKEREFVSIIDG TGSTSYAASVKGRFTASQ DKGKNIAYLQMNSLKPED TAMYYCKASCVRGRAISE YWGQGTQVTVSSGGGSQV QLQESGGGSVQAGGSLRL SCVASASTYCTYDMHWYR QAPGKGREFVSAIDSDGT TRYADSVKGRFTISQGTA KNTVYLQMNSLQPEDTAM | 942 | F T F S H S G M S | 946 | TI NS GG AS TY YT DS VK G | 231 | GG SG YG DA SR MT SP | 196 | STY CTY DMH | 202 | AID SDG TTR YAD SVK G | 954 | VC VV GS RW SD Y |

TABLE 1A-continued

| Name | SEQ ID NO: | Sequence of dual VHH dimer | SEQ ID NO: | CDR1 | SEQ ID NO: | CDR2 | SEQ ID NO: | CDR3 | SEQ ID NO: | CDR4 | SEQ ID NO: | CDR5 | SEQ ID NO: | CDR6 |
|---|---|---|---|---|---|---|---|---|---|---|---|---|---|---|
| | | YYCKTVCVVGSRWSDYWG QGTQVTVSS | | | | | | | | | | | | |
| hIL27Ra-VHH15-DR594 | 492 | QVQLQESGGGSVQAGGSL RLSCVASGYVSCDYFLPS WYRQAPGKEREFVSIIDG TGSTSYAASVKGRFTASQ DKGKNIAYLQMNTLKPED TAMYYCKASCVRGRAISE YWGQGTQVTVSSGGGSQV QLQESGGGSVQAGGSLRL SCVASASTYCTYDMHWYR QAPGKGREFVSAIDSDGT TRYADSVKGRFTISQGTA KNTVYLQMNSLQPEDTAM YYCKTVCVVGSRWSDYWG QGTQVTVSS | 942 | FTFSHSGMS | 946 | TINSGGASTYYTDSVKG | 231 | GGSGYGDASRMTSP | 196 | STYCTYDMH | 202 | AIDSDGTTRYADSVKG | 954 | VCVVGSRWSDY |
| hIL27Ra-VHH16-DR594 | 493 | QVQLQESGGGSVQAGGSL RLSCRASGSTYSNYCLGW FRQITGKEREGVAVINWV GGMLYFADSVKGRFTVSQ DQAKNTVYLQMNSLKPED TAMYYCAAESASSFSCGG WLTRPDRVPYWGQGTQVT VSSGGGSQVQLQESGGGS VQAGGSLRLSCVASASTY CTYDMHWYRQAPGKGREF VSAIDSDGTTRYADSVKG RFTISQGTAKNTVYLQMN SLQPEDTAMYYCKTVCVV GSRWSDYWGQGTQVTVSS | 942 | FTFSHSGMS | 946 | TINSGGASTYYTDSVKG | 231 | GGSGYGDASRMTSP | 196 | STYCTYDMH | 202 | AIDSDGTTRYADSVKG | 954 | VCVVGSRWSDY |
| hIL27Ra-VHH17-DR594 | 494 | QVQLQESGGGLVQPGGSL RLSCAASGFTFSLSGMSW VRQAPGKGLEWVSAISSG GASTYYTDSVKGRFTISR DNAKNMLYLQLNSLKTED TAMYYCAKGGSGYGDASR MTSPGSQGTQVTVSSGGG SQVQLQESGGGSVQAGGS LRLSCVASASTYCTYDMH WYRQAPGKGREFVSAIDS DGTTRYADSVKGRFTISQ GTAKNTVYLQMNSLQPED TAMYYCKTVCVVGSRWSD YWGQGTQVTVSS | 942 | FTFSHSGMS | 946 | TINSGGASTYYTDS50G | 231 | GGSGYGDASRMTSP | 196 | STYCTYDMH | 202 | AIDSDGTTRYADSVKG | 954 | VCVVGSRWSDY |
| hIL27Ra-VHH18-DR594 | 495 | QVQLQESGGGSVQAGGSL RLSCVASGYVSCDYFLPS WYRQAPGKEREFVSIIDG TGSTSYAASVKGRFTASQ DKGKNIAYLQMNSLKPED TAMYYCKASCVRGRGISE YWGQGTQVTVSSGGGSQV QLQESGGGSVQAGGSLRL SCVASASTYCTYDMHWYR QAPGKGREFVSAIDSDGT TRYADSVKGRFTISQGTA KNTVYLQMNSLQPEDTAM YYCKTVCVVGSRWSDYWG QGTQVTVSS | 942 | FTFSHSGMS | 946 | TINSGGASTYYTDSVKG | 231 | GGSGYGDASRMTSP | 196 | STYCTYDMH | 20 | AI2DSDGTTRYADSVKG | 954 | VCVVGSRWSDY |
| hIL27Ra-VHH19-DR594 | 496 | QVQLQESGGGSVQAGGSL RLSCRASGSTYSNYCLGW FRQITGKEREGVAVINWV GGMLYFADSVKGRFTVSQ DQAKNTVYLQMNSLKPED TAMYYCAAESVSSFSCGG WLTRPDRVPYWGQGTQVT VSSGGGSQVQLQESGGGS VQAGGSLRLSCVASASTY CTYDMHWYRQAPGKGREF VSAIDSDGTTRYADSVKG RFTISQGTAKNTVYLQMN | 942 | FTFSHSGMS | 946 | TINSGGASTYYTDSVKG | 231 | GGSGYGDASRMTSP | 196 | STYCTYDMH | 202 | AIDSDGTTRYADSVKG | 954 | VCVVGSRWSIY |

TABLE 1A-continued

| Name | SEQ ID NO: | Sequence of dual VHH dimer | SEQ ID NO: | CDR1 | SEQ ID NO: | CDR2 | SEQ ID NO: | CDR3 | SEQ ID NO: | CDR4 | SEQ ID NO: | CDR5 | SEQ ID NO: | CDR6 |
|---|---|---|---|---|---|---|---|---|---|---|---|---|---|---|
| | | SLQPEDTAMYYCKTVCVV GSRWSDYWGQGTQVTSS | | | | | | | | | | | | |
| hIL27Ra-VHH20-DR594 | 497 | QVQLQESGGGLVQPGGSL RLSCAASGFTFSSYPMSW VRQAPGKGLEWVSTISSG GDTTLYADSVKGRFTSSR DNAKNTLYLQLNSLKTED TAMYYCAKRIDCNSGYCY KRSYWGQGTQVTVSSGGG SQVQLQESGGGSVQAGGS LRLSCVASASTYCTYDMH WYRQAPGKGREFVSAIDS DGTTRYADSVKGRFTISQ GTAKNTVYLQMNSLQPED TAMYYCKTVCVVGSRWSD YWGQGTQVTVSS | 942 | FTFSSHSGMS | 946 | TINSGGASTYYTDSVKG | 231 | GGSGYGDASRMTSP | 196 | STYCTYDMH | 202 | AIDSDGTTRYADSVKG | 954 | VCVVGSRWSDY |
| hIL27Ra-VHH21-DR594 | 498 | QVQLQESGGGLVQPGGSL RLSCAASGFTFSLSSMSW VRQAPGKGLEWVSAISSG GASTYYTDSVKGRFTISR DNAKNMLYLQLNSLKTED TAMYYCAKGGSGYGDASR MTSPGSQGTQVTVSSGGG SQVQLQESGGGSVQAGGS LRLSCVASASTYCTYDMH WYRQAPGKGREFVSAIDS DGTTRYADSVKGRFTISQ GTAKNTVYLQMNSLQPED TAMYYCKTVCVVGSRWSD YWGQGTQVTVSS | 942 | FTFSSHSGMS | 946 | TINSGGASTYYTDSVKG | 231 | GGSGYGDASRMTSP | 196 | STYCTYDMH | 202 | AIDSDGTTRYADSVKG | 954 | VCVVGSRWSDY |
| hIL27Ra-VHH22-DR594 | 499 | QVQLQESGGGSVQAGGSL RLSCRASGSTYSNYCLGW FRQTTGKEREGVAVINWV GGMLYFADSVKGRFTVSQ DQAKNTVYLQMNSLKPED TAMYYCAAESVSSFSCGG WLTRPDRVPYWGQGTQVT VSSGGGSQVQLQESGGGS VQAGGSLRLSCVASASTY CTYDMHWYRQAPGKGREF VSAIDSDGTTRYADSVKG RFTISQGTAKNTVYLQMN SLQPEDTAMYYCKTVCVV | 942 | FTFSSHSGMS | 946 | TINSGGASTYYTDSVKG | 231 | GGSGYGDASRMTSP | 196 | STYCTYDMH | 202 | AIDSDGTTRYADSVKG | 954 | VCVVGSRWSDY |
| hIL27Ra-VHH23-DR594 | 500 | QVQLQESGGGSVQAGGSL RLSCRASRSPYGNYCLGW FRQSTGKEREGVAVINWV GGMLYFADSVKGRFTVSQ DHAKNTVTLQMNSLKPED TAMYYCAAESVSSFSCGG WLTRPDRVPYWGQGTQVT VSSGGGSQVQLQESGGGS VQAGGSLRLSCVASASTY CTYDMHWYRQAPGKGREF VSAIDSDGTTRYADSVKG RFTISQGTAKNTVYLQMN SLQPEDTAMYYCKTVCVV GSRWSDYWGQGTQVTSS | 942 | FTFSSHSGMS | 946 | TINSGGASTYYTDSVKG | 231 | GGSGYGDASRMTSP | 196 | STYCTYDMH | 202 | AIDSDGTTRYADSVKG | 954 | VCKGSRWSDY |
| hIL27Ra-VHH24-D9R54 | 501 | QVQLQESGGGLVQPGGSL RLSCAASGFTFSHSGMSW VRQAPGKGLEWVSTINSG GASTYYTDSVKGRFTISR DNAKNMLYLQLNSLKTED TAMYYCAKGGSGYGDASR MTSPGSQGTQVTVSSGGG SQVQLQESGGGSVQAGGS LRLSCVASASTYCTYDMH WYRQAPGKGREFVSAIDS DGTTRYADSVKGRFTISQ GTAKNTVYLQMNSLQPED TAMYYCKTVCVVGSRWSD YWGQGTQVTVSS | 942 | FTFSSHSGMS | 946 | TINSGGASTYYTDSVKG | 231 | GGSGYGDASRMTSP | 196 | STYCTYDMH | 202 | AIDSDGTTRYADSVKG | 954 | VCVVGSRWSDY |

TABLE 1A-continued

| Name | SEQ ID NO: | Sequence of dual VHH dimer | SEQ ID NO: CDR1 | | SEQ ID NO: CDR2 | | SEQ ID NO: CDR3 | | SEQ ID NO: CDR4 | | SEQ ID NO: CDR5 | | SEQ ID NO: CDR6 | |
|---|---|---|---|---|---|---|---|---|---|---|---|---|---|---|
| hIL27Ra-VHH1-DR595 | 502 | QVQLQESGGGLVQPGGSL RLSCAASGFTFSSYPMSW VRQAPGKGLEWISTISAG GDTTLYADSVKGRFTSSR DNAKNTLYLQLNSLKTED AAIYYCAKRIDCNSGYCY RRNYWGQGTQVTVSSGGG SQVQLQESGGGSVQAGGS LTLSCAASEYAYSTCNMG WYRQAPGKERELVSAFIS DGSTYYADSVKGRFTITR DNAKNTVYLQMNSLKPED TAIYYCSANCYRRLRNYW GQGTQVTVSS | 942 | F T F S H S G M S | 946 | TI NS GG AS TY YT DS VK G | 231 | GG SG YG DA SR MT SP | 197 | YAY STC NMG | 203 | AFI SDG STY YAD SVK G | 209 | NC YR RL RN Y |
| hIL27Ra-VHH2-DR595 | 503 | QVQLQESGGGLVQPGGSL RLSCAASGFTFSLSGMSW VRQAPGKGLEWVSAISSG GASTYYTDSVKGRFTISR DNAKNILYLQLNSLKTED TAMYYCAKGGSGYGDASR MTSPGSQGTQVTVSSGGG SQVQLQESGGGSVQAGGS LTLSCAASEYAYSTCNMG WYRQAPGKERELVSAFIS DGSTYYADSVKGRFTITR DNAKNTVYLQMNSLKPED TAIYYCSANCYRRLRNYW GQGTQVTVSS | 942 | F T F S H S G M S | 946 | TI NS GG AS TY YT DS VK G | 231 | GG SG YG DA SR MT SP | 197 | YAY STC NMG | 203 | AFI SDG STY YAD SVK G | 209 | NC YR RL RN Y |
| hIL27Ra-VHH3-DR595 | 504 | QVQLQESGGGSVQAGGSL RLSCVASGYVSCDYFLPS WYRQAPGKEREFVSIIDG TGSTSYAASVKGRFTASE DKGKNIAYLQMNSLKPED TAMYYCKASCVRGRAVSE YWGQGTQVTVSSGGGSQV QLQESGGGSVQAGGSLTL SCAASEYAYSTCNMGWYR QAPGKERELVSAFISDGS TYYADSVKGRFTITRDNA KNTVYLQMNSLKPEDTAI YYCSANCYRRLRNYWGQG TQVTVSS | 942 | F T F S H S G M S | 946 | TI NS GG AS TY YT DS VK G | 231 | GG SG YG DA SR MT SP | 197 | YAY STC NMG | 203 | AFI SDG STY YAD SVK G | 209 | NC YR RL RN Y |
| hIL27Ra-VHH4-DR595 | 505 | QVQLQESGGGLVQPGESL RLSCTASGFTFSNYAMSW VRQAPGKGLEWVSGINVA YGITSYADSVKGRFTISR DNTKNTLYLQLNSLKTED TAIYYCVKHSGTTIPRGF ISYTKRGQGTQVTVSSGG GSQVQLQESGGGSVQAGG SLTLSCAASEYAYSTCNM GWYRQAPGKERELVSAFI SDGSTYYADSVKGRFTIT RDNAKNTVYLQMNSLKPE DTAIYYCSANCYRRLRNY WGQGTQVTVSS | 942 | F T F S H S G M S | 946 | TI NS GG AS TY YT DS VK G | 231 | GG SG YG DA SR MT SP | 197 | YAY STC NMG | 203 | AFI SDG STY YAD SVK G | 209 | NC YR RI RN Y |
| hIL27Ra-VHH5-DR595 | 506 | QVQLQESGGGSVQAGGSL RLSCTASGYVSCDYFLPS WYRQAPGKEREFVSVIDG TGSTSYAASVKGRFTASQ DKGKNIAYLQMNSLKPED TAMYYCKASCVRGRAISE YWGQGTQVTVSSGGGSQV QLQESGGGSVQAGGSLTL SCAASEYAYSTCNMGWYR QAPGKERELVSAFISDGS TYYADSVKGRFTITRDNA KNTVYLQMNSLKPEDTAI YYCSANCYRRLRNYWGQG TQVTVSS | 942 | F T F S H S G M S | 946 | TI NS GG AS TY YT DS VK G | 231 | GG SG YG DA SR MT SP | 197 | YAY STC NMG | 203 | AFI SDG STY YAD SVK G | 209 | NC YR RL RN Y |

TABLE 1A-continued

| Name | SEQ ID NO: | Sequence of dual VHH dimer | SEQ ID NO: | CDR1 | SEQ ID NO: | CDR2 | SEQ ID NO: | CDR3 | SEQ ID NO: | CDR4 | SEQ ID NO: | CDR5 | SEQ ID NO: | CDR6 |
|---|---|---|---|---|---|---|---|---|---|---|---|---|---|---|
| hIL27Ra-VHH6-DR595 | 507 | QVQLQESGGGLVQPGGSLRLSCAASGFSFSSYAMKWVRQAPGKGLEWVSTISSGGSSTNYADSVKGRFTISRDNAKNTLYLQLNSLKIEDTAMYYCAKAIVPTGATMERGQGTQVTVSSGGGSQVQLQESGGGSVQAGGSLTLSCAASEYAYSTCNMGWYRQAPGKERELVSAFISDGSTYYADSVKGRFTITRDNAKNTVYLQMNSLKPEDTAIYYCSANCYRRLRNYWGQGTQVTVSS | 942 | FTFSHSGMS | 946 | TINSGGASTYYTDSVKG | 231 | GGSGYGDASRMTSP | 197 | YAYSTCNMG | 203 | AFISDGSTYYADSVKG | 209 | NCYRRLRNY |
| hIL27Ra-VHH7-DR595 | 508 | QVQLQESGGGLVQPGGSLRLSCAASGFTFSSYPMSWVRQAPGKGLEWISTISAGGDTTLYADSVKGRFTSSRDNAKNTLYLQLNSLKTEDTAIYYCAKRIDCNSGYCYRRNYWGQGTQVTVSSGGGSQVQLQESGGGSVQAGGSLTLSCAASEYAYSTCNMGWYRQAPGKERELVSAFISDGSTYYADSVKGRFTITRDNAKNTVYLQMNSLKPEDTAIYYCSANCYRRLRNYWGQGTQVTVSS | 942 | FTFSHSGMS | 946 | TINSGGASTYYTDSVKG | 231 | GGSGYGDASRMTSP | 197 | YAYSTCNMG | 203 | AFISDGSTYYADSVKG | 209 | NCYRRLRNY |
| hIL27Ra-VHH8-DR595 | 509 | QVQLQESGGGSVQVGGSLRLSCAASGFTFSSYPMSWVRQAPGKGLEWISTISAGGDTTLYADSVKGRFTSSRDNAKNTLYLQLNSLKTEDTAIYYCAKRIDCNSGYCYRRNYWGQGTQVTVSSGGGSQVQLQESGGGSVQAGGSLTLSCAASEYAYSTCNMGWYRQAPGKERELVSAFISDGSTYYADSVKGRFTITRDNAKNTVYLQMNSLKPEDTAIYYCSANCYRRLRNYWGQGTQVTVSS | 942 | FTFSHSGMS | 946 | TINSGGASTYYTDSVKG | 231 | GGSGY GDASRMTSP | 197 | YAYSTCNMG | 203 | AFISDGSTYYADSVKG | 209 | NCYRRLRNY |
| hIL27Ra-VHH9-DR595 | 510 | QVQLQESGGGSVQSGGSLRLSCAASGFTYSTSNSWMAWFRQAPGKEREGVAAIYTVGGSIFYADSVRGRFTISQDATKNMFYLQMNTLKPEDTAMYYCAAASGRLRGKWFWPYEYNYWGQGTQVTVSSGGGSQVQLQESGGGSVQAGGSLTLSCAASEYAYSTCNMGWYRQAPGKERELVSAFISDGSTYYADSVKGRFTITRDNAKNTVYLQMNSLKPEDTAIYYCSANCYRRLRNYWGQGTQVTVSS | 942 | FTFSHSGMS | 946 | TINSGGASTYYTDSVKG | 231 | GGSGYGDASRMTSP | 197 | YAYSTCNMG | 203 | AFISDGSTYYADSVKG | 209 | NCYRRLRNY |
| hIL27Ra-VHH10-DR595 | 511 | QVQLQESGGGSVQAGGSLRLSCRASGSTYSNYCLGWFRQITGKEREGVAVINWVGGMLYFADSVKGRFTVSQDQAKNTLYLQMNSLKPEDTAMYYCAAESVSSFSCGGWLTRPDRVPYWGQGTQVTVSSGGGSQVQLQESGGGSVQAGGSLTLSCAASEYAYSTCNMGWYRQAPGKERELVSAFISDGSTYYADSVKGRFTITRDNAKNTVYLQMNSLKPEDTAIYYCSANCYRRLRNYWGQGTQVTVSS | 942 | FTFSHSGMS | 946 | TINSGGASTYYTDSVKG | 231 | GGSGYGDASRMTSP | 197 | YAYSTCNMG | 203 | AFISDGSTYYADSVKG | 209 | NCYRRLRNY |

TABLE 1A-continued

| Name | SEQ ID NO: | Sequence of dual VHH dimer | SEQ ID NO: | CDR1 | SEQ ID NO: | CDR2 | SEQ ID NO: | CDR3 | SEQ ID NO: | CDR4 | SEQ ID NO: | CDR5 | SEQ ID NO: | CDR6 |
|---|---|---|---|---|---|---|---|---|---|---|---|---|---|---|
| hIL27Ra-VHH11-DR595 | 512 | QVQLQESGGGSVQAGGSLRLSCRASGSTYSNYCLGWFRQSTGKEREGVAVINWVGGMLYFADSVKGRFTVSQDHAKNTVTLQMNSLKPEDTAMYYCAAESVSSFSCGGWLTRPGRVPYWGQGTQVTVSSGGGSQVQLQESGGGSVQAGGSLTLSCAASEYAYSTCNMGWYRQAPGKERELVSAFISDGSTYYADSVKGRFTITRDNAKNTVYLQMNSLKPEDTAIYYCSANCYRRLRNYWGQGTQVTVSS | 942 | FTFSHSGMS | 946 | TINSGGASTYYTDSVKG | 231 | GGSGYGDASRMTSP | 197 | YAYSTCNMG | 203 | AFISDGSTYYADSVKG | 209 | NCYRRLRNY |
| hIL27Ra-VHH12-DR595 | 513 | QVQLQESGGGSVQAGESLRLSCRASGSTYSNYCLGWFRQITGKEREGVAVINWVGGMLYFADSVKGRFTVSQDQAKNTVYLEMNSLKPEDTAMYYCATESVSSFSCGGWLTRPDRVPYWGQGTQVTVSSGGGSQVQLQESGGGSVQAGGSLTLSCAASEYAYSTCNMGWYRQAPGKERELVSAFISDGSTYYADSVKGRFTITRDNAKNTVYLQMNSLKPEDTAIYYCSANCYRRLRNYWGQGTQVTVSS | 942 | FTFSHSGMS | 946 | TINSGGASTYYTDSVKG | 231 | GGSGYGDASRMTSP | 197 | YAYSTCNMG | 203 | AFISDGSTYYADSVKG | 209 | NCYRRIRNY |
| hIL27Ra-VHH13-DR595 | 514 | QVQLQESGGGSVQAGGSLRLSCVASGYVSCDYFLPSWYRQAPGKEREFVSIIDGTGSTSYAASVKGRFTASQDRGKNIAYLQMNSLKPEDTAMYYCKASCVRGRTISEYWGQGTQVTVSSGGGSQVQLQESGGGSVQAGGSLTLSCAASEYAYSTCNMGWYRQAPGKERELVSAFISDGSTYYADSVKGRFTITRDNAKNTVYLQMNSLKPEDTAIYYCSANCYRRLRNYWGQGTQVTVSS | 942 | FTFSHSGMS | 946 | TINSGGASTYYTDSVKG | 231 | GGSGYGDASRMTSP | 197 | YAYSTCNMG | 203 | AFISDGSTYYADSVKG | 209 | NCYRRLRNY |
| hIL27Ra-VHH14-DR595 | 515 | QVQLQESGGGSVQAGGSLRLSCVASGYVSCDYFLPSWYRQAPGKEREFVSIIDGTGSTSYAASVKGRFTASQDKGKNIAYLQMNSLKPEDTAMYYCKASCVRGRAISEYWGQGTQVTVSSGGGSQVQLQESGGGSVQAGGSLTLSCAASEYAYSTCNMGWYRQAPGKERELVSAFISDGSTYYADSVKGRFTITRDNAKNTVYLQMNSLKPEDTAIYYCSANCYRRLRNYWGQGTQVTVSS | 942 | FTFSHSGMS | 946 | TINSGGASTYYTDSVKG | 231 | GGSGYGDASRMTSP | 197 | YAYSTCNMG | 203 | AFISDGSTYYADSVKG | 209 | NCYRRLRNY |
| hIL27Ra-VHH15-DR595 | 516 | QVQLQESGGGSVQAGGSLRLSCVASGYVSCDYFLPSWYRQAPGKEREFVSIIDGTGSTSYAASVKGRFTASQDKGKNIAYLQMNTLKPEDTAMYYCKASCVRGRAISEYWGQGTQVTVSSGGGSQVQLQESGGGSVQAGGSLTLSCAASEYAYSTCNMGWYRQAPGKERELVSAFISDGSTYYADSVKGRFTITRDNAKNTVYLQMNSLKPEDTAIYYCSANCYRRLRNYWGQGTQVTVSS | 942 | FTFSHSGMS | 946 | TINSGGASTYYTDSVKG | 231 | GGSGYGDASRMTSP | 197 | YAYSTCNMG | 203 | AFISDGSTYYADSVKG | 209 | NCYRRLRIY |

TABLE 1A-continued

| Name | SEQ ID NO: | Sequence of dual VHH dimer | SEQ ID NO: | CDR1 | SEQ ID NO: | CDR2 | SEQ ID NO: | CDR3 | SEQ ID NO: | CDR4 | SEQ ID NO: | CDR5 | SEQ ID NO: | CDR6 |
|---|---|---|---|---|---|---|---|---|---|---|---|---|---|---|
| hIL27Ra-VHH16-DR595 | 517 | QVQLQESGGGSVQAGGSLRLSCRASGSTYSNYCLGWFRQITGKEREGVAVINWVGGMLYFADSVKGRFTVSQDQAKNTVYLQMNSLKPEDTAMYYCAAESASSFSCGGWLTRPDRVPYWGQGTQVTVSSGGGSQVQLQESGGGSVQAGGSLTLSCAASEYAYSTCNMGWYRQAPGKERELVSAFISDGSTYYADSVKGRFTITRDNAKNTVYLQMNSLKPEDTAIYYCSANCYRRLRNYWGQGTQVTVSS | 942 | FTFSHSGMS | 946 | TINSGGASTYTDSVIG | 231 | GGSGYGDASRMTSP | 197 | YAYSTCNMG | 203 | AFISDGSTYYADSVKG | 209 | NCYRRLRNY |
| hIL27Ra-VHH17-DR595 | 518 | QVQLQESGGGLVQPGGSLRLSCAASGFTFSLSGMSWVRQAPGKGLEWVSAISSGGASTYYTDSVKGRFTISRDNAKNMLYLQLNSLKTEDTAMYYCAKGGSGYGDASRMTSPGSQGTQVTVSSGGGSQVQLQESGGGSVQAGGSLTLSCAASEYAYSTCNMGWYRQAPGKERELVSAFISDGSTYYADSVKGRFTITRDNAKNTVYLQMNSLKPEDTAIYYCSANCYRRLRNYWGQGTQVTVSS | 942 | FTFSHSGMS | 946 | TINSGGASTYTDSVKG | 231 | GGSGYGDASRMTSP | 197 | YAYSTCNMG | 203 | AFISDGSTYYADSVKG | 209 | NCYRRLRNY |
| hIL27Ra-VHH18-DR595 | 519 | QVQLQESGGGSVQAGGSLRLSCVASGYVSCDYFLPSWYRQAPGKEREFVSIIDGTGSTSYAASVKGRFTASQDKGKNIAYLQMNSLKPEDTAMYYCKASCVRGRGISEYWGQGTQVTVSSGGGSQVQLQESGGGSVQAGGSLTLSCAASEYAYSTCNMGWYRQAPGKERELVSAFISDGSTYYADSVKGRFTITRDNAKNTVYLQMNSLKPEDTAIYYCSANCYRRLRNYWGQGTQVTVSS | 942 | FTFSHSGMS | 946 | TINSGGASTYTDSVKG | 231 | GGSGYGDASRMTSP | 197 | YAYSTCNMG | 203 | AFISDGSTYYADSVKG | 209 | NCYRRLRNY |
| hIL27Ra-VHH19-DR595 | 520 | QVQLQESGGGSVQAGGSLRLSCRASGSTYSNYCLGWFRQITGKEREGVAVINWVGGMLYFADSVKGRFTVSQDQAKNTVYLQMNSLKPEDTAMYYCAAESVSSFSCGGWLTRPDRVPYWGQGTQVTVSSGGGSQVQLQESGGGSVQAGGSLTLSCAASEYAYSTCNMGWYRQAPGKERELVSAFISDGSTYYADSVKGRFTITRDNAKNTVYLQMNSLKPEDTAIYYCSANCYRRLRNYWGQGTQVTVSS | 942 | FTFSHSGMS | 946 | TINSGGASTYTDSVKG | 231 | GGSGYGDASRMTSP | 197 | YAYSTCNMG | 203 | AFISDGSTYYADSVKG | 209 | NCYRRLRNY |
| hIL27Ra-VHH20-DR595 | 521 | QVQLQESGGGLVQPGGSLRLSCAASGFTFSSYPMSWVRQAPGKGLEWVSTISSGGDTTLYADSVKGRFTSSRDNAKNTLYLQLNSLKTEDTAMYYCAKRIDCNSGYCYKRSYWGQGTQVTVSSGGGSQVQLQESGGGSVQAGGSLTLSCAASEYAYSTCNMGWYRQAPGKERELVSAFISDGSTYYADSVKGRFTITRDNAKNTVYLQMNSLKPEDTAIYYCSANCYRRLRNYWGQGTQVTVSS | 942 | FTFSHSGMS | 946 | TINSGGASTYTDSVKG | 231 | GGSGYGDASRMTSP | 197 | YAYSTCNMG | 203 | AFISDGSTYYADSVKG | 209 | NCYRRLRNY |

TABLE 1A-continued

| Name | SEQ ID NO: | Sequence of dual VHH dimer | SEQ ID NO: | CDR1 | SEQ ID NO: | CDR2 | SEQ ID NO: | CDR3 | SEQ ID NO: | CDR4 | SEQ ID NO: | CDR5 | SEQ ID NO: | CDR6 |
|---|---|---|---|---|---|---|---|---|---|---|---|---|---|---|
| hIL27Ra-VHH21-DR595 | 522 | QVQLQESGGGLVQPGGSLRLSCAASGFTFSLSSMSWVRQAPGKGLEWVSAISSGGASTYYTDSVKGRFTISRDNAKNMLYLQLNSLKTEDTAMYYCAKGGSGYGDASRMTSPGSQGTQVTVSSGGGSQVQLQESGGGSVQAGGSLTLSCAASEYAYSTCNMGWYRQAPGKERELVSAFISDGSTYYADSVKGRFTITRDNAKNTVYLQMNSLKPEDTAIYYCSANCYRRLRNYWGQGTQVTVSS | 942 | FTFSHSGMS | 946 | TINSGGASTYYTDSVKG | 231 | GGSGYGDASRMTSP | 197 | YAYSTCNMG | 203 | AFISDGSTYADSVKG | 209 | NCYRRLRNY |
| hIL27Ra-VHH22-DR595 | 523 | QVQLQESGGGSVQAGGSLRLSCRASGSTYSNYCLGWFRQTTGKEREGVAVINWVGGMLYFADSVKGRFTVSQDQAKNTVYLQMNSLKPEDTAMYYCAAESVSSFSCGGWLTRPDRVPYWGQGTQVTVSSGGGSQVQLQESGGGSVQAGGSLTLSCAASEYAYSTCNMGWYRQAPGKERELVSAFISDGSTYYADSVKGRFTITRDNAKNTVYLQMNSLKPEDTAIYYCSANCYRRLRNYWGQGTQVTVSS | 942 | FTFSHSGMS | 946 | TINSGGASTYYTDSVKG | 231 | GGSGYGDASRMTSP | 197 | YAYSTCNMG | 203 | AFISDGSTYADSVKG | 209 | NCYRRIRIY |
| hIL27Ra-VHH23-DR595 | 524 | QVQLQESGGGSVQAGGSLRLSCRASRSPYGNYCLGWFRQSTGKEREGVAVINWVGGMLYFADSVKGRFTVSQDHAKNTVTLQMNSLKPEDTAMYYCAAESVSSFSCGGWLTRPDRVPYWGQGTQVTVSSGGGSQVQLQESGGGSVQAGGSLTLSCAASEYAYSTCNMGWYRQAPGKERELVSAFISDGSTYYADSVKGRFTITRDNAKNTVYLQMNSLKPEDTAIYYCSANCYRRLRNYWGQGTQVTVSS | 942 | FTFSHSGMS | 946 | TINSGGASTYYTDSVKG | 231 | GGSGYGDASRMTSP | 197 | YAYSTCNMG | 203 | AFISDGSTYADSVKG | 209 | NCYRRLRNY |
| hIL27Ra-VHH24-DR595 | 525 | QVQLQESGGGLVQPGGSLRLSCAASGFTFSHSGMSWVRQAPGKGLEWVSTINSGGASTYYTDSVKGRFTISRDNAKNMLYLQLNSLKTEDTAMYYCAKGGSGYGDASRMTSPGSQGTQVTVSSGGGSQVQLQESGGGSVQAGGSLTLSCAASEYAYSTCNMGWYRQAPGKERELVSAFISDGSTYYADSVKGRFTITRDNAKNTVYLQMNSLKPEDTAIYYCSANCYRRLRNYWGQGTQVTVSS | 942 | FTFSHSGMS | 946 | TINSGGASTYYTDSVKG | 231 | GGSGYGDASRMTSP | 197 | YAYSTCNMG | 203 | AFISDGSTYADSVKG | 209 | NCYRRLRNY |
| hIL27Ra-VHH1-DR596 | 526 | QVQLQESGGGLVQPGGSLRLSCAASGFTFSSYPMSWVRQAPGKGLEWISTISAGGDTTLYADSVKGRFTSSRDNAKNTLYLQLNSLKTEDAAIYYCAKRIDCNSGYCYRRNYWGQGTQVTVSSGGGSQVQLQESGGGLVQPGGSLRLSCTASGLTFDDSVMGWFRQAPGKGREAVSCISSSGANAFYADSVKGRFTISRDNAKNTLYLQMNSLKPEDTATYYCKRGHACAGYYPIPYDDYWGQGTQVTVSS | 942 | FTFSHSGMS | 946 | TINSGGASTYYTDSVKG | 231 | GGSGYGDASRMTSP | 198 | LTFDDSVMG | 204 | CISSSGANAFYADSVKG | 210 | GHACAGYYPIPYDDY |

TABLE 1A-continued

| Name | SEQ ID NO: | Sequence of dual VHH dimer | SEQ ID NO: | CDR1 | SEQ ID NO: | CDR2 | SEQ ID NO: | CDR3 | SEQ ID NO: | CDR4 | SEQ ID NO: | CDR5 | SEQ ID NO: | CDR6 |
|---|---|---|---|---|---|---|---|---|---|---|---|---|---|---|
| hIL27Ra-VHH2-DR596 | 527 | QVQLQESGGGLVQPGGSLRLSCAASGFTFSLSGMSWVRQAPGKGLEWVSAISSGGASTYYTDSVKGRFTISRDNAKNILYLQLNSLKTEDTAMYYCAKGGSGYGDASRMTSPGSQGTQVTVSSGGGSQVQLQESGGGLVQPGGSLRLSCTASGLTFDDSVMGWFRQAPGKGREAVSCISSSGANAFYADSVKGRFTISRDNAKNTLYLQMNSLKPEDTATYYCKRGHACAGYYPIPYDDYWGQGTQVTVSS | 942 | FTFSLSGMS | 946 | TINSGGASTYYTDSVKG | 231 | GGSGYGDASRMTSP | 198 | LTFDDSVMG | 204 | CISSSGANAFYADSVKG | 210 | GHACAGYYPIPYDDY |
| hIL27Ra-VHH3-DR596 | 528 | QVQLQESGGGSVQAGGSLRLSCVASGYVSCDYFLPSWYRQAPGKEREFVSIIDGTGSTSYAASVKGRFTASEDKGKNIAYLQMNSLKPEDTAMYYCKASCVRGRAVSEYWGQGTQVTVSSGGGSQVQLQESGGGLVQPGGSLRLSCTASGLTFDDSVMGWFRQAPGKGREAVSCISSSGANAFYADSVKGRFTISRDNAKNTLYLQMNSLKPEDTATYYCKRGHACAGYYPIPYDDYWGQGTQVTVSS | 942 | FTFSLSGMS | 946 | TINSGGASTYYTDSVKG | 231 | GGSGYGDASRMTKSP | 198 | LTFDDSVMG | 204 | CISSSGANAFYADSVKG | 210 | GHACAGYYPIPYDIY |
| hIL27Ra-VHH4-DR596 | 529 | QVQLQESGGGLVQPGESLRLSCTASGFTFSNYAMSWVRQAPGKGLEWVSGINVAYGITSYADSVKGRFTISRDNTKNTLYLQLNSLKTEDTAIYYCVKHSGTTIPRGFISYTKRGQGTQVTVSSGGGSQVQLQESGGGLVQPGGSLRLSCTASGLTFDDSVMGWFRQAPGKGREAVSCISSSGANAFYADSVKGRFTISRDNAKNTLYLQMNSLKPEDTATYYCKRGHACAGYYPIPYDDYWGQGTQVTVSS | 942 | FTFSHSGMS | 946 | TINSGGASTYYTDSVKG | 231 | GGSGYGDASRMTSP | 198 | LTFDDSVMG | 204 | CISSSGANAFYADSVKG | 210 | GHACAGYYPIYDIY |
| hIL27Ra-VHH5-DR596 | 530 | QVQLQESGGGSVQAGGSLRLSCTASGYVSCDYFLPSWYRQAPGKEREFVSVIDGTGSTSYAASVKGRFTASQDKGKNIAYLQMNSLKPEDTAMYYCKASCVRGRAISEYWGQGTQVTVSSGGGSQVQLQESGGGLVQPGGSLRLSCTASGLTFDDSVMGWFRQAPGKGREAVSCISSSGANAFYADSVKGRFTISRDNAKNTLYLQMNSLKPEDTATYYCKRGHACAGYYPIPYDDYWGQGTQVTVSS | 942 | FTFSHSGMS | 946 | TINSGGASTYYTDSVKG | 231 | GGSGYGDASRMTSP | 198 | LTFDDSVMG | 204 | CISSSGANAFYADSVKG | 210 | GHACAGYYPIPYDDY |
| hIL27Ra-VHH6-DR596 | 531 | QVQLQESGGGLVQPGGSLRLSCAASGFSFSSYAMKWVRQAPGKGLEWVSTISSGGSSTNYADSVKGRFTISRDNAKNTLYLQLNSLKIEDTAMYYCAKAIVPTGATMERGQGTQVTVSSGGGSQVQLQESGGGLVQPGGSLRLSCTASGLTFDDSVMGWFRQAPGKGREAVSCISSSGANAFYADSVKGRFTISRDNAKNTLYLQMNSLKPEDTATYYCKRGHACAGYYPIPYDDYWGQGTQVTVSS | 942 | FTFSHSGMS | 946 | TINSGGASTYYTDSVKG | 231 | GGSGYGDASRMTSP | 198 | LTFDDSVMG | 204 | CISSSGANAFYADSVKG | 210 | GHACAGYYPIPYDDY |

TABLE 1A-continued

| Name | SEQ ID NO: | Sequence of dual VHH dimer | SEQ ID NO: | CDR1 | SEQ ID NO: | CDR2 | SEQ ID NO: | CDR3 | SEQ ID NO: | CDR4 | SEQ ID NO: | CDR5 | SEQ ID NO: | CDR6 |
|---|---|---|---|---|---|---|---|---|---|---|---|---|---|---|
| hIL27Ra-VHH7-DR596 | 532 | QVQLQESGGGLVQPGGSLRLSCAASGFTFSSYPMSWVRQAPGKGLEWISTISAGGDTTLYADSVKGRFTSSRDNAKNTLYLQLNSLKTEDTAIYYCAKRIDCNSGYCYRRNYWGQGTQVTVSSGGGSQVQLQESGGGLVQPGGSLRLSCTASGLTFDDSVMGWFRQAPGKGREAVSCISSSGANAFYADSVKGRFTISRDNAKNTLYLQMNSLKPEDTATYYCKRGHACAGYYPIPYDDYWGQGTQVTVSS | 942 | FTFSSHSGMS | 946 | TINSGGASTYYTDSVKG | 231 | GGSGYGDASRMTSP | 198 | LTFDDSVMG | 204 | CISSSGANAFYADSVKG | 210 | GHACAGYYPIPYDDY |
| hIL27Ra-VHH8-DR596 | 533 | QVQLQESGGGSVQVGGSLRLSCAASGFTFSSYPMSWVRQAPGKGLEWISTISAGGDTTLYADSVKGRFTSSRDNAKNTLYLQLNSLKTEDTAIYYCAKRIDCNSGYCYRRNYWGQGTQVTVSSGGGSQVQLQESGGGLVQPGGSLRLSCTASGLTFDDSVMGWFRQAPGKGREAVSCISSSGANAFYADSVKGRFTISRDNAKNTLYLQMNSLKPEDTATYYCKRGHACAGYYPIPYDDYWGQGTQVTVSS | 942 | FTFSSHSGMS | 946 | TINSGGASTYYTDSVKG | 231 | GGSGYGDASRMTSP | 198 | LTFDDSVMG | 204 | CISSSGANAFYADSVKG | 210 | GHACAGYYPIPYDDY |
| hIL27Ra-VHH9-DR596 | 534 | QVQLQESGGGSVQSGGSLRLSCAASGFTYSTSNSWMAWFRQAPGKEREGVAAIYTVGGSIFYADSVRGRFTISQDATKNMFYLQMNTLKPEDTAMYYCAAASGRLRGKWFWPYEYNYWGQGTQVTVSSGGGSQVQLQESGGGLVQPGGSLRLSCTASGLTFDDSVMGWFRQAPGKGREAVSCISSSGANAFYADSVKGRFTISRDNAKNTLYLQMNSLKPEDTATYYCKRGHACAGYYPIPYDDYWGQGTQVTVSS | 942 | FTFSSHSGMS | 946 | TINSGGASTYYTDSVKG | 231 | GGSGYGDASRMTSP | 198 | LTFDDSVMG | 204 | CISSSGANAFYADSVKG | 210 | GHACAGYYPIPYDDY |
| hIL27Ra-VHH10-DR596 | 535 | QVQLQESGGGSVQAGGSLRLSCRASGSTYSNYCLGWFRQITGKEREGVAVINWVGGMLYFADSVKGRFTVSQDQAKNTLYLQMNSLKPEDTAMYYCAAESVSSFSCGGWLTRPDRVPYWGQGTQVTVSSGGGSQVQLQESGGGLVQPGGSLRLSCTASGLTFDDSVMGWFRQAPGKGREAVSCISSSGANAFYADSVKGRFTISRDNAKNTLYLQMNSLKPEDTATYYCKRGHACAGYYPIPYDDYWGQGTQVTVSS | 942 | FTFSSHSGMS | 946 | TINSGGASTYYTDSVKG | 231 | GGSGYGDASRMTSP | 198 | LTFDDSVMG | 204 | CISSSGANAFYADSVKG | 210 | GHACAGYYPIPYDDY |
| hIL27Ra-VHH11-DR596 | 536 | QVQLQESGGGSVQAGGSLRLSCRASGSTYSNYCLGWFRQSTGKEREGVAVINWVGGMLYFADSVKGRFTVSQDHAKNTVTLQMNSLKPEDTAMYYCAAESVSSFSCGGWLTRPGRVPYWGQGTQVTVSSGGGSQVQLQESGGGLVQPGGSLRLSCTASGLTFDDSVMGWFRQAPGKGREAVSCISSSGANAFYADSVKGRFTISRDNAKNTLYLQMNSLKPEDTATYYCKRGHA | 942 | FTFSSHSGMS | 946 | TINSGGASTYYTVKG | 231 | GGSGYGDASRMTSP | 198 | LTFDDSVMG | 204 | CISSSGANAFYADSVKG | 210 | GHACAGYYPIPYDDY |

TABLE 1A-continued

| Name | SEQ ID NO: | Sequence of dual VHH dimer | SEQ ID NO: | CDR1 | SEQ ID NO: | CDR2 | SEQ ID NO: | CDR3 | SEQ ID NO: | CDR4 | SEQ ID NO: | CDR5 | SEQ ID NO: | CDR6 |
|---|---|---|---|---|---|---|---|---|---|---|---|---|---|---|
| | | CAGYYPIPYDDYWGQGTQVTVSS | | | | | | | | | | | | |
| hIL27Ra-VHH12-DR596 | 537 | QVQLQESGGGSVQAGESLRLSCRASGSTYSNYCLGWFRQITGKEREGVAVINWVGGMLYFADSVKGRFTVSQDQAKNTVYLEMNSLKPEDTAMYYCATESVSSFSCGGWLTRPDRVPYWGQGTQVTVSSGGGSQVQLQESGGGLVQPGGSLRLSCTASGLTFDDSVMGWFRQAPGKGREAVSCISSSGANAFYADSVKGRFTISRDNAKNTLYLQMNSLKPEDTATYYCKRGHACAGYYPIPYDDYWGQGTQVTVSS | 942 | FTFSHSGMS | 946 | TINSGGASTYYTDSVKG | 231 | GGSGYGDASRMTSP | 198 | LTFDDSVMG | 204 | CISSSGANAFYADSVKG | 210 | GHACAGYYPIPYDDY |
| hIL27Ra-VHH13-DR596 | 538 | QVQLQESGGGSVQAGGSLRLSCVASGYVSCDYFLPSWYRQAPGKEREFVSIIDGTGSTSYAASVKGRFTASQDRGKNIAYLQMNSLKPEDTAMYYCKASCVRGRTISEYWGQGTQVTVSSGGGSQVQLQESGGGLVQPGGSLRLSCTASGLTFDDSVMGWFRQAPGKGREAVSCISSSGANAFYADSVKGRFTISRDNAKNTLYLQMNSLKPEDTATYYCKRGHACAGYYPIPYDDYWGQGTQVTVSS | 942 | FTFSHSGMS | 946 | TINSGGASTYYTDSVKG | 231 | GGSGYGDASRMTSP | 198 | LTFDDSVMG | 204 | CISSSGANAFYADSVKG | 210 | GHACAGYYPIPYDDY |
| hIL27Ra-VHH14-DR596 | 539 | QVQLQESGGGSVQAGGSLRLSCVASGYVSCDYFLPSWYRQAPGKEREFVSIIDGTGSTSYAASVKGRFTASQDKGKNIAYLQMNSLKPEDTAMYYCKASCVRGRAISEYWGQGTQVTVSSGGGSQVQLQESGGGLVQPGGSLRLSCTASGLTFDDSVMGWFRQAPGKGREAVSCISSSGANAFYADSVKGRFTISRDNAKNTLYLQMNSLKPEDTATYYCKRGHACAGYYPIPYDDYWGQGTQVTVSS | 942 | FTFSHSGMS | 946 | TINSGGASTYYTDSVKG | 231 | GGSGYGDASRMTSP | 198 | LTFDDSVMG | 204 | CISSSGANAFYADSVKG | 210 | GHACAGYYPIPYDDY |
| hIL27Ra-VHH15-DR596 | 540 | QVQLQESGGGSVQAGGSLRLSCVASGYVSCDYFLPSWYRQAPGKEREFVSIIDGTGSTSYAASVKGRFTASQDKGKNIAYLQMNSLKPEDTAMYYCKASCVRGRAISEYWGQGTQVTVSSGGGSQVQLQESGGGLVQPGGSLRLSCTASGLTFDDSVMGWFRQAPGKGREAVSCISSSGANAFYADSVKGRFTISRDNAKNTLYLQMNSLKPEDTATYYCKRGHACAGYYPIPYDDYWGQGTQVTVSS | 942 | FTFSHSGMS | 946 | TINSGGASTYYTDSVKG | 231 | GGSGYGDASRMTSP | 198 | LTFDDSVMG | 204 | CISSSGANAFYADSVKG | 210 | GHACAGYYPIPYDDY |
| hIL27Ra-VHH16-DR596 | 541 | QVQLQESGGGSVQAGGSLRLSCRASGSTYSNYCLGWFRQITGKEREGVAVINWVGGMLYFADSVKGRFTVSQDQAKNTVYLQMNSLKPEDTAMYYCAAESASSFSCGGWLTRPDRVPYWGQGTQVTVSSGGGSQVQLQESGGGLVQPGGSLRLSCTASGLTFDDSVMGWFRQAPGKGREAVSCISSSGANAFYADSVKGRFTISRDNAKNTLYLQM | 942 | FTFSHSGMS | 946 | TINSGGASTYYTDSVKG | 231 | GGSGYGDASRMTSP | 198 | LTFDDSVMG | 204 | CISSSGANAFYADSVKG | 210 | GHACAGYYPIPYDDY |

TABLE 1A-continued

| Name | SEQ ID NO: | Sequence of dual VHH dimer | SEQ ID NO: | CDR1 | SEQ ID NO: | CDR2 | SEQ ID NO: | CDR3 | SEQ ID NO: | CDR4 | SEQ ID NO: | CDR5 | SEQ ID NO: | CDR6 |
|---|---|---|---|---|---|---|---|---|---|---|---|---|---|---|
| | | NSLKPEDTATYYCKRGHA CAGYYPIPYDDYWGQGTQ VTVSS | | | | | | | | | | | | |
| hIL27Ra- VHH17- DR596 | 542 | QVQLQESGGGLVQPGGSL RLSCAASGFTFSLSGMSW VRQAPGKGLEWVSAISSG GASTYYTDSVKGRFTISR DNAKNMLYLQLNSLKTED TAMYYCAKGGSGYGDASR MTSPGSQGTQVTVSSGGG SQVQLQESGGGLVQPGGS LRLSCTASGLTFDDSVMG WFRQAPGKGREAVSCISS SGANAFYADSVKGRFTIS RDNAKNTLYLQMNSLKPE DTATYYCKRGHACAGYYP IPYDDYWGQGTQVTVSS | 942 | F T F S H S G M S | 946 | TI NS GG AS TY YT S VK G | 231 | GG SG YG DA SR MT SP | 198 | LTF DDS VMG | 204 | CIS SSG ANA FYA DSV KG | 210 | GH AC AG YY PI PY DD Y |
| hIL27Ra- VHH18- DR596 | 543 | QVQLQESGGGSVQAGGSL RLSCVASGYVSCDYFLPS WYRQAPGKEREFVSIIDG TGSTSYAASVKGRFTASQ DKGKNIAYLQMNSLKPED TAMYYCKASCVRGRGISE YWGQGTQVTVSSGGGSQV QLQESGGGLVQPGGSLRL SCTASGLTFDDSVMGWFR QAPGKGREAVSCISSSGA NAFYADSVKGRFTISRDN AKNTLYLQMNSLKPEDTA TYYCKRGHACAGYYPIPY DDYWGQGTQVTVSS | 942 | F T F S H S G M S | 946 | TI NS GG AS TY YT DS VK G | 231 | GG SG YG DA SR MT SP | 198 | LTF DDS VMG | 204 | CIS SSG ANA FYA DSV KG | 210 | GH AC AG YY PI PY DD Y |
| hIL27Ra- VHH19- DR596 | 544 | QVQLQESGGGSVQAGGSL RLSCRASGSTYSNYCLGW FRQITGKEREGVAVINWV GGMLYFADSVKGRFTVSQ DQAKNTVYLQMNSLKPED TAMYYCAAESVSSFSCGG WLTRPDRVPYWGQGTQVT VSSGGGSQVQLQESGGGL VQPGGSLRLSCTASGLTF DDSVMGWFRQAPGKGREA VSCISSSGANAFYADSVK GRFTISRDNAKNTLYLQM NSLKPEDTATYYCKRGHA CAGYYPIPYDDYWGQGTQ VTVSS | 942 | F T F S H S G M S | 946 | TI NS GG AS TY YT DS VK G | 231 | GG SG YG DA SR MT SP | 198 | LTF DDS VMG | 204 | CIS SSG ANA FYA DSV KG | 210 | GH AC AG YY PI PY DD Y |
| hIL27Ra- VHH20- DR596 | 545 | QVQLQESGGGLVQPGGSL RLSCAASGFTFSSYPMSW VRQAPGKGLEWVSTISSG GDTTLYADSVKGRFTSSR DNAKNTLYLQLNSLKTED TAMYYCAKRIDCNSGYCY KRSYWGQGTQVTVSSGGG SQVQLQESGGGLVQPGGS LRLSCTASGLTFDDSVMG WFRQAPGKGREAVSCISS SGANAFYADSVKGRFTIS RDNAKNTLYLQMNSLKPE DTATYYCKRGHACAGYYP IPYDDYWGQGTQVTVSS | 942 | F T F S H S G M S | 946 | TI NS GG AS TY YT DS VK G | 231 | GG SG YG DA SR MT SP | 198 | LTF DDS VMG | 204 | CIS SSG ANA FYA DSV KG | 210 | GH AC AG YY PI PY DD Y |
| hIL27Ra- VHH21- DR596 | 546 | QVQLQESGGGLVQPGGSL RLSCAASGFTFSLSSMSW VRQAPGKGLEWVSAISSG GASTYYTDSVKGRFTISR DNAKNMLYLQLNSLKTED TAMYYCAKGGSGYGDASR MTSPGSQGTQVTVSSGGG SQVQLQESGGGLVQPGGS LRLSCTASGLTFDDSVMG WFRQAPGKGREAVSCISS SGANAFYADSVKGRFTIS | 942 | F T F S H S G M S | 946 | TI NS G AS TY YT DS VK G | 231 | GG SG YG DA SR MT SP | 198 | LTF DDS VMG | 204 | CIS SSG ANA FYA DSV KG | 210 | GH AC AG YY PI PY DD Y |

TABLE 1A-continued

| Name | SEQ ID NO: | Sequence of dual VHH dimer | SEQ ID NO: | CDR1 | SEQ ID NO: | CDR2 | SEQ ID NO: | CDR3 | SEQ ID NO: | CDR4 | SEQ ID NO: | CDR5 | SEQ ID NO: | CDR6 |
|---|---|---|---|---|---|---|---|---|---|---|---|---|---|---|
| | | RDNAKNTLYLQMNSLKPE DTATYYCKRGHACAGYYP IPYDDYWGQGTQVTVSS | | | | | | | | | | | | |
| hIL27Ra-VHH22-DR596 | 547 | QVQLQESGGGSVQAGGSL RLSCRASGSTYSNYCLGW FRQTTGKEREGVAVINWV GGMLYFADSVKGRFTVSQ DQAKNTVYLQMNSLKPED TAMYYCAAESVSSFSCGG WLTRPDRVPYWGQGTQVT VSSGGGSQVQLQESGGGL VQPGGSLRLSCTASGLTF DDSVMGWFRQAPGKGREA VSCISSSGANAFYADSVK GRFTISRDNAKNTLYLQM NSLKPEDTATYYCKRGHA CAGYYPIPYDDYWGQGTQ VTVSS | 942 | FTFSHSGMS | 946 | TINSGGASTYYTDSVKG | 231 | GGSGYGDASRMTSP | 198 | LTFDDSVMG | 204 | CISSSGANAFYADSVKG | 210 | GHACAGYYPIPYDDY |
| hIL27Ra-VHH23-DR596 | 548 | QVQLQESGGGSVQAGGSL RLSCRASRSPYGNYCLGW FRQSTGKEREGVAVINWV GGMLYFADSVKGRFTVSQ DHAKNTVTLQMNSLKPED TAMYYCAAESVSSFSCGG WLTRPDRVPYWGQGTQVT VSSGGGSQVQLQESGGGL VQPGGSLRLSCTASGLTF DDSVMGWFRQAPGKGREA VSCISSSGANAFYADSVK GRFTISRDNAKNTLYLQM NSLKPEDTATYYCKRGHA CAGYYPIPYDDYWGQGTQ VTVSS | 942 | FTFSHSGMS | 946 | TINSGGASTYYTDSVKG | 231 | GGSGYGDASRMTSP | 198 | LTFDDSVMG | 204 | CISSSGANAFYADSVKG | 210 | GHACAGYYPIPYDDY |
| hIL27Ra-VHH24-DR596 | 549 | QVQLQESGGGLVQPGGSL RLSCAASGFTFSHSGMSW VRQAPGKGLEWVSTINSG GASTYYTDSVKGRFTISR DNAKNMLYLQLNSLKTED TAMYYCAKGGSGYGDASR MTSPGSQGTQVTVSSGGG SQVQLQESGGGLVQPGGS LRLSCTASGLTFDDSVMG WFRQAPGKGREAVSCISS SGANAFYADSVKGRFTIS RDNAKNTLYLQMNSLKPE DTATYYCKRGHACAGYYP IPYDDYWGQGTQVTVSS | 942 | FTFSHSGMS | 946 | TINSGGASTYYTDSVKG | 231 | GGSGYGDASRMTSP | 198 | LTFDDSVMG | 204 | CISSSGANAFYADSVKG | 210 | GHACAGYYPIPYDDY |
| DR591-hIL27Ra-VHH1 | 1 | QVQLQESGGGSVQAGGSL RLSCTASGAIASGYIDSR WCMAWFRQAPGKEREGVA AIWPGGGLTVYADSVKGR FTISRDHAKNTLYLQMNN LKPEDTAMYYCAAGSPRM CPSLEFGFDYWGQGTQVT VSSGGGSQVQLQESGGGL VQPGGSLRLSCAASGFTF SSYPMSWVRQAPGKGLEW ISTISAGGDTTLYADSVK GRFTSSRDNAKNTLYLQL NSLKTEDAAIYYCAKRID CNSGYCYRRNYWGQGTQV TVSS | 943 | AIASGYIDSRWCMA | 199 | AIWPGGGLTVYADSVKG | 205 | GSPRMCPSLEFGFDY | 211 | FTFSSYPMS | 218 | TISAGGDTTLYADSVKG | 947 | RIDCNSGYCYRRNY |
| DR591-hIL27Ra-VHH2 | 550 | QVQLQESGGGSVQAGGSL RLSCTASGAIASGYIDSR WCMAWFRQAPGKEREGVA AIWPGGGLTVYADSVKGR FTISRDHAKNTLYLQMNN LKPEDTAMYYCAAGSPRM CPSLEFGFDYWGQGTQVT VSSGGGSQVQLQESGGGL VQPGGSLRLSCAASGFTF | 943 | AIASGYIDSRWCMA | 199 | AIWPGGGLTVYADSVKG | 205 | GSPRMCPSLEFGFDY | 940 | FTFSLSGMS | 224 | AISSGGASTYYTDSVKG | 231 | GGSGYGDASRMTSP |

TABLE 1A-continued

| Name | SEQ ID NO: | Sequence of dual VHH dimer | SEQ ID NO: | CDR1 | SEQ ID NO: | CDR2 | SEQ ID NO: | CDR3 | SEQ ID NO: | CDR4 | SEQ ID NO: | CDR5 | SEQ ID NO: | CDR6 |
|---|---|---|---|---|---|---|---|---|---|---|---|---|---|---|
| | | SLSGMSWVRQAPGKLEW VSAISSGGASTYYTDSVK GRFTISRDNAKNILYLQL NSLKTEDTAMYYCAKGGS GYGDASRMTSPGSQGTQV TVSS | | R W C M A | | | | | | | | | | |
| DR591-hIL27Ra-VHH3 | 551 | QVQLQESGGGSVQAGGSL RLSCTASGAIASGYIDSR WCMAWFRQAPGKEREGVA AIWPGGGLTVYADSVKGR FTISRDHAKNTLYLQMNN LKPEDTAMYYCAAGSPRM CPSLEFGFDYWGQGTQVT VSSGGGSQVQLQESGGGS VQAGGSLRLSCVASGYVS CDYFLPSWYRQAPGKERE FVSIIDGTSTSYAASVK GRFTASEDKGKNIAYLQM NSLKPEDTAMYCKASCV RGRAVSEYWGQGTQVTVS S | 943 | A I A S G Y I D S R W C M A | 199 | AI WP GG GL TV YA DS VK G | 205 | GS PR MC PS LE FG FD Y | 215 | YVS CDY FLP S | 222 | IID GTG STS YAA SVK G | 948 | SC VR GR AV SE Y |
| DR591-hIL27Ra-VHH4 | 2 | QVQLQESGGGSVQAGGSL RLSCTASGAIASGYIDSR WCMAWFRQAPGKEREGVA AIWPGGGLTVYADSVKGR FTISRDHAKNTLYLQMNN LKPEDTAMYYCAAGSPRM CPSLEFGFDYWGQGTQVT VSSGGGSQVQLQESGGGL VQPGESLRLSCTASGFTF SNYAMSWVRQAPGKGLEW VSGINVAYGITSYADSVK GRFTISRDNTKNTLYLQL NSLKTEDTAIYYCVKHSG TTIPRGFISYTKRGQGTQ VTVSS | 943 | A I A S G Y I D S R W C M A | 199 | AI WP GG GL TV YA DS VK G | 205 | GS PR MC PS LE FG FD Y | 212 | FTF SNY AMS | 219 | GIN VAY GIT SYA DSV KG | 226 | HS GT TI PR GF IS YT K |
| DR591-hIL27Ra-VHH5 | 552 | QVQLQESGGGSVQAGGSL RLSCTASGAIASGYIDSR WCMAWFRQAPGKEREGVA AIWPGGGLTVYADSVKGR FTISRDHAKNTLYLQMNN LKPEDTAMYYCAAGSPRM CPSLEFGFDYWGQGTQVT VSSGGGSQVQLQESGGGS VQAGGSLRLSCTASGYVS CDYFLPSWYRQAPGKERE FVSVIDGTSTSYAASVK GRFTASQDKGKNIAYLQM NSLKPEDTAMYCKASCV RGRAISEYWGQGTQVTVS S | 943 | A I A S G Y I D S R W C M A | 199 | AI WP GG GL TV YA DS VK G | 205 | GS PR MC PS LE FG FD Y | 215 | YVS CDY FLP S | 944 | VID GTG STS YAA SVK G | 229 | SC VR GR AI SE Y |
| DR591-hIL27Ra-VHH6 | 3 | QVQLQESGGGSVQAGGSL RLSCTASGAIASGYIDSR WCMAWFRQAPGKEREGVA AIWPGGGLTVYADSVKGR FTISRDHAKNTLYLQMNN LKPEDTAMYYCAAGSPRM CPSLEFGFDYWGQGTQVT VSSGGGSQVQLQESGGGL VQPGGSLRLSCAASGFSF SSYAMKWVRQAPGKGLEW VSTISSGGSSTNYADSVK GRFTISRDNAKNTLYLQL NSLKIEDTAMYYCAKAIV PTGATMERGQGTQVTVSS | 943 | A I A S G Y I D S R W C M A | 199 | AI WP GG GL TV YA DS VK G | 205 | GS PR MC PS LE FG FD Y | 213 | FSF SSY AMK | 220 | TIS SGG SST NYA DSV KG | 227 | AI VP TG AT ME |
| DR591-hIL27Ra-VHH7 | 553 | QVQLQESGGGSVQAGGSL RLSCTASGAIASGYIDSR WCMAWFRQAPGKEREGVA AIWPGGGLTVYADSVKGR FTISRDHAKNTLYLQMNN LKPEDTAMYYCAAGSPRM | 943 94 3 | A I A S G Y | 199 | AI WP GG GL TV YA | 205 | GS PR MC PS LE FG | 211 | FTF SSY PMS | 218 | TIS AGG DTT LYA DSV KG | 947 | RI DC NS GY CY RR |

TABLE 1A-continued

| Name | SEQ ID NO: | Sequence of dual VHH dimer | SEQ ID NO: | CDR1 | SEQ ID NO: | CDR2 | SEQ ID NO: | CDR3 | SEQ ID NO: | CDR4 | SEQ ID NO: | CDR5 | SEQ ID NO: | CDR6 |
|---|---|---|---|---|---|---|---|---|---|---|---|---|---|---|
| | | CPSLEFGFDYWGQGTQVT VSSGGGSQVQLQESGGGL VQPGGSLRLSCAASGFTF SSYPMSWVRQAPGKGLEW ISTISAGGDTTLYADSVK GRFTSSRDNAKNTLYLQL NSLKTEDTAIYYCAKRID CNSGYCYRRNYWGQGTQV TVSS | | AI A S G Y I D S R W C M A | | DS VK G | | FD Y | | | | | | NY |
| DR591-hIL27Ra-VHH8 | 554 | QVQLQESGGGSVQAGGSL RLSCTASGAIASGYIDSR WCMAWFRQAPGKEREGVA AIWPGGGLTVYADSVKGR FTISRDHAKNTLYLQMNN LKPEDTAMYYCAAGSPRM CPSLEFGFDYWGQGTQVT VSSGGGSQVQLQESGGGS VQVGGSLRLSCAASGFTF SSYPMSWVRQAPGKGLEW ISTISAGGDTTLYADSVK GRFTSSRDNAKNTLYLQL NSLKTEDTAIYYCAKRID CNSGYCYRRNYWGQGTQV TVSS | 943 | A I A S G Y I D S R W C M A | 199 | AI WP GG GL TV YA DS VK G | 205 | GS PR MC PS LE FG FD Y | 211 | FTF SSY PMS | 218 | TIS AGG DTT LYA DSV KG | 947 | RI DC NS GY CY RR NY |
| DR591-hIL27Ra-VHH9 | 4 | QVQLQESGGGSVQAGGSL RLSCTASGAIASGYIDSR WCMAWFRQAPGKEREGVA AIWPGGGLTVYADSVKGR FTISRDHAKNTLYLQMNN LKPEDTAMYYCAAGSPRM CPSLEFGFDYWGQGTQVT VSSGGGSQVQLQESGGGS VQSGGSLRLSCAASGFTY STSNSWMAWFRQAPGKER EGVAAIYTVGGSIFYADS VRGRFTISQDATKNMFYL QMNTLKPEDTAMYYCAAA SGRLRGKWFWPYEYNYWG QGTQVTVSS | 943 | A I A S G Y I D S R W C M A | 199 | AI WP GG GL TV YA DS VK G | 205 | GS PR MC PS LE FG FD Y | 214 | FTY STS NSW MA | 221 | AIY TVG GSI FYA DSV RG | 228 | AS GR LR GK WE WP YE YN Y |
| DR591-hIL27Ra-VHH10 | 555 | QVQLQESGGGSVQAGGSL RLSCTASGAIASGYIDSR WCMAWFRQAPGKEREGVA AIWPGGGLTVYADSVKGR FTISRDHAKNTLYLQMNN LKPEDTAMYYCAAGSPRM CPSLEFGFDYWGQGTQVT VSSGGGSQVQLQESGGGS VQAGGSLRLSCRASGSTY SNYCLGWFRQITGKEREG VAVINWVGGMLYFADSVK GRFTVSQDQAKNTLYLQM NSLKPEDTAMYYCAAESV SSFSCGGWLTRPDRVPYW GQGTQVTVSS | 943 | A I A S G Y I D S R W C M A | 199 | AI WP GG GL TV YA DS VK G | 205 | GS PR MC PS LE FG FD Y | 216 | STY SNY CLG | 223 | VIN WVG GML YFA DSV KG | 230 | ES VS SF SC GG WL TR PD RV PY |
| DR591-hIL27Ra-VHH11 | 556 | QVQLQESGGGSVQAGGSL RLSCTASGAIASGYIDSR WCMAWFRQAPGKEREGVA AIWPGGGLTVYADSVKGR FTISRDHAKNTLYLQMNN LKPEDTAMYYCAAGSPRM CPSLEFGFDYWGQGTQVT VSSGGGSQVQLQESGGGS VQAGGSLRLSCRASGSTY SNYCLGWFRQITGKEREG VAVINWVGGMLYFADSVK GRFTVSQDHAKNTVTLQM NSLKPEDTAMYYCAAESV SSFSCGGWLTRPGRVPYW GQGTQVTVSS | 943 | A I A S G Y I D S R W C M A | 199 | AI WP GG GL TV YA DS VK G | 205 | GS PR MC PS LE FG FD Y | 216 | STY SNY CLG | 223 | VIN WVG GML YFA DSV KG | 949 | ES VS SF SC GG WL TR PG RV PY |

TABLE 1A-continued

| Name | SEQ ID NO: | Sequence of dual VHH dimer | SEQ ID NO: | CDR1 | SEQ ID NO: | CDR2 | SEQ ID NO: | CDR3 | SEQ ID NO: | CDR4 | SEQ ID NO: | CDR5 | SEQ ID NO: | CDR6 |
|---|---|---|---|---|---|---|---|---|---|---|---|---|---|---|
| DR591-hIL27Ra-VHH12 | 557 | QVQLQESGGGSVQAGGSLRLSCTASGAIASGYIDSRWCMAWFRQAPGKEREGVAAIWPGGGLTVYADSVKGRFTISRDHAKNTLYLQMNNLKPEDTAMYYCAAGSPRMCPSLEFGFDYWGQGTQVTVSSGGGSQVQLQESGGGSVQAGESLRLSCRASGSTYSNYCLGWFRQITGKEREGVAVINWVGGMLYFADSVKGRFTVSQDQAKNTVYLEMNSLKPEDTAMYYCATESVSSFSCGGWLTRPDRVPYWGQGTQVTVSS | 943 | AIASGYIDSRWCMA | 199 | AIWPGGGLTVYADSVKG | 205 | GSPRMCPSLEFGFDY | 216 | STYSNYCLG | 223 | VINWVGGMLYFADSVKG | 230 | ESVSSFSCGGWLTRPDRVPY |
| DR591-hIL27Ra-VHH13 | 558 | QVQLQESGGGSVQAGGSLRLSCTASGAIASGYIDSRWCMAWFRQAPGKEREGVAAIWPGGGLTVYADSVKGRFTISRDHAKNTLYLQMNNLKPEDTAMYYCAAGSPRMCPSLEFGFDYWGQGTQVTVSSGGGSQVQLQESGGGSVQAGGSLRLSCVASGYVSCDYFLPSWYRQAPGKEREFVSIIDGTGSTSYAASVKGRFTASQDRGKNIAYLQMNSLKPEDTAMYYCKASCVRGRTISEYWGQGTQVTVSS | 943 | AIASGYIDSRWCMA | 199 | AIWPGGGLTVYADSVKG | 205 | GSPRMCPSLEFGFDY | 215 | YVSCDYFLPS | 222 | IIDGTGSTSYAASVKG | 950 | SCVRGRTISEY |
| DR591-hIL27Ra-VHH14 | 559 | QVQLQESGGGSVQAGGSLRLSCTASGAIASGYIDSRWCMAWFRQAPGKEREGVAAIWPGGGLTVYADSVKGRFTISRDHAKNTLYLQMNNLKPEDTAMYYCAAGSPRMCPSLEFGFDYWGQGTQVTVSSGGGSQVQLQESGGGSVQAGGSLRLSCVASGYVSCDYFLPSWYRQAPGKEREFVSIIDGTGSTSYAASVKGRFTASQDKGKNIAYLQMNSLKPEDTAMYYCKASCVRGRAISEYWGQGTQVTVSS | 943 | AIASGYIDSRWCMA | 199 | AIWPGGGLTVYADSVKG | 205 | GSPRMCPSLEFGFDY | 215 | YVSCDYFLPS | 222 | IIDGTGSTSYAASVKG | 229 | SCVRGIAISEY |
| DR591-hIL27Ra-VHH15 | 5 | QVQLQESGGGSVQAGGSLRLSCTASGAIASGYIDSRWCMAWFRQAPGKEREGVAAIWPGGGLTVYADSVKGRFTISRDHAKNTLYLQMNNLKPEDTAMYYCAAGSPRMCPSLEFGFDYWGQGTQVTVSSGGGSQVQLQESGGGSVQAGGSLRLSCVASGYVSCDYFLPSWYRQAPGKEREFVSIIDGTGSTSYAASVKGRFTASQDKGKNIAYLQMNTLKPEDTAMYYCKASCVRGRAISEYWGQGTQVTVSS | 943 | AIASGYIDSRWCMA | 199 | AIWPGGGLTVYADSVKG | 205 | GSPRMCPSLEFGFDY | 215 | YVSCDYFLPS | 222 | IIDGTGSTSYAASVKG | 229 | SCVRGIAISEY |
| DR591-hIL27Ra-VHH16 | 560 | QVQLQESGGGSVQAGGSLRLSCTASGAIASGYIDSRWCMAWFRQAPGKEREGVAAIWPGGGLTVYADSVKGRFTISRDHAKNTLYLQMNNLKPEDTAMYYCAAGSPRMCPSLEFGFDYWGQGTQVTVSSGGGSQVQLQESGGGSVQAGGSLRLSCRASGSTYSNYCLGWFRQITGKEREGVAVINWVGGMLYFADSVKGRFTVSQDQAKNTVYLQMC... | 943 | AIASGYIDSRWCMA | 199 | AIWPGGGLTVYADSVKG | 205 | GSPRMCPSLEFGFDY | 216 | STYSNYCLG | 223 | VINWVGGMLYFADSVKG | 951 | ESASSFSCGGWLTRPDRVPY |

TABLE 1A-continued

| Name | SEQ ID NO: | Sequence of dual VHH dimer | SEQ ID NO: CDR1 | CDR1 | SEQ ID NO: CDR2 | CDR2 | SEQ ID NO: CDR3 | CDR3 | SEQ ID NO: CDR4 | CDR4 | SEQ ID NO: CDR5 | CDR5 | SEQ ID NO: CDR6 | CDR6 |
|---|---|---|---|---|---|---|---|---|---|---|---|---|---|---|
| | | NSLKPEDTAMYYCAAESA SSFSCGGWLTRPDRVPYW GQGTQVTVSS | | MA | | | | | | | | | | |
| DR591-hIL27Ra-VHH17 | 561 | QVQLQESGGGSVQAGGSL RLSCTASGAIASGYIDSR WCMAWFRQAPGKEREGVA AIWPGGGLTVYADSVKGR FTISRDHAKNTLYLQMNN LKPEDTAMYYCAAGSPRM CPSLEFGFDYWGQGTQVT VSSGGGSQVQLQESGGGL VQPGGSLRLSCAASGFTF SLSGMSWVRQAPGKGLEW VSAISSGGASTYYTDSVK GRFTISRDNAKNMLYLQL NSLKTEDTAMYYCAKGGS GYGDASRMTSPGSQGTQV TVSS | 943 | AIASGYIDSRWCMA | 199 | AIWPGGGLTVYA | 205 | GSPRMCPSLEFGFDY | 940 | FTFSLSGMS | 224 | AISSGGASTYYTDSVKG | 231 | GGSGYGDASRMTSP |
| DR591-hIL27Ra-VHH18 | 562 | QVQLQESGGGSVQAGGSL RLSCTASGAIASGYIDSR WCMAWFRQAPGKEREGVA AIWPGGGLTVYADSVKGR FTISRDHAKNTLYLQMNN LKPEDTAMYYCAAGSPRM CPSLEFGFDYWGQGTQVT VSSGGGSQVQLQESGGGS VQAGGSLRLSCVASGYVS CDYFLPSWYRQAPGKERE FVSIIDGTGSTSYAASVK GRFTASQDKGKNIAYLQM NSLKPEDTAMYYCKASCV RGRGISEYWGQGTQVTVS S | 943 | AIASGYIDSRWCMA | 199 | AIWPGGGLTVYA | 205 | GSPRMCPSLEFGFDY | 215 | YVSCDYFLPS | 222 | IIDGTGSTSYAASVKG | 952 | SCVRGRGISEY |
| DR591-hIL27Ra-VHH19 | 6 | QVQLQESGGGSVQAGGSL RLSCTASGAIASGYIDSR WCMAWFRQAPGKEREGVA AIWPGGGLTVYADSVKGR FTISRDHAKNTLYLQMNN LKPEDTAMYYCAAGSPRM CPSLEFGFDYWGQGTQVT VSSGGGSQVQLQESGGGS VQAGGSLRLSCRASGSTY SNYCLGWFRQITGKEREG VAVINWVGGMLYFADSVK GRFTVSQDQAKNTVYLQM NSLKPEDTAMYYCAAESV SSFSCGGWLTRPDRVPYW GQGTQVTVSS | 943 | AIASGYIDSRWCMA | 199 | AIWPGGGLTVYA | 025 | GSPRMCPSLEFGFDY | 216 | STYSNYCLG | 223 | VINWVGGMLYFADSVKG | 230 | ESVSSFSCGGWLTRPDRVPY |
| DR591-hIL27Ra-VHH20 | 563 | QVQLQESGGGSVQAGGSL RLSCTASGAIASGYIDSR WCMAWFRQAPGKEREGVA AIWPGGGLTVYADSVKGR FTISRDHAKNTLYLQMNN LKPEDTAMYYCAAGSPRM CPSLEFGFDYWGQGTQVT VSSGGGSQVQLQESGGGL VQPGGSLRLSCAASGFTF SSYPMSWVRQAPGKGLEW VSTISSGGDTTLYADSVK GRFTSSRDNAKNTLYLQL NSLKTEDTAMYYCAKRID CNSGYCYKRSYWGQGTQV TVSS | 943 | AIASGYIDSRWCMA | 199 | AIWPGGGLTVYA | 205 | GSPRMCPSLEFGFDY | 211 | FTFSSYPMS | 954 | TISSGGDTTLYADSVKG | 953 | RIDCNSGYCYKRSY |
| DR591-hIL27Ra-VHH21 | 7 | QVQLQESGGGSVQAGGSL RLSCTASGAIASGYIDSR WCMAWFRQAPGKEREGVA AIWPGGGLTVYADSVKGR FTISRDHAKNTLYLQMNN LKPEDTAMYYCAAGSPRM CPSLEFGFDYWGQGTQVT VSSGGGSQVQLQESGGGL | 943 | AIASGYIDSRWCMA | 199 | AIWPGGGLTVYA | 205 | GSPRMCPSLEFGFDY | 217 | FTFSLSSMS | 224 | AISSGGASTYYTDSVKG | 231 | GGSGYGDASRMTSP |

TABLE 1A-continued

| Name | SEQ ID NO: | Sequence of dual VHH dimer | SEQ ID NO: | CDR1 | SEQ ID NO: | CDR2 | SEQ ID NO: | CDR3 | SEQ ID NO: | CDR4 | SEQ ID NO: | CDR5 | SEQ ID NO: | CDR6 |
|---|---|---|---|---|---|---|---|---|---|---|---|---|---|---|
| | | VQPGGSLRLSCAASGFTF SLSSMSWVRQAPGKGLEW VSAISSGGASTYYTDSVK GRFTISRDNAKNMLYLQL NSLKTEDTAMYYCAKGGS GYGDASRMTSPGSQGTQV TVSS | | S R W C M A | | G | | | | | | | | |
| DR591-hIL27Ra-VHH22 | 564 | QVQLQESGGGSVQAGGSL RLSCTASGAIASGYIDSR WCMAWFRQAPGKEREGVA AIWPGGGLTVYADSVKGR FTISRDHAKNTLYLQMNN LKPEDTAMYYCAAGSPRM CPSLEFGFDYWGQGTQVT VSSGGGSQVQLQESGGGS VQAGGSLRLSCRASGSTY SNYCLGWFRQTTGKEREG VAVINWVGGMLYFADSVK GRFTVSQDQAKNTVYLQM NSLKPEDTAMYYCAAESV SSFSCGGWLTRPDRVPYW GQGTQVTVSS | 94 | 3A I A S G Y I D S R W C M A | 199 | AI WP GG GL TV YA DS VK G | 205 | GS PR MC PS LE FG FD Y | 216 | STY SNY CLG | 223 | VIN WVG GML YFA DSV KG | 230 | ES VS SF SC GG WL TR PD RV PY |
| DR591-hIL27Ra-VHH23 | 565 | QVQLQESGGGSVQAGGSL RLSCTASGAIASGYIDSR WCMAWFRQAPGKEREGVA AIWPGGGLTVYADSVKGR FTISRDHAKNTLYLQMNN LKPEDTAMYYCAAGSPRM CPSLEFGFDYWGQGTQVT VSSGGGSQVQLQESGGGS VQAGGSLRLSCRASRSPY GNYCLGWFRQSTGKEREG VAVINWVGGMLYFADSVK GRFTVSQDHAKNTVTLQM NSLKPEDTAMYYCAAESV SSFSCGGWLTRPDRVPYW GQGTQVTVSS | 943 | A I A S G Y I D S R W C M A | 199 | AI WP GG GL TV YA DS VK G | 205 | GS PR MC PS LE FG FD Y | 941 | SPY GNY | 223 | VIN WVG GML YFA DSV KG | 230 | ES VS SF SC GG WL TR PD RV PY |
| DR591-hIL27Ra-VHH24 | 566 | QVQLQESGGGSVQAGGSL RLSCTASGAIASGYIDSR WCMAWFRQAPGKEREGVA AIWPGGGLTVYADSVKGR FTISRDHAKNTLYLQMNN LKPEDTAMYYCAAGSPRM CPSLEFGFDYWGQGTQVT VSSGGGSQVQLQESGGGL VQPGGSLRLSCAASGFTF SHSGMSWVRQAPGKGLEW VSTINGGASTYYTDSVK GRFTISRDNAKNMLYLQL NSLKTEDTAMYYCAKGGS GYGDASRMTSPGSQGTQV TVSS | 943 | A I A S G Y I D S R W C M A | 199 | AI WP GG GL TV YA DS VK G | 205 | GS PR MC PS LE FG FD Y | 942 | FTF SHS GMS | 946 | TIN SGG AST YYT DSV KG | 231 | GG SG YG DA SR MT SP |
| DR592-hIL27Ra-VHH1 | 8 | QVQLQESGGGSVQAGGSL RLSCTAPGFTSNSCGMDW YRQAPGKEREFVSSISTD GTTGYADSVKGRFTISKD KAKDTVYLQMNSLKPEDT GMYSCKTKDGTIATMELC DFGYWGQGTQVTVSSGGG SQVQLQESGGGLVQPGGS LRLSCAASGFTFSSYPMS WVRQAPGKGLEWISTISA GGDTTLYADSVKGRFTSS RDNAKNTLYLQLNSLKTE DAAIYYCAKRIDCNSGYC YRRNYWGQGTQVTVSS | 194 | F T S N S C G M D | 200 | SI ST DG TT GY AD SV KG M | 206 | KD GT IA TM EL CD FG Y | 211 | FTF SSY PMS | 218 | TIS AGG DTT LYA DSV KG | 947 | RI DC NS GY CY RR NY |
| DR592-hIL27Ra-VHH2 | 567 | QVQLQESGGGSVQAGGSL RLSCTAPGFTSNSCGMDW YRQAPGKEREFVSSISTD GTTGYADSVKGRFTISKD KAKDTVYLQMNSLKPEDT | 194 | F T S N S | 200 | SI ST DG TT GY | 206 | KD GT IA TM EL | 940 | FTF SLS GMS | 224 | AIS SGG AST YYT DSV | 231 | GG SG YG DA SR |

TABLE 1A-continued

| Name | SEQ ID NO: | Sequence of dual VHH dimer | SEQ ID NO: CDR1 | CDR1 | SEQ ID NO: CDR2 | CDR2 | SEQ ID NO: CDR3 | CDR3 | SEQ ID NO: CDR4 | CDR4 | SEQ ID NO: CDR5 | CDR5 | SEQ ID NO: CDR6 | CDR6 |
|---|---|---|---|---|---|---|---|---|---|---|---|---|---|---|
| | | GMYSCKTKDGTIATMELC DFGYWGQGTQVTVSSGGG SQVQLQESGGGLVQPGGS LRLSCAASGFTFSLSGMS WVRQAPGKGLEWVSAISS GGASTYYTDSVKGRFTIS RDNAKNILYLQLNSLKTE DTAMYYCAKGGSGYGDAS RMTSPGSQGTQVTVSS | | C G M D | | AD SV KG | | CD FG Y | | | | KG | | MT SP |
| DR592-hIL27Ra-VHH3 | 568 | QVQLQESGGGSVQAGGSL RLSCTAPGFTSNSCGMDW YRQAPGKEREFVSSISTD GTTGYADSVKGRFTISKD KAKDTVYLQMNSLKPEDT GMYSCKTKDGTIATMELC DFGYWGQGTQVTVSSGGG SQVQLQESGGGSVQAGGS LRLSCVASGYVSCDYFLP SWYRQAPGKEREFVSIID GTGSTSYAASVKGRFTAS EDKGKNIAYLQMNSLKPE DTAMYYCKASCVRGRAVS EYWGQGTQVTVSS | 194 | F T S N S C G M D | 200 | SI ST DG TT GY AD SV KG | 206 | KD GT IA TM EL CD FG Y | 215 | YVS CDY FLP S | 222 | IID GTG STS YAA SVK G | 948 | SC VR GR AV SE Y |
| DR592-hIL27Ra-VHH4 | 9 | QVQLQESGGGSVQAGGSL RLSCTAPGFTSNSCGMDW YRQAPGKEREFVSSISTD GTTGYADSVKGRFTISKD KAKDTVYLQMNSLKPEDT GMYSCKTKDGTIATMELC DFGYWGQGTQVTVSSGGG SQVQLQESGGGLVQPGES LRLSCTASGFTFSNYAMS WVRQAPGKGLEWVSGINV AYGITSYADSVKGRFTIS RDNTKNTLYLQLNSLKTE DTAIYYCVKHSGTTIPRG FISYTKRGQGTQVTVSS | 194 | F T S N S C G M D | 200 | SI ST DG TT GY AD SV KG | 206 | KD GT IA TM EL CD FG Y | 212 | FTF SNY AMS | 219 | GIN VAY GIT SYA DSV KG | 226 | HS GT TI PR GF IS YT K |
| DR592-hIL27Ra-VHH5 | 569 | QVQLQESGGGSVQAGGSL RLSCTAPGFTSNSCGMDW YRQAPGKEREFVSSISTD GTTGYADSVKGRFTISKD KAKDTVYLQMNSLKPEDT GMYSCKTKDGTIATMELC DFGYWGQGTQVTVSSGGG SQVQLQESGGGSVQAGGS LRLSCTASGYVSCDYFLP SWYRQAPGKEREFVSIID GTGSTSYAASVKGRFTAS QDKGKNIAYLQMNSLKPE DTAMYYCKASCVRGRAIS EYWGQGTQVTVSS | 194 | F T S N S C G M D | 200 | SI ST DG TT GY AD SV KG | 206 | KD GT IA TM EL CD FG Y | 21 | 5YVS CDY FLP S | 944 | VID GTG STS YAA SVK G | 229 | SC VR GR AI SE Y |
| DR592-hIL27Ra-VHH6 | 10 | QVQLQESGGGSVQAGGSL RLSCTAPGFTSNSCGMDW YRQAPGKEREFVSSISTD GTTGYADSVKGRFTISKD KAKDTVYLQMNSLKPEDT GMYSCKTKDGTIATMELC DFGYWGQGTQVTVSSGGG SQVQLQESGGGLVQPGGS LRLSCAASGFSFSSYAMK WVRQAPGKGLEWVSTISS GGSSTNYADSVKGRFTIS RDNAKNTLYLQLNSLKIE DTAMYYCAKAIVPTGATM ERGQGTQVTVSS | 194 | F T S N S C G M D | 200 | SI ST DG TT GY AD SV KG | 206 | KD GT IA TM EL CD FG Y | 213 | FSF SSY AMK | 220 | TIS SGG SST NYA DSV KG | 227 | AI VP TG AT ME |
| DR592-hIL27Ra-VHH7 | 570 | QVQLQESGGGSVQAGGSL RLSCTAPGFTSNSCGMDW YRQAPGKEREFVSSISTD GTTGYADSVKGRFTISKD KAKDTVYLQMNSLKPEDT GMYSCKTKDGTIATMELC | 194 | F T S N S C | 200 | SI ST DG TT GY AD | 206 | KD GT IA TM EL CD | 211 | FTF SSY PMS | 218 | TIS AGG DTT LYA DSV KG | 947 | RI DC NS GY CY RR |

TABLE 1A-continued

| Name | SEQ ID NO: | Sequence of dual VHH dimer | SEQ ID NO: CDR1 | SEQ ID NO: CDR2 | SEQ ID NO: CDR3 | SEQ ID NO: CDR4 | SEQ ID NO: CDR5 | SEQ ID NO: CDR6 |
|---|---|---|---|---|---|---|---|---|
| | | DFGYWGQGTQVTVSSGGG SQVQLQESGGGLVQPGGS LRLSCAASGFTFSSYPMS WVRQAPGKGLEWISTISA GGDTTLYADSVKGRFTSS RDNAKNTLYLQLNSLKTE DTAIYYCAKRIDCNSGYC YRRNWGQGTQVTVSS | G M D | | FG Y | | | NY |
| DR592-hIL27Ra-VHH8 | 571 | QVQLQESGGGSVQAGGSL RLSCTAPGFTSNSCGMDW YRQAPGKEREFVSSISTD GTTGYADSVKGRFTISKD KAKDTVYLQMNSLKPEDT GMYSCKTKDGTIATMELC DFGYWGQGTQVTVSSGGG SQVQLQESGGGSVQVGGS LRLSCAASGFTFSSYPMS WVRQAPGKGLEWISTISA GGDTTLYADSVKGRFTSS RDNAKNTLYLQLNSLKTE DTAIYYCAKRIDCNSGYC YRRNWGQGTQVTVSS | 194 F T S N S C G M D | 200 SI ST DG TT GY AD SV KG | 206 KD GT IA TM EL CD FG Y | 211 FTF SSY PMS | 218 TIS AGG DTT LYA DSV KG | 947 RI DC NS GY CY RR NY |
| DR592-hIL27Ra-VHH9 | 11 | QVQLQESGGGSVQAGGSL RLSCTAPGFTSNSCGMDW YRQAPGKEREFVSSISTD GTTGYADSVKGRFTISKD KAKDTVYLQMNSLKPEDT GMYSCKTKDGTIATMELC DFGYWGQGTQVTVSSGGG SQVQLQESGGGSVQSGGS LRLSCAASGFTYSTSNSW MAWFRQAPGKEREGVAAI YTVGGSIFYADSVRGRFT ISQDATKNMFYLQMNTLK PEDTAMYYCAAASGRLRG KWFWPYEYNYWGQGTQVT VSS | 194 F T S N S C G M D | 200 SI ST DG TT GY AD SV KG | 206 KD GT IA TM EL CD FG Y | 214 FTY STS NSW MA | 221 AIY TVG GSI FYA DSV RG | 228 AS GR LR GK WI WE YE Y |
| DR592-hIL27Ra-VHH10 | 572 | QVQLQESGGGSVQAGGSL RLSCTAPGFTSNSCGMDW YRQAPGKEREFVSSISTD GTTGYADSVKGRFTISKD KAKDTVYLQMNSLKPEDT GMYSCKTKDGTIATMELC DFGYWGQGTQVTVSSGGG SQVQLQESGGGSVQAGGS LRLSCRASGSTYSNYCLG WERQITGKEREGVAVINW VGGMLYFADSVKGRFTVS QDQAKNTLYLQMNSLKPE DTAMYYCAAESVSSFSCG GWLTRPDRVPYWGQGTQV TVSS | 194 F T S N S C G M D | 200 SI ST DG TT GY AD SV KG | 206 KD GT IA TM EL CD FG Y | 216 STY SNY CLG | 223 VIN WVG GML YFA DSV KG | 230 ES VS SF SC GG WL TR PD RV PY |
| DR592-hIL27Ra-VHH11 | 573 | QVQLQESGGGSVQAGGSL RLSCTAPGFTSNSCGMDW YRQAPGKEREFVSSISTD GTTGYADSVKGRFTISKD KAKDTVYLQMNSLKPEDT GMYSCKTKDGTIATMELC DFGYWGQGTQVTVSSGGG SQVQLQESGGGSVQAGGS LRLSCRASGSTYSNYCLG WFRQSTGKEREGVAVINW VGGMLYFADSVKGRFTVS QDHAKNTVTLQMNSLKPE DTAMYYCAAESVSSFSCG GWLTRPGRVPYWGQGTQV TVSS | 194 F T S N S C G M D | 200 SI ST DG TT GY AD SV KG | 206 KD GT IA TM EL CD FG Y | 216 STY SNY CLG | 223 VIN WVG GML YFA DSV KG | 949 ES VS SF SC GG WL TR PG RV PY |
| DR592-hIL27Ra-VHH12 | 574 | QVQLQESGGGSVQAGGSL RLSCTAPGFTSNSCGMDW YRQAPGKEREFVSSISTD GTTGYADSVKGRFTISKD | 194 F T S N | 200 SI ST DG TT | 206 KD GT IA TM | 216 STY SNY CLG | 223 VIN WVG GML YFA | 230 ES VS SE SC |

TABLE 1A-continued

| Name | SEQ ID NO: | Sequence of dual VHH dimer | SEQ ID NO: | CDR1 | SEQ ID NO: | CDR2 | SEQ ID NO: | CDR3 | SEQ ID NO: | CDR4 | SEQ ID NO: | CDR5 | SEQ ID NO: | CDR6 |
|---|---|---|---|---|---|---|---|---|---|---|---|---|---|---|
| | | KAKDTVYLQMNSLKPEDT GMYSCKTKDGTIATMELC DFGYWGQGTQVTVSSGGG SQVQLQESGGGSVQAGES LRLSCRASGSTYSNYCLG WFRQITGKEREGVAVINW VGGMLYFADSVKGRFTVS QDQAKNTVYLEMNSLKPE DTAMYYCATESVSSFSCG GWLTRPDRVPYWGQGTQV TVSS | | S C G M D | | GY AD SV KG | | EL CD FG Y | | | | DSV KG | | GG WL TR PD RV PY |
| DR592-hIL27Ra-VHH13 | 575 | QVQLQESGGGSVQAGGSL RLSCTAPGFTSNSCGMDW YRQAPGKEREFVSSISTD GTTGYADSVKGRFTISKD KAKDTVYLQMNSLKPEDT GMYSCKTKDGTIATMELC DFGYWGQGTQVTVSSGGG SQVQLQESGGGSVQAGGS LRLSCVASGYVSCDYFLP SWYRQAPGKEREFVSIID GTGSTSYAASVKGRFTAS QDRGKNIAYLQMNSLKPE DTAMYYCKASCVRGRTIS EYWGQGTQVTVSS | 194 | F T S N S C G M D | 200 | SI ST DG TT GY AD SV KG | 206 | KD GT IA TM EL CD FG Y | 215 | YVS CDY FLP S | 222 | IID GTG STS YAA SVK G | 950 | SC VR GR TI SE Y |
| DR592-hIL27Ra-VHH14 | 576 | QVQLQESGGGSVQAGGSL RLSCTAPGFTSNSCGMDW YRQAPGKEREFVSSISTD GTTGYADSVKGRFTISKD KAKDTVYLQMNSLKPEDT GMYSCKTKDGTIATMELC DFGYWGQGTQVTVSSGGG SQVQLQESGGGSVQAGGS LRLSCVASGYVSCDYFLP SWYRQAPGKEREFVSIID GTGSTSYAASVKGRFTAS QDKGKNIAYLQMNSLKPE DTAMYYCKASCVRGRAIS EYWGQGTQVTVSS | 194 | F T S N S C G M D | 200 | SI ST DG TT GY AD SV KG | 206 | KD GT IA TM EL CD FG Y | 215 | YVS CDY FLP S | 222 | IID GTG STS YAA SVK G | 229 | SC VR GR AI SE Y |
| DR592-hIL27Ra-VHH15 | 12 | QVQLQESGGGSVQAGGSL RLSCTAPGFTSNSCGMDW YRQAPGKEREFVSSISTD GTTGYADSVKGRFTISKD KAKDTVYLQMNSLKPEDT GMYSCKTKDGTIATMELC DFGYWGQGTQVTVSSGGG SQVQLQESGGGSVQAGGS LRLSCVASGYVSCDYFLP SWYRQAPGKEREFVSIID GTGSTSYAASVKGRFTAS QDKGKNIAYLQMNTLKPE DTAMYYCKASCVRGRAIS EYWGQGTQVTVSS | 194 | F T S N S C G M D | 200 | SI ST DG TT GY AD SV KG | 206 | KD GT IA TM EL CD FG Y | 215 | YVS CDY FLP S | 222 | IID GTG STS YAA SVK G | 229 | SC VR GR AI SE Y |
| DR592-hIL27Ra-VHH16 | 577 | QVQLQESGGGSVQAGGSL RLSCTAPGFTSNSCGMDW YRQAPGKEREFVSSISTD GTTGYADSVKGRFTISKD KAKDTVYLQMNSLKPEDT GMYSCKTKDGTIATMELC DFGYWGQGTQVTVSSGGG SQVQLQESGGGSVQAGGS LRLSCRASGSTYSNYCLG WFRQITGKEREGVAVINW VGGMLYFADSVKGRFTVS QDQAKNTVYLQMNSLKPE DTAMYYCAAESASSFSCG GWLTRPDRVPYWGQGTQV TVSS | 194 | F T S N S C G M D | 200 | SI ST DG TT GY AD SV KG | 206 | KD GT IA TM EL CD FG | 216 | STY SNY CLG | 223 | VIN WVG GML YFA DSV KG | 951 | ES AS SF SC GG WL TR PD RV PY |

TABLE 1A-continued

| Name | SEQ ID NO: | Sequence of dual VHH dimer | SEQ ID NO: | CDR1 | SEQ ID NO: | CDR2 | SEQ ID NO: | CDR3 | SEQ ID NO: | CDR4 | SEQ ID NO: | CDR5 | SEQ ID NO: | CDR6 |
|---|---|---|---|---|---|---|---|---|---|---|---|---|---|---|
| DR592-hIL27Ra-VHH17 | 578 | QVQLQESGGGSVQAGGSLRLSCTAPGFTSNSCGMDWYRQAPGKEREFVSSISTDGTTGYADSVKGRFTISKDKAKDTVYLQMNSLKPEDTGMYSCKTKDGTIATMELCDFGYWGQGTQVTVSSGGGSQVQLQESGGGLVQPGGSLRLSCAASGFTFSLSGMSWVRQAPGKGLEWVSAISSGGASTYYTDSVKGRFTISRDNAKNMLYLQLNSLKTEDTAMYYCAKGGSGYGDASRMTSPGSQGTQVTVSS | 194 | FTSNSCGMD | 200 | SISTDGTTGYADSV KG | 206 | KDGTIATMELCDFGY | 940 | FTFSLSGMS | 224 | AISSGGASTYYTDSVKG | 231 | GGSGYGDASRMTSP |
| DR592-hIL27Ra-VHH18 | 579 | QVQLQESGGGSVQAGGSLRLSCTAPGFTSNSCGMDWYRQAPGKEREFVSSISTDGTTGYADSVKGRFTISKDKAKDTVYLQMNSLKPEDTGMYSCKTKDGTIATMELCDFGYWGQGTQVTVSSGGGSQVQLQESGGGSVQAGGSLRLSCVASGYVSCDYFLPSWYRQAPGKEREFVSIIDGTGSTSYAASVKGRFTASQDKGKNIAYLQMNSLKPEDTAMYYCKASCVRGRGISEYWGQGTQVTVSS | 194 | FTSNSCGMD | 200 | SISTDGTTGYADSV KG | 206 | KDGTIATMELCDFGY | 215 | YVSCDYFLPS | 222 | IIDGTGSTSYAASVKG | 952 | SCVRGRGISEY |
| DR592-hIL27Ra-VHH19 | 13 | QVQLQESGGGSVQAGGSLRLSCTAPGFTSNSCGMDWYRQAPGKEREFVSSISTDGTTGYADSVKGRFTISKDKAKDTVYLQMNSLKPEDTGMYSCKTKDGTIATMELCDFGYWGQGTQVTVSSGGGSQVQLQESGGGSVQAGGSLRLSCRASGSTYSNYCLGWERQITGKEREGVAVINWVGGMLYFADSVKGRFTVSQDQAKNTVYLQMNSLKPEDTAMYYCAAESVSSFSCGGWLTRPDRVPYWGQGTQVTVSS | 194 | ETSNSCGMD | 200 | SISTDGTTGYADSV KG | 206 | KDGTIATMELCDFGY | 216 | STYSNYCLG | 223 | VINWVGGMLYFADSVKG | 230 | ESVSSFSCGGW1TRPDRVPY |
| DR592-hIL27Ra-VHH20 | 580 | QVQLQESGGGSVQAGGSLRLSCTAPGFTSNSCGMDWYRQAPGKEREFVSSISTDGTTGYADSVKGRFTISKDKAKDTVYLQMNSLKPEDTGMYSCKTKDGTIATMELCDFGYWGQGTQVTVSSGGGSQVQLQESGGGLVQPGGSLRLSCAASGFTFSSYPMSWVRQAPGKGLEWVSTISSGGDTTLYADSVKGRFTSSRDNAKNTLYLQLNSLKTEDTAMYYCAKRIDCNSGYCYKRSYWGQGTQVTVSS | 194 | FTSNSCGMD | 200 | SISTDGTTGYADSV KG | 206 | KDGTIATMELCDFGY | 211 | FTFSSYPMS | 945 | TISSGGDTTLYADSVKG | 953 | RIDCNSGYCYKRSY |
| DR592-hIL27Ra-VHH21 | 14 | QVQLQESGGGSVQAGGSLRLSCTAPGFTSNSCGMDWYRQAPGKEREFVSSISTDGTTGYADSVKGRFTISKDKAKDTVYLQMNSLKPEDTGMYSCKTKDGTIATMELCDFGYWGQGTQVTVSSGGGSQVQLQESGGGLVQPGGSLRLSCAASGFTFSLSSMSWVRQAPGKGLEWVSAISSGGASTYYTDSVKGRFTISRDNAKNMLYLQLNSLKTEDTAMYYCAKGGSGYGDASRMTSPGSQGTQVTVSS | 194 | FTSNSCGMD | 200 | SISTDGTTGYADSV KG | 206 | KDGTIATMELCDFGY | 217 | FTFSLSSMS | 224 | AISSGGASTYYTDSVKG | 231 | GGSGYGDASRMTSP |

TABLE 1A-continued

| Name | SEQ ID NO: | Sequence of dual VHH dimer | SEQ ID NO: | CDR1 | SEQ ID NO: | CDR2 | SEQ ID NO: | CDR3 | SEQ ID NO: | CDR4 | SEQ ID NO: | CDR5 | SEQ ID NO: | CDR6 |
|---|---|---|---|---|---|---|---|---|---|---|---|---|---|---|
| DR592-hIL27Ra-VHH22 | 581 | QVQLQESGGGSVQAGGSLRLSCTAPGFTSNSCGMDWYRQAPGKEREFVSSISTDGTTGYADSVKGRFTISKDKAKDTVYLQMNSLKPEDTGMYSCKTKDGTIATMELCDFGYWGQGTQVTVSSGGGSQVQLQESGGGSVQAGGSLRLSCRASGSTYSNYCLGWFRQTTGKEREGVAVINWVGGMLYFADSVKGRFTVSQDQAKNTVYLQMNSLKPEDTAMYYCAAESVSSFSCGGWLTRPDRVPYWGQGTQVTVSS | 194 | FTSNSCGMD | 200 | SISTDGTTGYADSVKG | 206 | KDGTIATMELCDFGY | 216 | STYSNYCLG | 223 | VINWVGGMLYFADSVKG | 230 | ESVSSFSCGGWLTRPDRVPY |
| DR592-hIL27a-VHH23 | 582 | QVQLQESGGGSVQAGGSLRLSCTAPGFTSNSCGMDWYRQAPGKEREFVSSISTDGTTGYADSVKGRFTISKDKAKDTVYLQMNSLKPEDTGMYSCKTKDGTIATMELCDFGYWGQGTQVTVSSGGGSQVQLQESGGGSVQAGGSLRLSCRASRSPYGNYCLGWFRQSTGKEREGVAVINWVGGMLYFADSVKGRFTVSQDHAKNTVTLQMNSLKPEDTAMYYCAAESVSSFSCGGWLTRPDRVPYWGQGTQVTVSS | 194 | FTSNSCGMD | 200 | SISTDGTTGYADSVKG | 206 | KDGTIATMELCDFGY | 941 | SPYGNYCLG | 223 | VINWVGGMLYFADSVKG | 230 | ESVSSFSCGGWLTRPBRVPY |
| DR592-hIL27Ra-VHH24 | 583 | QVQLQESGGGSVQAGGSLRLSCTAPGFTSNSCGMDWYRQAPGKEREFVSSISTDGTTGYADSVKGRFTISKDKAKDTVYLQMNSLKPEDTGMYSCKTKDGTIATMELCDFGYWGQGTQVTVSSGGGSQVQLQESGGGLVQPGGSLRLSCAASGFTFSHSGMSWVRQAPGKGLEWVSTINSGGASTYYTDSVKGRFTISRDNAKNMLYLQLNSLKTEDTAMYYCAKGGSGYGDASRMTSPGSQGTQVTVSS | 194 | FTSNSCGMD | 200 | SISTDGTTGSADSVKG | 206 | KDGTIATMELCDFGY | 942 | FTFSHSGMS | 946 | TINSGGASTYYTDSVKG | 231 | GGSGYGDASRMTSP |
| DR593-hIL27Ra-VHH1 | 15 | QVQLQESGGGSVQAGGSLRLSCAASGYPYSNGYMGWFRQAPGKEREGVATIYTGDGRTYYADSVKGRFTISRDNAKNTVDLQMSSLKPEDTAMYYCAARAAPLYSSGSPLTRARYNWGQGTQVTVSSGGGSQVQLQESGGGLVQPGGSLRLSCAASGFTFSSYPMSWVRQAPGKGLEWISTISAGGDTTLYADSVKGRFTSSRDNAKNTLYLQLNSLKTEDAAIYYCAKRIDCNSGYCYRRNYWGQGTQVTVSS | 195 | YPYSNGYMG | 201 | TIYTGIGRTYYADSVKG | 207 | RAAPLYSSGSPITRARYNV | 942 | FTFSHSGMS | 946 | TINSGGASTYYTDSVKG | 231 | GGSGYGDASRMTSP |
| DR593-hIL27Ra-VHH2 | 584 | QVQLQESGGGSVQAGGSLRLSCAASGYPYSNGYMGWFRQAPGKEREGVATIYTGDGRTYYADSVKGRFTISRDNAKNTVDLQMSSLKPEDTAMYYCAARAAPLYSSGSPLTRARYNWGQGTQVTVSSGGGSQVQLQESGGGLVQPGGSLRLSCAASGFTFSLSGMSWVRQAPGKGLEWVSAISSGGASTYYTDSVKGRFTISRDNAKNILYLQLNSLKTEDTAMYYCAKGGSG | 195 | YPYSNGYMG | 201 | TIYTGDGRTYYADSVKG | 207 | RAAPLYSSGSPTRARYNV | 942 | FTFSHSGMS | 946 | TINSGGASTYYTDSVKG | 231 | GGSGYGDASRMTSP |

TABLE 1A-continued

| Name | SEQ ID NO: | Sequence of dual VHH dimer | SEQ ID NO: | CDR1 | SEQ ID NO: | CDR2 | SEQ ID NO: | CDR3 | SEQ ID NO: | CDR4 | SEQ ID NO: | CDR5 | SEQ ID NO: | CDR6 |
|---|---|---|---|---|---|---|---|---|---|---|---|---|---|---|
| | | YGDASRMTSPGSQGTQVTVSS | | | | | | | | | | | | |
| DR593-hIL27Ra-VHH3 | 585 | QVQLQESGGGSVQAGGSLRLSCAASGYPYSNGYMGWFRQAPGKEREGVATIYTGDGRTYYADSVKGRFTISRDNAKNTVDLQMSSLKPEDTAMYYCAARAAPLYSSGSPLTRARYNVWGQGTQVTVSSGGGSQVQLQESGGGSVQAGGSLRLSCVASGYVSCDYFLPSWYRQAPGKEREFVSIIDGTGSTSYAASVKGRFTASEDKGKNIAYLQMNSLKPEDTAMYYCKASCVRGRAVSEYWGQGTQVTVSS | 195 | YPYSNGYMG | 201 | TIYTGDGRTYYADSVKG | 207 | RAAPLYSSGSPLTRARYNV | 942 | FTFSHSGMS | 946 | TINSGGASTYYTDSVKG | 231 | GGSGYGDASRMTSP |
| DR593-hIL27Ra-VHH4 | 16 | QVQLQESGGGSVQAGGSLRLSCAASGYPYSNGYMGWFRQAPGKEREGVATIYTGDGRTYYADSVKGRFTISRDNAKNTVDLQMSSLKPEDTAMYYCAARAAPLYSSGSPLTRARYNVWGQGTQVTVSSGGGSQVQLQESGGGLVQPGESLRLSCTASGFTFSNYAMSWVRQAPGKGLEWVSGINVAYGITSYADSVKGRFTISRDNTKNTLYLQLNSLKTEDTAIYYCVKHSGTTIPRGFISYTKRGQGTQVTVSS | 195 | YPYSNGYMG | 201 | TIYTGDGRTYYADSVKG | 207 | RAAPLYSSGSPLTRARYNV | 942 | FTFSHSGMS | 946 | TINSGGASTYYTDSVKG | 231 | GGSGYGDASRMTSP |
| DR593-hIL27Ra-VHH5 | 586 | QVQLQESGGGSVQAGGSLRLSCAASGYPYSNGYMGWFRQAPGKEREGVATIYTGDGRTYYADSVKGRFTISRDNAKNTVDLQMSSLKPEDTAMYYCAARAAPLYSSGSPLTRARYNVWGQGTQVTVSSGGGSQVQLQESGGGSVQAGGSLRLSCTASGYVSCDYFLPSWYRQAPGKEREFVSVIDGTGSTSYAASVKGRFTASQDKGKNIAYLQMNSLKPEDTAMYYCKASCVRGRAISEYWGQGTQVTVSS | 195 | YPYSNGYMG | 201 | TIYTGDGRTYYADSVKG | 207 | RAAPLYSSGSPLTRARYNV | 942 | FTFSHSGMS | 946 | TINSGGASTYYTDSVKG | 231 | GGSGYGDASRMTSP |
| DR593-hIL27Ra-VHH6 | 17 | QVQLQESGGGSVQAGGSLRLSCAASGYPYSNGYMGWFRQAPGKEREGVATIYTGDGRTYYADSVKGRFTISRDNAKNTVDLQMSSLKPEDTAMYYCAARAAPLYSSGSPLTRARYNVWGQGTQVTVSSGGGSQVQLQESGGGLVQPGGSLRLSCAASGFSFSSYAMKWVRQAPGKGLEWVSTISSGGSTNYADSVKGRFTISRDNAKNTLYLQLNSLKIEDTAMYYCAKAIVPTGATMERGQGTQVTVSS | 195 | YPYSNGYMG | 201 | TIYTGDGRTYYADSVKG | 207 | RAAPLYSSGSPLTRARYNV | 942 | FTFSHSGMS | 946 | TINSGGASTYYTDSVKG | 231 | GGSGYGDASRMTSP |
| DR593-hIL27Ra-VHH7 | 587 | QVQLQESGGGSVQAGGSLRLSCAASGYPYSNGYMGWFRQAPGKEREGVATIYTGDGRTYYADSVKGRFTISRDNAKNTVDLQMSSLKPEDTAMYYCAARAAPLYSSGSPLTRARYNVWGQGTQVTVSSGGGSQVQLQESGGGLVQPGGSLRLSCAASGFTFSSYPMSWVRQAPGKGLEWISTISAGGDTTLYADSVKGRFTSSRDNAKNTLYLQLN | 195 | YPYSNGYMG | 201 | TIYTGIGRTYYADSVKG | 207 | RAAPLYSSGSPLTRARYNV | 942 | FTFSHSGMS | 946 | TINSGGASTYYTDSVKG | 231 | GGSGYGDASRMTSP |

TABLE 1A-continued

| Name | SEQ ID NO: | Sequence of dual VHH dimer | SEQ ID NO: | CDR1 | SEQ ID NO: | CDR2 | SEQ ID NO: | CDR3 | SEQ ID NO: | CDR4 | SEQ ID NO: | CDR5 | SEQ ID NO: | CDR6 |
|---|---|---|---|---|---|---|---|---|---|---|---|---|---|---|
| | | SLKTEDTAIYYCAKRIDC NSGYCYRRNYWGQGTQVT VSS | | | | | | | | | | | | |
| DR593-hIL27Ra-VHH8 | 588 | QVQLQESGGGSVQAGGSL RLSCAASGYPYSNGYMGW FRQAPGKEREGVATIYTG DGRTYYADSVKGRFTISR DNAKNTVDLQMSSLKPED TAMYYCAARAAPLYSSGS PLTRARYNVWGQGTQVTV SSGGGSQVQLQESGGGSV QVGGSLRLSCAASGFTFS SYPMSWVRQAPGKGLEWI STISAGGDTTLYADSVKG RFTSSRDNAKNTLYLQLN SLKTEDTAIYYCAKRIDC NSGYCYRRNYWGQGTQVT VSS | 195 | Y P Y S N G Y M G | 201 | TI YT GD GR TY YA DS VK G | 207 | RA AP LY SS GS PL TR AR YN V | 942 | FTF SHS GMS | 946 | TIN SGG AST YYT DSV KG | 231 | GG SG YG DA SR MT SP |
| DR593-hIL27Ra-VHH9 | 18 | QVQLQESGGGSVQAGGSL RLSCAASGYPYSNGYMGW FRQAPGKEREGVATIYTG DGRTYYADSVKGRFTISR DNAKNTVDLQMSSLKPED TAMYYCAARAAPLYSSGS PLTRARYNVWGQGTQVTV SSGGGSQVQLQESGGGSV QSGGSLRLSCAASGFTYS TSNSWMAWFRQAPGKERE GVAAIYTVGGSIFYADSV RGRFTISQDATKNMFYLQ MNTLKPEDTAMYYCAAAS GRLRGKWFWPYEYNYWGQ GTQVTVSS | 195 | Y P Y S N G Y M G | 201 | TI YT GD GR TY YA DS VK G | 207 | RA AP LY SS GS PL TR AR YN V | 942 | FTF SHS GMS | 946 | TIN SGG AST YYT DSV KG | 231 | GG SG YG DA SR MT SP |
| DR593-hIL27Ra-VHH10 | 589 | QVQLQESGGGSVQAGGSL RLSCAASGYPYSNGYMGW FRQAPGKEREGVATIYTG DGRTYYADSVKGRFTISR DNAKNTVDLQMSSLKPED TAMYYCAARAAPLYSSGS PLTRARYNVWGQGTQVTV SSGGGSQVQLQESGGGSV QAGGSLRLSCRASGSTYS NYCLGWFRQITGKEREGV AVINWVGGMLYFADSVKG RFTVSQDQAKNTLYLQMN SLKPEDTAMYYCAAESVS SFSCGGWLTRPDRVPYWG QGTQVTVSS | 195 | Y P Y S N G Y M G | 201 | TI YT GD GR TY YA DS VK G | 207 | RA AP LY SS GS PL TR AR YN V | 942 | FTF SHS GMS | 946 | TIN SGG AST YYT DSV KG | 231 | GG SG YG DA SR MT SP |
| DR593-hIL27Ra-VHH11 | 590 | QVQLQESGGGSVQAGGSL RLSCAASGYPYSNGYMGW FRQAPGKEREGVATIYTG DGRTYYADSVKGRFTISR DNAKNTVDLQMSSLKPED TAMYYCAARAAPLYSSGS PLTRARYNVWGQGTQVTV SSGGGSQVQLQESGGGSV QAGGSLRLSCRASGSTYS NYCLGWFRQSTGKEREGV AVINWVGGMLYFADSVKG RFTVSQDHAKNTVLQMN SLKPEDTAMYYCAAESVS SFSCGGWLTRPGRVPYWG QGTQVTVSS | 195 | Y P Y S N G Y M G | 201 | TI YT GD GR TY YA DS VK G | 207 | RA AP LY SS GS PL TR AR YN V | 942 | FTF SHS GMS | 946 | TIN SGG AST YYT DSV KG | 231 | GG SG YG DA SR MT SP |
| DR593-hIL27Ra-VHH12 | 591 | QVQLQESGGGSVQAGGSI RLSCAASGYPYSNGYMGW FRQAPGKEREGVATIYTG DGRTYYADSVKGRFTISR DNAKNTVDLQMSSLKPED TAMYYCAARAAPLYSSGS PLTRARYNVWGQGTQVTV SSGGGSQVQLQESGGGSV | 195 | Y P Y S N G Y M G | 201 | TI YT GD GR TY YA DS VK M | 207 | RA AP LY SS GS PL TR AR | 942 | FTF SHS GMS | 946 | TIN SGG AST YYT DSV KG | 231 | GG SG YG DA SR MT SP |

TABLE 1A-continued

| Name | SEQ ID NO: | Sequence of dual VHH dimer | SEQ ID NO: CDR1 | CDR1 | SEQ ID NO: CDR2 | CDR2 | SEQ ID NO: CDR3 | CDR3 | SEQ ID NO: CDR4 | CDR4 | SEQ ID NO: CDR5 | CDR5 | SEQ ID NO: CDR6 | CDR6 |
|---|---|---|---|---|---|---|---|---|---|---|---|---|---|---|
| | | QAGESLRLSCRASGSTYS NYCLGWFRQITGKEREGV AVINWVGGMLYFADSVKG RFTVSQDQAKNTVYLEMN SLKPEDTAMYYCATESVS SFSCGGWLTRPDRVPYWG QGTQVTVSS | | G | | G | | YN V | | | | | | |
| DR593-hIL27Ra-VHH13 | 592 | QVQLQESGGGSVQAGGSL RLSCAASGYPYSNGYMGW FRQAPGKEREGVATIYTG DGRTYYADSVKGRFTISR DNAKNTVDLQMSSLKPED TAMYYCAARAAPLYSSGS PLTRARYNVWGQGTQVTV SSGGGSQVQLQESGGGSV QAGGSLRLSCVASGYVSC DYFLPSWYRQAPGKEREF VSIIDGTGSTSYAASVKG RFTASQDRGKNIAYLQMN SLKPEDTAMYYCKASCVR GRTISEYWGQGTQVTVSS | 195 | Y P Y S N G Y M G | 201 | TI YT GD GR TY YA DS VK G | 207 | RA AP LY SS GS PL TR AR YN V | 942 | FTF SHS GMS | 946 | TIN SGG AST YYT DSV KG | 231 | GG SG YG DA SR MT SP |
| DR593-hIL27Ra-VHH14 | 593 | QVQLQESGGGSVQAGGSL RLSCAASGYPYSNGYMGW FRQAPGKEREGVATIYTG DGRTYYADSVKGRFTISR DNAKNTVDLQMSSLKPED TAMYYCAARAAPLYSSGS PLTRARYNVWGQGTQVTV SSGGGSQVQLQESGGGSV QAGGSLRLSCVASGYVSC DYFLPSWYRQAPGKEREF VSIIDGTGSTSYAASVKG RFTASQDKGKNIAYLQMN SLKPEDTAMYYCKASCVR GRAISEYWGQGTQVTVSS | 195 | Y P Y S N G Y M G | 201 | TI YT GD GR TY YA DS VK G | 207 | RA AP LY SS GS PL TR AR YN V | 942 | FTF SHS GMS | 946 | TIN SGG AST YYT DSV KG | 231 | GG SG YG DA SR MT SP |
| DR593-hIL27Ra-VHH15 | 19 | QVQLQESGGGSVQAGGSL RLSCAASGYPYSNGYMGW FRQAPGKEREGVATIYTG DGRTYYADSVKGRFTISR DNAKNTVDLQMSSLKPED TAMYYCAARAAPLYSSGS PLTRARYNVWGQGTQVTV SSGGGSQVQLQESGGGSV QAGGSLRLSCVASGYVSC DYFLPSWYRQAPGKEREF VSIIDGTGSTSYAASVKG RFTASQDKGKNIAYLQMN TLKPEDTAMYYCKASCVR GRAISEYWGQGTQVTVSS | 195 | Y P Y S N G Y M G | 201 | TI YT GD GR TY YA DS VK G | 207 | RA AP LY SS GS PL TR AR YN V | 942 | FTF SHS GMS | 946 | TIN SGG AST YYT DSV KG | 231 | GG SG YG DA SR MT SP |
| DR593-hIL27Ra-VHH16 | 594 | QVQLQESGGGSVQAGGSL RLSCAASGYPYSNGYMGW FRQAPGKEREGVATIYTG DGRTYYADSVKGRFTISR DNAKNTVDLQMSSLKPED TAMYYCAARAAPLYSSGS PLTRARYNVWGQGTQVTV SSGGGSQVQLQESGGGSV QAGGSLRLSCRASGSTYS NYCLGWFRQITGKEREGV AVINWVGGMLYFADSVKG RFTVSQDQAKNTVYLQMN SLKPEDTAMYYCAAESAS SFSCGGWLTRPDRVPYWG QGTQVTVSS | 195 | Y P Y S N G Y M G | 201 | TI YT GD GR TY YA DS VK G | 207 | RA AP LY SS GS PL TR AR YI V | 942 | FTF SHS GMS | 946 | TIN SGG AST YYT DSV KG | 231 | GG SG YG DA SR MT SP |
| DR593-hIL27Ra-VHH17 | 595 | QVQLQESGGGSVQAGGSL RLSCAASGYPYSNGYMGW FRQAPGKEREGVATIYTG DGRTYYADSVKGRFTISR DNAKNTVDLQMSSLKPED TAMYYCAARAAPLYSSGS PLTRARYNVWGQGTQVTV | 195 | Y P Y S N G Y M G | 201 | TI YT GI GR TY YA DS | 207 | RA AP LY SS GS PL TR | 942 | FTF SHS GMS | 946 | TIN SGG AST YYT DSV KG | 231 | GG SG YG DA SR MT SP |

TABLE 1A-continued

| Name | SEQ ID NO: | Sequence of dual VHH dimer | SEQ ID NO: | CDR1 | SEQ ID NO: | CDR2 | SEQ ID NO: | CDR3 | SEQ ID NO: | CDR4 | SEQ ID NO: | CDR5 | SEQ ID NO: | CDR6 |
|---|---|---|---|---|---|---|---|---|---|---|---|---|---|---|
| | | SSGGGSQVQLQESGGGLV QPGGSLRLSCAASGFTFS LSGMSWVRQAPGKGLEWV SAISSGGASTYYTDSVKG RFTISRDNAKNMLYLQLN SLKTEDTAMYYCAKGGSG YGDASRMTSPGSQGTQVT VSS | | M G | | VK G | | AR YN V | | | | | | |
| DR593-hIL27Ra-VHH18 | 596 | QVQLQESGGGSVQAGGSL RLSCAASGYPYSNGYMGW FRQAPGKEREGVATIYTG DGRTYYADSVKGRFTISR DNAKNTVDLQMSSLKPED TAMYYCAARAAPLYSSGS PLTRARYNVWGQGTQVTV SSGGGSQVQLQESGGGSV QAGGSLRLSCVASGYVSC DYFLPSWYRQAPGKEREF VSIIDGTGSTSYAASVKG RFTASQDKGKNIAYLQMN SLKPEDTAMYYCKASCVR GRGISEYWGQGTQVTVSS | 195 | Y P Y S N G Y M G | 201 | TI YT GD GR TY YA DS VK G | 207 | RA AP LY SS GS PL TR AR YN V | 942 | FTF SHS GMS | 946 | TIN SGG AST YYT DSV KG | 231 | GG SG YG DA SR MT SP |
| DR593-hIL27Ra-VHH19 | 20 | QVQLQESGGGSVQAGGSL RLSCAASGYPYSNGYMGW FRQAPGKEREGVATIYTG DGRTYYADSVKGRFTISR DNAKNTVDLQMSSLKPED TAMYYCAARAAPLYSSGS PLTRARYNVWGQGTQVTV SSGGGSQVQLQESGGGSV QAGGSLRLSCRASGSTYS NYCLGWFRQITGKEREGV AVINWVGGMLYFADSVKG RFTVSQDQAKNTVYLQMN SLKPEDTAMYYCAAESVS SFSCGGWLTRPDRVPYWG QGTQVTVSS | 195 | Y P Y S N G Y M G | 201 | TI YT GD GR TY YA DS VK G | 207 | RA AP LY SS GS PL TR AR YN V | 942 | FTF SHS GMS | 946 | TIN SGG AST YYT DSV KG | 231 | GG SG YG DA SR MT SP |
| DR593-hIL27Ra-VHH20 | 597 | QVQLQESGGGSVQAGGSL RLSCAASGYPYSNGYMGW FRQAPGKEREGVATIYTG DGRTYYADSVKGRFTISR DNAKNTVDLQMSSLKPED TAMYYCAARAAPLYSSGS PLTRARYNVWGQGTQVTV SSGGGSQVQLQESGGGLV QPGGSLRLSCAASGFTFS SYPMSWVRQAPGKGLEWV STISSGDTTLYADSVKG RFTSSRDNAKNTLYLQLN SLKTEDTAMYYCAKRIDC NSGYCYKRSYWGQGTQVT VSS | 195 | Y P Y S N G Y M G | 201 | TI YT GI GR TY YA DS VK G | 207 | RA AP LY SS GS PL TR AR YN V | 942 | FTF SHS GMS | 946 | TIN SGG AST YYT DSV KG | 231 | GG SG YG DA SR MT SP |
| DR593-hIL27Ra-VHH21 | 21 | QVQLQESGGGSVQAGGSL RLSCAASGYPYSNGYMGW FRQAPGKEREGVATIYTG DGRTYYADSVKGRFTISR DNAKNTVDLQMSSLKPED TAMYYCAARAAPLYSSGS PLTRARYNVWGQGTQVTV SSGGGSQVQLQESGGGLV QPGGSLRLSCAASGFTFS LSSMSWVRQAPGKGLEWV SAISSGGASTYYTDSVKG RFTISRDNAKNMLYLQLN SLKTEDTAMYYCAKGGSG YGDASRMTSPGSQGTQVT VSS | 195 | Y P Y S N G Y M G | 201 | TI YT GD GR TY YA DS VK G | 207 | RA AP LY SS GS PL TR AR YN V | 942 | FTF SHS GMS | 946 | TIN SGG AST YYT DSV KG | 231 | GG SG YG DA SR MT SP |

TABLE 1A-continued

| Name | SEQ ID NO: | Sequence of dual VHH dimer | SEQ ID NO: | CDR1 | SEQ ID NO: | CDR2 | SEQ ID NO: | CDR3 | SEQ ID NO: | CDR4 | SEQ ID NO: | CDR5 | SEQ ID NO: | CDR6 |
|---|---|---|---|---|---|---|---|---|---|---|---|---|---|---|
| DR593-hIL27Ra-VHH22 | 598 | QVQLQESGGGSVQAGGSLRLSCAASGYPYSNGYMGWFRQAPGKEREGVATIYTGDGRTYYADSVKGRFTISRDNAKNTVDLQMSSLKPEDTAMYYCAARAAPLYSSGSPLTRARYNVWGQGTQVTVSSGGGSQVQLQESGGGSVQAGGSLRLSCRASGSTYSNYCLGWFRQTTGKEREGVAVINWVGGMLYFADSVKGRFTVSQDQAKNTVYLQMNSLKPEDTAMYYCAAESVSSFSCGGWLTRPDRVPYWGQGTQVTVSS | 195 | YPYSNGYMG | 201 | TIYTGDGRTYYADSVKG | 207 | RAAPLYSSGSPLTRARYNV | 942 | FTFSHSGMS | 946 | TINSGGASTYYTDSVKG | 231 | GGSGYGDASRMTSP |
| DR593-hIL27Ra-VHH23 | 599 | QVQLQESGGGSVQAGGSLRLSCAASGYPYSNGYMGWFRQAPGKEREGVATIYTGDGRTYYADSVKGRFTISRDNAKNTVDLQMSSLKPEDTAMYYCAARAAPLYSSGSPLTRARYNVWGQGTQVTVSSGGGSQVQLQESGGGSVQAGGSLRLSCRASRSPYGNYCLGWFRQSTGKEREGVAVINWVGGMLYFADSVKGRFTVSQDHAKNTVTLQMNSLKPEDTAMYYCAAESVSSFSCGGWLTRPDRVPYWGQGTQVTVSS | 195 | YPYSNGYMG | 201 | TIYTGDGRTYYADSVKG | 207 | RAAPLYSSGSPLTRARYNV | 942 | FTFSHSGMS | 946 | TINSGGASTYYTDSVKG | 231 | GGSGYGDASRMTSP |
| DR593-hIL27Ra-VHH24 | 600 | QVQLQESGGGSVQAGGSLRLSCAASGYPYSNGYMGWFRQAPGKEREGVATIYTGDGRTYYADSVKGRFTISRDNAKNTVDLQMSSLKPEDTAMYYCAARAAPLYSSGSPLTRARYNVWGQGTQVTVSSGGGSQVQLQESGGGLVQPGGSLRLCAASGFTFSHSGMSWVRQAPGKGLEWVSTINSGGASTYYTDSVKGRFTISRDNAKNMLYLQLNSLKTEDTAMYYCAKGGSGYGDASRMTSPGSQGTQVTVSS | 195 | YPYSNGYMG | 201 | TIYTGDGRTYYADSVKG | 207 | RAAPLYSSGSPLTRARYNV | 942 | FTFSHSGMS | 946 | TINSGGASTYYTDSVKG | 231 | GGSGYGDASRFMTSP |
| DR594-hIL27Ra-VHH1 | 22 | QVQLQESGGGSVQAGGSLRLSCVASASTYCTYDMHWYRQAPGKGREFVSAIDSDGTTRYADSVKGRFTISQGTAKNTVYLQMNSLQPEDTAMYYCKTVCVVGSRWSDYWGQGTQVTVSSGGGSQVQLQESGGGLVQPGGSLRLSCAASGFTFSSYPMSWVRQAPGKGLEWISTISAGGDTTLYADSVKGRFTSSRDNAKNTLYLQLNSLKTEDAAIYYCAKRIDCNSGYCYRRNYWGQGTQVTVSS | 196 | STYCTYDMH | 202 | AIDSDGTTRYADSVKG | 954 | VCVVGSRWSDY | 942 | FTFSHSGMS | 946 | TINSGGASTYYTDSVKG | 231 | GGSGYGDASRFMTSP |
| DR594-hIL27Ra-VHH2 | 601 | QVQLQESGGGSVQAGGSLRLSCVASASTYCTYDMHWYRQAPGKGREFVSAIDSDGTTRYADSVKGRFTISQGTAKNTVYLQMNSLQPEDTAMYYCKTVCVVGSRWSDYWGQGTQVTVSSGGGSQVQLQESGGGLVQPGGSLRLSCAASGFTFSLSGMSWVRQAPGKGLEWVSAISSGGASTYYTDSVKGRFTISRDNAKNILYLQLNSLKTEDTAM | 196 | STYCTYDMH | 202 | AIDSDGTTRYADSVKG | 954 | VC55GSRWSDY | 942 | FTFSHSGMS | 946 | TINSGGASTYYTDSVKG | 231 | GGSGYGDASRFMTSP |

TABLE 1A-continued

| Name | SEQ ID NO: | Sequence of dual VHH dimer | SEQ ID NO: | CDR1 | SEQ ID NO: | CDR2 | SEQ ID NO: | CDR3 | SEQ ID NO: | CDR4 | SEQ ID NO: | CDR5 | SEQ ID NO: | CDR6 |
|---|---|---|---|---|---|---|---|---|---|---|---|---|---|---|
| | | YYCAKGGSYGDASRMTS PGSQGTQVTVSS | | | | | | | | | | | | |
| DR594-hIL27Ra-VHH3 | 602 | QVQLQESGGGSVQAGGSL RLSCVASASTYCTYDMHW YRQAPGKGREFVSAIDSD GTTRYADSVKGRFTISQG TAKNTVYLQMNSLQPEDT AMYYCKTVCVVGSRWSDY WGQGTQVTVSSGGGSQVQ LQESGGGSVQAGGSLRLS CVASGYVSCDYFLPSWYR QAPGKEREFVSIIDGTGS TSYAASVKGRFTASEDKG KNIAYLQMNSLKPEDTAM YYCKASCVRGRAVSEYWG QGTQVTVSS | 196 | S T Y C T Y D M H | 202 | AI DS DG TT RY AD SV KG | 954 | VC VV GS RW SD Y | 942 | FTF SHS GMS | 946 | TIN SGG AST YYT DSV KG | 231 | GG SG YG DA SR MT SP |
| DR594-hIL27Ra-VHH4 | 23 | QVQLQESGGGSVQAGGSL RLSCVASASTYCTYDMHW YRQAPGKGREFVSAIDSD GTTRYADSVKGRFTISQG TAKNTVYLQMNSLQPEDT AMYYCKTVCVVGSRWSDY WGQGTQVTVSSGGGSQVQ LQESGGGLVQPGESLRLS CTASGFTFSNYAMSWVRQ APGKGLEWVSGINVAYGI TSYADSVKGRFTISRDNT KNTLYLQLNSLKTEDTAI YYCVKHSGTTIPRGFISY TKRGQGTQVTVSS | 196 | S T Y C T Y D M H | 202 | AI DS DG TT RY AD SV KG | 954 | VC VV GS RW SD Y | 942 | FTF SHS GMS | 946 | TIN SGG AST YYT DSV KG | 231 | GG SG YG DA SR MT SP |
| DR594-hIL27Ra-VHH5 | 603 | QVQLQESGGGSVQAGGSL RLSCVASASTYCTYDMHW YRQAPGKGREFVSAIDSD GTTRYADSVKGRFTISQG TAKNTVYLQMNSLQPEDT AMYYCKTVCVVGSRWSDY WGQGTQVTVSSGGGSQVQ LQESGGGSVQAGGSLRLS CTASGYVSCDYFLPSWYR QAPGKEREFVSIDGTGS TSYAASVKGRFTASQDKG KNIAYLQMNSLKPEDTAM YYCKASCVRGRAISEYWG QGTQVTVSS | 196 | S T Y C T Y D M H | 202 | AI DS DG TT RY AD SV KG | 954 | VC VV GS RW SD Y | 942 | FTF SHS GMS | 946 | TIN SGG AST YYT DSV KG | 231 | GG SG YG DA SR MT SP |
| DR594-hIL27Ra-VHH6 | 24 | QVQLQESGGGSVQAGGSL RLSCVASASTYCTYDMHW YRQAPGKGREFVSAIDSD GTTRYADSVKGRFTISQG TAKNTVYLQMNSLQPEDT AMYYCKTVCVVGSRWSDY WGQGTQVTVSSGGGSQVQ LQESGGGLVQPGGSLRLS CAASGFSFSSYAMKWVRQ APGKGLEWVSTISSGGSS TNYADSVKGRFTISRDNA KNTLYLQLNSLKIEDTAM YYCAKAIVPTGATMERGQ GTQVTVSS | 196 | S T Y C T Y D M H | 202 | AI DS DG TT RY AL SV KG | 954 | VC VV GS RW SD Y | 942 | FTF SHS GMS | 946 | TIN SGG AST YYT DSV KG | 231 | GG SG YG DA SR MT SP |
| DR594-hIL27Ra-VHH7 | 604 | QVQLQESGGGSVQAGGSL RLSCVASASTYCTYDMHW YRQAPGKGREFVSAIDSD GTTRYADSVKGRFTISQG TAKNTVYLQMNSLQPEDT AMYYCKTVCVVGSRWSDY WGQGTQVTVSSGGGSQVQ LQESGGGLVQPGGSLRLS CAASGFTFSSYPMSWVRQ APGKGLEWISTISAGGDT TLYADSVKGRFTSSRDNA KNTLYLQLNSLKTEDTAI | 196 | S T Y C T Y D M H | 202 | AI DS DG TT RY AD SV KG | 954 | VC VV GS RW SD Y | 942 | FTF SHS GMS | 946 | TIN SGG AST YYT DSV KG | 231 | GG SG YG DA SR MT SP |

TABLE 1A-continued

| Name | SEQ ID NO: | Sequence of dual VHH dimer | SEQ ID NO: | CDR1 | SEQ ID NO: | CDR2 | SEQ ID NO: | CDR3 | SEQ ID NO: | CDR4 | SEQ ID NO: | CDR5 | SEQ ID NO: | CDR6 |
|---|---|---|---|---|---|---|---|---|---|---|---|---|---|---|
| | | YYCAKRIDCNSGYCYRRN YWGQGTQVTVSS | | | | | | | | | | | | |
| DR594-hIL27Ra-VHH8 | 605 | QVQLQESGGGSVQAGGSL RLSCVASASTYCTYDMHW YRQAPGKGREFVSAIDSD GTTRYADSVKGRFTISQG TAKNTVYLQMNSLQPEDT AMYYCKTVCVVGSRWSDY WGQGTQVTVSSGGGSQVQ LQESGGGSVQVGGSLRLS CAASGFTFSSYPMSWVRQ APGKGLEWISTISAGGDT TLYADSVKGRFTSSRDNA KNTLYLQLNSLKTEDTAI YYCAKRIDCNSGYCYRRN YWGQGTQVTVSS | 196 | STYCTYDMH | 202 | AIDSDGTTRYADSV KG | 954 | VCVVGSRWSDY | 942 | FTFSHSGMS | 946 | TINSGGASTYYTDSV KG | 231 | GGSGYGDASRMTSP |
| DR594-hIL27Ra-VHH9 | 25 | QVQLQESGGGSVQAGGSL RLSCVASASTYCTYDMHW YRQAPGKGREFVSAIDSD GTTRYADSVKGRFTISQG TAKNTVYLQMNSLQPEDT AMYYCKTVCVVGSRWSDY WGQGTQVTVSSGGGSQVQ LQESGGGSVQSGGSLRLS CAASGFTYSTSNSWMAWF RQAPGKEREGVAAIYTVG GSIFYADSVRGRFTISQD ATKNMFYLQMNTLKPEDT AMYYCAAASGRLRGKWFW PYEYNYWGQGTQVTVSS | 196 | STYCTYDMH | 202 | AIDSDGTTRYADSV KG | 954 | VCVVGSRWSDY | 942 | FTFSHSGMS | 946 | TINSGGASTYYTDSV KG | 231 | GGSGYGDASRMTSP |
| DR594-hIL27Ra-VHH10 | 606 | QVQLQESGGGSVQAGGSL RLSCVASASTYCTYDMHW YRQAPGKGREFVSAIDSD GTTRYADSVKGRFTISQG TAKNTVYLQMNSLQPEDT AMYYCKTVCVVGSRWSDY WGQGTQVTVSSGGGSQVQ LQESGGGSVQAGGSLRLS CRASGSTYSNYCLGWFRQ ITGKEREGVAVINWVGGM LYFADSVKGRFTVSQDQA KNTLYLQMNSLKPEDTAM YYCAAESVSSFSCGGWLT RPDRVPYWGQGTQVTVSS | 196 | STYCTYDMH | 202 | AIDSDGTTRYADSV K | 954 | VCVVGSRWSDY | 942 | FTFSHSGMS | 946 | TINSGGASTYYTDSV KG | 231 | GGSGYGDASRMTSP |
| DR594-hIL27Ra-VHH11 | 607 | QVQLQESGGGSVQAGGSL RLSCVASASTYCTYDMHW YRQAPGKGREFVSAIDSD GTTRYADSVKGRFTISQG TAKNTVYLQMNSLQPEDT AMYYCKTVCVVGSRWSDY WGQGTQVTVSSGGGSQVQ LQESGGGSVQAGGSLRLS CRASGSTYSNYCLGWFRQ STGKEREGVAVINWVGGM LYFADSVKGRFTVSQDHA KNTVTLQMNSLKPEDTAM YYCAAESVSSFSCGGWLT RPGRVPYWGQGTQVTVSS | 196 | STYCTYDMH | 202 | AIDSDGTTRYADSV KG | 954 | VCVVGSRWSDY | 942 | FTFSHSGMS | 946 | TINSGGASTYYTDSV KG | 231 | GGSGYGDASRMTSP |
| DR594-hIL27Ra-VHH12 | 608 | QVQLQESGGGSVQAGGSL RLSCVASASTYCTYDMHW YRQAPGKGREFVSAIDSD GTTRYADSVKGRFTISQG TAKNTVYLQMNSLQPEDT AMYYCKTVCVVGSRWSDY WGQGTQVTVSSGGGSQVQ LQESGGGSVQAGESLRLS CRASGSTYSNYCLGWFRQ ITGKEREGVAVINWVGGM LYFADSVKGRFTVSQDQA KNTVYLEMNSLKPEDTAM | 196 | STYCTYDMH | 202 | AIDSDGTTRYADSV KG | 954 | VCVVGSRWSDY | 942 | FTFSHSGMS | 946 | TINSGGASTYYTDSV KG | 231 | GGSGYGDASRMTSP |

TABLE 1A-continued

| Name | SEQ ID NO: | Sequence of dual VHH dimer | SEQ ID NO: CDR1 | | SEQ ID NO: CDR2 | | SEQ ID NO: CDR3 | | SEQ ID NO: CDR4 | | SEQ ID NO: CDR5 | | SEQ ID NO: CDR6 | |
|---|---|---|---|---|---|---|---|---|---|---|---|---|---|---|
| | | YYCATESVSSFSCGGWLT RPDRVPYWGQGTQVTVSS | | | | | | | | | | | | |
| DR594-hIL27Ra-VHH13 | 609 | QVQLQESGGGSVQAGGSL RLSCVASASTYCTYDMHW YRQAPGKGREFVSAIDSD GTTRYADSVKGRFTISQG TAKNTVYLQMNSLQPEDT AMYYCKTVCVVGSRWSDY WGQGTQVTVSSGGGSQVQ LQESGGGSVQAGGSLRLS CVASGYVSCDYFLPSWYR QAPGKEREFVSIIDGTGS TSYAASVKGRFTASQDRG KNIAYLQMNSLKPEDTAM YYCKASCVRGRTISEYWG QGTQVTVSS | 196 | S T Y C T Y D M H | 202 | AI DS DG TT RY AD SV KG | 954 | VC VV GS RW SD Y | 942 | FTF SHS GMS | 946 | TIN SGG AST YYT DSV KG | 231 | GG SG YG DA SR MT SP |
| DR594-hIL27Ra-VHH14 | 610 | QVQLQESGGGSVQAGGSL RLSCVASASTYCTYDMHW YRQAPGKGREFVSAIDSD GTTRYADSVKGRFTISQG TAKNTVYLQMNSLQPEDT AMYYCKTVCVVGSRWSDY WGQGTQVTVSSGGGSQVQ LQESGGGSVQAGGSLRLS CVASGYVSCDYFLPSWYR QAPGKEREFVSIIDGTGS TSYAASVKGRFTASQDKG KNIAYLQMNSLKPEDTAM YYCKASCVRGRAISEYWG QGTQVTVSS | 196 | S T Y C T Y D M H | 202 | AI DS DG TT RY AD SV KG | 954 | VC VV GS RW SD Y | 942 | FTF SHS GMS | 946 | TIN SGG AST YYT DSV KG | 231 | GG SG YG DA SR MT SP |
| DR594-hIL27Ra-VHH15 | 26 | QVQLQESGGGSVQAGGSL RLSCVASASTYCTYDMHW YRQAPGKGREFVSAIDSD GTTRYADSVKGRFTISQG TAKNTVYLQMNSLQPEDT AMYYCKTVCVVGSRWSDY WGQGTQVTVSSGGGSQVQ LQESGGGSVQAGGSLRLS CVASGYVSCDYFLPSWYR QAPGKEREFVSIIDGTGS TSYAASVKGRFTASQDKG KNIAYLQMNTLKPEDTAM YYCKASCVRGRAISEYWG QGTQVTVSS | 196 | S T Y C T Y D M H | 202 | AI DS DG TT RY AD SV KG | 954 | VC VV GS RW SD Y | 942 | FTF SHS GMS | 946 | TIN SGG AST YYT DSV KG | 231 | GG SG YG DA SR MT SP |
| DR594-hIL27Ra-VHH16 | 611 | QVQLQESGGGSVQAGGSL RLSCVASASTYCTYDMHW YRQAPGKGREFVSAIDSD GTTRYADSVKGRFTISQG TAKNTVYLQMNSLQPEDT AMYYCKTVCVVGSRWSDY WGQGTQVTVSSGGGSQVQ LQESGGGSVQAGGSLRLS CRASGSTYSNYCLGWFRQ ITGKEREGVAVINWVGGM LYFADSVKGRFTVSQDQA KNTVYLQMNSLKPEDTAM YYCAAESASSFSCGGWLT RPDRVPYWGQGTQVTVSS | 196 | S T Y C T Y D M H | 202 | AI DS DG TT RY AD SV KG | 954 | VC VV GS RW SD Y | 942 | FTF SHS GMS | 946 | TIN SGG AST YYT DSV KG | 231 | GG SG YG DA SR MT SP |
| DR594-hIL27Ra-VHH17 | 612 | QVQLQESGGGSVQAGGSL RLSCVASASTYCTYDMHW YRQAPGKGREFVSAIDSD GTTRYADSVKGRFTISQG TAKNTVYLQMNSLQPEDT AMYYCKTVCVVGSRWSDY WGQGTQVTVSSGGGSQVQ LQESGGGLVQPGGSLRLS CAASGFTFSLSGMSWVRQ APGKGLEWVSAISSGGAS TYYTDSVKGRFTISRDNA KNMLYLQLNSLKTEDTAM | 196 | S T Y C T Y D M H | 202 | AI DS DG TT RY AD SV KG | 954 | VC VV GS RW SD Y | 942 | FTF SHS GMS | 946 | TIN SGG AST YYT DSV KG | 231 | GG SG YG DA SR MT SP |

TABLE 1A-continued

| Name | SEQ ID NO: | Sequence of dual VHH dimer | SEQ ID NO: CDR1 | SEQ ID NO: CDR2 | SEQ ID NO: CDR3 | SEQ ID NO: CDR4 | SEQ ID NO: CDR5 | SEQ ID NO: CDR6 |
|---|---|---|---|---|---|---|---|---|
| | | YYCAKGGSYGDASRMTS PGSQGTQVTVSS | | | | | | |
| DR594-hIL27Ra-VHH18 | 613 | QVQLQESGGGSVQAGGSL RLSCVASASTYCTYDMHW YRQAPGKGREFVSAIDSD GTTRYADSVKGRFTISQG TAKNTVYLQMNSLQPEDT AMYYCKTVCVVGSRWSDY WGQGTQVTVSSGGGSQVQ LQESGGGSVQAGGSLRLS CVASGYVSCDYFLPSWYR QAPGKEREFVSIIDGTGS TSYAASVKGRFTASQDKG KNIAYLQMNSLKPEDTAM YYCKASCVRGRGISEYWG QGTQVTVSS | 196 | 202 | 954 | 942 | 946 | 231 |
| | | | S T Y C T Y D M H | AI DS DG TT RY AD SV KG | VC VV GS RW SD Y | FTF SHS GMS | TIN SGG AST YYT DSV KG | GG SG YG DA SR MT SP |
| DR594-hIL27Ra-VHH19 | 27 | QVQLQESGGGSVQAGGSL RLSCVASASTYCTYDMHW YRQAPGKGREFVSAIDSD GTTRYADSVKGRFTISQG TAKNTVYLQMNSLQPEDT AMYYCKTVCVVGSRWSDY WGQGTQVTVSSGGGSQVQ LQESGGGSVQAGGSLRLS CRASGSTYSNYCLGWFRQ ITGKEREGVAVINWVGGM LYFADSVKGRFTVSQDQA KNTVYLQMNSLKPEDTAM YYCAAESVSSFSCGGWLT RPDRVPYWGQGTQVTVSS | 196 | 202 | 954 | 942 | 946 | 231 |
| | | | S T Y C T Y D M H | AI DS DG TT RY AD SV KG | VC VV GS RW SD Y | FTF SHS GMS | TIN SGG AST YYT DSV KG | GG SG YG DA SR MT SP |
| DR594-hIL27Ra-VHH20 | 614 | QVQLQESGGGSVQAGGSL RLSCVASASTYCTYDMHW YRQAPGKGREFVSAIDSD GTTRYADSVKGRFTISQG TAKNTVYLQMNSLQPEDT AMYYCKTVCVVGSRWSDY WGQGTQVTVSSGGGSQVQ LQESGGGLVQPGGSLRLS CAASGFTFSSYPMSWVRQ APGKGLEWVSTISSGGDT TLYADSVKGRFTSSRDNA KNTLYLQLNSLKTEDTAM YYCAKRIDCNSGYCYKRS YWGQGTQVTVSS | 196 | 202 | 954 | 942 | 946 | 231 |
| | | | S T Y C T Y D M H | AI DS DG TT RY AD SV KG | VC VV GS RW SD Y | FTF SHS GMS | TIN SGG AST YYT DSV KG | GG SG YG DA SR MT SP |
| DR594-hIL27Ra-VHH21 | 28 | QVQLQESGGGSVQAGGSL RLSCVASASTYCTYDMHW YRQAPGKGREFVSAIDSD GTTRYADSVKGRFTISQG TAKNTVYLQMNSLQPEDT AMYYCKTVCVVGSRWSDY WGQGTQVTVSSGGGSQVQ LQESGGGLVQPGGSLRLS CAASGFTFSLSSMSWVRQ APGKGLEWVSAISSGGAS TYYTDSVKGRFTISRDNA KNMLYLQLNSLKTEDTAM YYCAKGGSYGDASRMTS PGSQGTQVTVSS | 196 | 202 | 954 | 942 | 946 | 231 |
| | | | S T Y C T Y D M H | AI DS DG TT RY AD SV KG | VC VV GS RW SD Y | FTF SHS GMS | TIN SGG AST YYT DSV KG | GG SG YG DA SR MT SP |
| DR594-hIL27Ra-VHH22 | 615 | QVQLQESGGGSVQAGGSL RLSCVASASTYCTYDMHW YRQAPGKGREFVSAIDSD GTTRYADSVKGRFTISQG TAKNTVYLQMNSLQPEDT AMYYCKTVCVVGSRWSDY WGQGTQVTVSSGGGSQVQ LQESGGGSVQAGGSLRLS CRASGSTYSNYCLGWFRQ TTGKEREGVAVINWVGGM LYFADSVKGRFTVSQDQA KNTVYLQMNSLKPEDTAM | 196 | 202 | 954 | 942 | 946 | 231 |
| | | | S T Y C T Y D M H | AI DS DG TT RY AD SV KG | VC VV GS RW SD Y | FTF SHS GMS | TIN SGG AST YYT DSV KG | GG SG YG DA SR MT SP |

TABLE 1A-continued

| Name | SEQ ID NO: | Sequence of dual VHH dimer | SEQ ID NO: | CDR1 | SEQ ID NO: | CDR2 | SEQ ID NO: | CDR3 | SEQ ID NO: | CDR4 | SEQ ID NO: | CDR5 | SEQ ID NO: | CDR6 |
|---|---|---|---|---|---|---|---|---|---|---|---|---|---|---|
| | | YYCAAESVSSFSCGGWLT RPDRVPYWGQGTQVTSS | | | | | | | | | | | | |
| DR594-hIL27Ra-VHH23 | 616 | QVQLQESGGGSVQAGGSL RLSCVASASTYCTYDMHW YRQAPGKGREFVSAIDSD GTTRYADSVKGRFTISQG TAKNTVYLQMNSLQPEDT AMYYCKTVCVVGSRWSDY WGQGTQVTVSSGGGSQVQ LQESGGGSVQAGGSLRLS CRASRSPYGNYCLGWFRQ STGKEREGVAVINWVGGM LYFADSVKGRFTVSQDHA KNTVTLQMNSLKPEDTAM YYCAAESVSSFSCGGWLT RPDRVPYWGQGTQVTVSS | 196 | STYCTYDMH | 202 | AIDSDGTTRYADSVKG | 954 | VCVVGSRWSDY | 942 | FTFSHSGMS | 946 | TINSGGASTYYTDSVKG | 231 | GGSGYGDASRMTSP |
| DR594-hIL27Ra-VHH24 | 617 | QVQLQESGGGSVQAGGSL RLSCVASASTYCTYDMHW YRQAPGKGREFVSAIDSD GTTRYADSVKGRFTISQG TAKNTVYLQMNSLQPEDT AMYYCKTVCVVGSRWSDY WGQGTQVTVSSGGGSQVQ LQESGGGLVQPGGSLRLS CAASGFTFSHSGMSWVRQ APGKGLEWVSTINSGGAS TYYTDSVKGRFTISRDNA KNMLYLQLNSLKTEDTAM YYCAKGGSGYGDASRMTS PGSQGTQVTVSS | 196 | STYCTYDMH | 202 | AIDSDGTTRYADSVKG | 954 | VCVVGSRWSDY | 942 | FTFSHSGMS | 946 | TINSGGASTYYTDSVKG | 231 | GGSGYGDASRMTSP |
| DR595-hIL27Ra-VHH1 | 29 | QVQLQESGGGSVQAGGSL TLSCAASEYAYSTCNMGW YRQAPGKERELVSAFISD GSTYYADSVKGRFTITRD NAKNTVYLQMNSLKPEDT AIYYCSANCYRRLNYWG QGTQVTVSSGGGSQVQLQ ESGGGLVQPGGSLRLSCA ASGFTFSSYPMSWVRQAP GKGLEWISTISAGGDTTL YADSVKGRFTSSRDNAKN TLYLQLNSLKTEDAAIYY CAKRIDCNSGYCYRRNYW GQGTQVTVSS | 197 | YAYSTCNMG | 203 | AFISDGSTYYADSVKG | 209 | NCYRRLRNY | 942 | FTFSHSGMS | 946 | TINSGGASTYYTDSVKG | 231 | GGSGYGDASRMTSP |
| DR595-hIL27Ra-VHH2 | 618 | QVQLQESGGGSVQAGGSL TLSCAASEYAYSTCNMGW YRQAPGKERELVSAFISD GSTYYADSVKGRFTITRD NAKNTVYLQMNSLKPEDT AIYYCSANCYRRLNYWG QGTQVTVSSGGGSQVQLQ ESGGGLVQPGGSLRLSCA ASGFTFSLSGMSWVRQAP GKGLEWVSAISSGGASTY YTDSVKGRFTISRDNAKN ILYLQLNSLKTEDTAMYY CAKGGSGYGDASRMTSPG SQGTQVTVSS | 197 | YAYSTCNMG | 203 | AFISDGSTYYADSVKG | 209 | NCYRRLRNY | 942 | FTFSHSGMS | 946 | TINSGGASTYYTDSVKG | 231 | GGSGYGDASRMTSP |
| DR595-hIL27Ra-VHH3 | 619 | QVQLQESGGGSVQAGGSL TLSCAASEYAYSTCNMGW YRQAPGKERELVSAFISD GSTYYADSVKGRFTITRD NAKNTVYLQMNSLKPEDT AIYYCSANCYRRLNYWG QGTQVTVSSGGGSQVQLQ ESGGGSVQAGGSLRLSCV ASGYVSCDYFLPSWYRQA PGKEREFVSIIDGTGSTS YAASVKGRFTASEDKGKN IAYLQMNSLKPEDTAMYY | 197 | YAYSTCNMG | 203 | AFISDGSTYYADSVKG | 209 | NCYRRLRNY | 942 | FTFSHSGMS | 946 | TINSGGASTYYTDSVKG | 231 | GGSGYGDASRMTSP |

TABLE 1A-continued

| Name | SEQ ID NO: | Sequence of dual VHH dimer | SEQ ID NO: | CDR1 | SEQ ID NO: | CDR2 | SEQ ID NO: | CDR3 | SEQ ID NO: | CDR4 | SEQ ID NO: | CDR5 | SEQ ID NO: | CDR6 |
|---|---|---|---|---|---|---|---|---|---|---|---|---|---|---|
| | | CKASCVRGRAVSEYWGQGTQVTVSS | | | | | | | | | | | | |
| DR595-hIL27Ra-VHH4 | 30 | QVQLQESGGGSVQAGGSLTLSCAASEYAYSTCNMGWYRQAPGKERELVSAFISDGSTYYADSVKGRFTITRDNAKNTVYLQMNSLKPEDTAIYYCSANCYRRLRNYWGQGTQVTVSSGGGSQVQLQESGGGLVQPGESLRLSCTASGFTFSNYAMSWVRQAPGKGLEWVSGINVAYGITSYADSVKGRFTISRDNTKNTLYLQLNSLKTEDTAIYYCVKHSGTTIPRGFISYTKRGQGTQVTVSS | 197 | YAYSTCNMG | 203 | AFISDGSTYYADSVKG | 209 | NCYRRLRNY | 942 | FTFSHSGMS | 946 | TINSGGASTYYTDSVKG | 231 | GGSGYGDASRMTSP |
| DR595-hIL27Ra-VHH5 | 620 | QVQLQESGGGSVQAGGSLTLSCAASEYAYSTCNMGWYRQAPGKERELVSAFISDGSTYYADSVKGRFTITRDNAKNTVYLQMNSLKPEDTAIYYCSANCYRRLRNYWGQGTQVTVSSGGGSQVQLQESGGGSVQAGGSLRLSCTASGYVSCDYFLPSWYRQAPGKEREFVSVIDGTGSTSYAASVKGRFTASQDKGKNTAYLQMNSLKPEDTAMYYCKASCVRGRAISEYWGQGTQVTVSS | 197 | YAYSTCNMG | 203 | AFISDGSTYYADSVKG | 209 | NCYRRLRNY | 942 | FTFSHSGMS | 946 | TINSGGASTYYTDSVKG | 231 | GGSGYGDASRMTSP |
| DR595-hIL27Ra-VHH6 | 31 | QVQLQESGGGSVQAGGSLTLSCAASEYAYSTCNMGWYRQAPGKERELVSAFISDGSTYYADSVKGRFTITRDNAKNTVYLQMNSLKPEDTAIYYCSANCYRRLRNYWGQGTQVTVSSGGGSQVQLQESGGGLVQPGGSLRLSCAASGFSFSSYAMKWVRQAPGKGLEWVSTISSGGSSTNYADSVKGRFTISRDNAKNTLYLQLNSLKIEDTAMYYCAKAIVPTGATMERGQGTQVTVSS | 197 | YAYSTCNMG | 203 | AFISDGSTYYADSVKG | 209 | NCYRRLRNY | 942 | FTFSHSGMS | 946 | TINSGGASTYYTDSVKG | 231 | GGSGYGDASRMTSP |
| DR595-hIL27Ra-VHH7 | 621 | QVQLQESGGGSVQAGGSLTLSCAASEYAYSTCNMGWYRQAPGKERELVSAFISDGSTYYADSVKGRFTITRDNAKNTVYLQMNSLKPEDTAIYYCSANCYRRLRNYWGQGTQVTVSSGGGSQVQLQESGGGLVQPGGSLRLSCAASGFTFSSYPMSWVRQAPGKGLEWISTISAGGDTTLYADSVKGRFTSSRDNAKNTLYLQLNSLKTEDTAIYYCAKRIDCNSGYCYRRNYWGQGTQVTVSS | 197 | YAYSTCNMG | 203 | AFISDGSTYYADSVKG | 209 | NCYRRLRNY | 942 | FTFSHSGMS | 946 | TINSGGASTYYTDSVKG | 231 | GGSGYGDASRMTSP |
| DR595-hIL27Ra-VHH8 | 622 | QVQLQESGGGSVQAGGSLTLSCAASEYAYSTCNMGWYRQAPGKERELVSAFISDGSTYYADSVKGRFTITRDNAKNTVYLQMNSLKPEDTAIYYCSANCYRRLRNYWGQGTQVTVSSGGGSQVQLQESGGGSVQVGGSLRLSCAASGFTFSSYPMSWVRQAPGKGLEWISTISAGGDTTLYADSVKGRFTSSRDNAKNTLYLQLNSLKTEDTAIYY | 197 | YAYSTCNMG | 203 | AFISDGSTYYADSVKG | 209 | NCYRRLRNY | 942 | FTFSHSGMS | 946 | TINSGGASTYYTDSVKG | 231 | GGSGYGDASRMTSP |

TABLE 1A-continued

| Name | SEQ ID NO: | Sequence of dual VHH dimer | SEQ ID NO: CDR1 | CDR1 | SEQ ID NO: CDR2 | CDR2 | SEQ ID NO: CDR3 | CDR3 | SEQ ID NO: CDR4 | CDR4 | SEQ ID NO: CDR5 | CDR5 | SEQ ID NO: CDR6 | CDR6 |
|---|---|---|---|---|---|---|---|---|---|---|---|---|---|---|
| | | CAKRIDCNSGYCYRRNYWGQGTQVTVSS | | | | | | | | | | | | |
| DR595-hIL27Ra-VHH9 | 32 | QVQLQESGGGSVQAGGSLTLSCAASEYAYSTCNMGWYRQAPGKERELVSAFISDGSTYYADSVKGRFTITRDNAKNTVYLQMNSLKPEDTAIYYCSANCYRRLRNYWGQGTQVTVSSGGGSQVQLQESGGGSVQSGGSLRLSCAASGFTYSTSNSWMAWFRQAPGKEREGVAAIYTVGGSIFYADSVRGRFTISQDATKNMFYLQMNTLKPEDTAMYYCAAASGRLRGKWFWPYEYNYWGQGTQVTVSS | 197 | YAYSTCNMG | 203 | AFYSDSTYYADSVKG | 209 | NCYRRLRNY | 942 | FTFSHSGMS | 946 | TINSGGASTYYTDSVKG | 231 | GGSGYGDASRMTSP |
| DR595-hIL27Ra-VHH10 | 623 | QVQLQESGGGSVQAGGSLTLSCAASEYAYSTCNMGWYRQAPGKERELVSAFISDGSTYYADSVKGRFTITRDNAKNTVYLQMNSLKPEDTAIYYCSANCYRRLRNYWGQGTQVTVSSGGGSQVQLQESGGGSVQAGGSLRLSCRASGSTYSNYCLGWFRQITGKEREGVAVINWVGGMLYFADSVKGRFTVSQDQAKNTLYLQMNSLKPEDTAMYYCAAESVSSFSCGGWLTRPDRVPYWGQGTQVTVSS | 197 | YAYSTCNMG | 203 | AFYSDSTYYADSVKG | 209 | NCYRRLRNY | 942 | FTFSHSGMS | 946 | TINSGGASTYYTDSVKG | 231 | GGSGYGDASRMTSP |
| DR595-hIL27Ra-VHH11 | 624 | QVQLQESGGGSVQAGGSLTLSCAASEYAYSTCNMGWYRQAPGKERELVSAFISDGSTYYADSVKGRFTITRDNAKNTVYLQMNSLKPEDTAIYYCSANCYRRLRNYWGQGTQVTVSSGGGSQVQLQESGGGSVQAGGSLRLSCRASGSTYSNYCLGWFRQSTGKEREGVAVINWVGGMLYFADSVKGRFTVSQDHAKNTVTLQMNSLKPEDTAMYYCAAESVSSFSCGGWLTRPGRVPYWGQGTQVTVSS | 197 | YAYSTCNMG | 203 | AFYSDSTYYADSVKG | 209 | NCYRRLRNY | 942 | FTFSHSGMS | 946 | TINSGGASTYYTDSVKG | 231 | GGSGYGDASRMTSP |
| DR595-hIL27Ra-VHH12 | 625 | QVQLQESGGGSVQAGGSLTLSCAASEYAYSTCNMGWYRQAPGKERELVSAFISDGSTYYADSVKGRFTITRDNAKNTVYLQMNSLKPEDTAIYYCSANCYRRLRNYWGQGTQVTVSSGGGSQVQLQESGGGSVQAGESLRLSCRASGSTYSNYCLGWFRQITGKEREGVAVINWVGGMLYFADSVKGRFTVSQDQAKNTVYLEMNSLKPEDTAMYYCATESVSSFSCGGWLTRPDRVPYWGQGTQVTVSS | 197 | YAYSTCNMG | 203 | AFYSDSTYYADSVKG | 209 | NCYRRLRNY | 942 | FTFSHSGMS | 946 | TINSGGASTYYTDSVKG | 231 | GGSGYGDASRMTSP |
| DR595-hIL27Ra-VHH13 | 626 | QVQLQESGGGSVQAGGSLTLSCAASEYAYSTCNMGWYRQAPGKERELVSAFISDGSTYYADSVKGRFTITRDNAKNTVYLQMNSLKPEDTAIYYCSANCYRRLRNYWGQGTQVTVSSGGGSQVQLQESGGGSVQAGGSLRLSCVASGYVSCDYFLPSWYRQAPGKEREFVSIIDGTGSTSYAASVKGRFTASDRGKNIAYLQMNSLKPEDTAMYY | 197 | YAYSTCNMG | 203 | AFYSDSTYYADSVKG | 209 | NCYRRLRIY | 942 | FTFSHSGMS | 946 | TINSGGASTYYTDSVKG | 231 | GGSGYGDASRMTSP |

TABLE 1A-continued

| Name | SEQ ID NO: | Sequence of dual VHH dimer | SEQ ID NO: | CDR1 | SEQ ID NO: | CDR2 | SEQ ID NO: | CDR3 | SEQ ID NO: | CDR4 | SEQ ID NO: | CDR5 | SEQ ID NO: | CDR6 |
|---|---|---|---|---|---|---|---|---|---|---|---|---|---|---|
| | | CKASCVRGRTISEYWGQG TQVTVSS | | | | | | | | | | | | |
| DR595-hIL27Ra-VHH14 | 627 | QVQLQESGGGSVQAGGSL TLSCAASEYAYSTCNMGW YRQAPGKERELVSAFISD GSTYYADSVKGRFTITRD NAKNTVYLQMNSLKPEDT AIYYCSANCYRRLRNYWG QGTQVTVSSGGGSQVQLQ ESGGGSVQAGGSLRLSCV ASGYVSCDYFLPSWYRQA PGKEREFVSIIDGTGSTS YAASVKGRFTASQDKGKN IAYLQMNSLKPEDTAMYY CKASCVRGRAISEYWGQG TQVTVSS | 197 | YAYSTCNMG | 203 | AFISDGSTYYADSVKG | 209 | NCYRRLRNY | 942 | FTFSHSGMS | 946 | TINSGGASTYYTDSVKG | 231 | GGSGYGDASRMTSP |
| DR595-hIL27Ra-VHH15 | 33 | QVQLQESGGGSVQAGGSL TLSCAASEYAYSTCNMGW YRQAPGKERELVSAFISD GSTYYADSVKGRFTITRD NAKNTVYLQMNSLKPEDT AIYYCSANCYRRLRNYWG QGTQVTVSSGGGSQVQLQ ESGGGSVQAGGSLRLSCV ASGYVSCDYFLPSWYRQA PGKEREFVSIIDGTGSTS YAASVKGRFTASQDKGKN IAYLQMNTLKPEDTAMYY CKASCVRGRAISEYWGQG TQVTVSS | 197 | YAYSTCNMG | 203 | AFISDGSTYYADSVKG | 209 | NCYRRLRIY | 942 | FTFSHSGMS | 946 | TINSGGASTYYTDSVKG | 231 | GGSGYGDASRMTSP |
| DR595-hIL27Ra-VHH16 | 628 | QVQLQESGGGSVQAGGSL TLSCAASEYAYSTCNMGW YRQAPGKERELVSAFISD GSTYYADSVKGRFTITRD NAKNTVYLQMNSLKPEDT AIYYCSANCYRRLRNYWG QGTQVTVSSGGGSQVQLQ ESGGGSVQAGGSLRLSCR ASGSTYSNYCLGWFRQIT GKEREGVAVINWVGGMLY FADSVKGRFTVSQDQAKN TVYLQMNSLKPEDTAMYY CAAESASSFSCGGWLTRP DRVPYWGQGTQVTVSS | 197 | YAYSTCNMG | 203 | AFISDGSTYYADSVKG | 209 | NCYRRLRNY | 942 | FTFSHSGMS | 946 | TINSGGASTYYTDSVKG | 231 | GGSGYGDASRMTSP |
| DR595-hIL27Ra-VHH17 | 629 | QVQLQESGGGSVQAGGSL TLSCAASEYAYSTCNMGW YRQAPGKERELVSAFISD GSTYYADSVKGRFTITRD NAKNTVYLQMNSLKPEDT AIYYCSANCYRRLRNYWG QGTQVTVSSGGGSQVQLQ ESGGGLVQPGGSLRLSCA ASGFTFSLSGMSWVRQAP GKGLEWVSAISSGGASTY YTDSVKGRFTISRDNAKN MLYLQLNSLKTEDTAMYY CAKGGSYGDASRMTSPG SQGTQVTVSS | 197 | YAYSTCNMG | 203 | AFISDGSTYYADSVKG | 209 | NCYRRLRNY | 942 | FTFSHSGMS | 946 | TINSGGASTYYTDSVKG | 231 | GGSGYGDASRMTSP |
| DR595-hIL27Ra-VHH18 | 630 | QVQLQESGGGSVQAGGSL TLSCAASEYAYSTCNMGW YRQAPGKERELVSAFISD GSTYYADSVKGRFTITRD NAKNTVYLQMNSLKPEDT AIYYCSANCYRRLRNYWG QGTQVTVSSGGGSQVQLQ ESGGGSVQAGGSLRLSCV ASGYVSCDYFLPSWYRQA PGKEREFVSIIDGTGSTS YAASVKGRFTASQDKGKN IAYLQMNSLKPEDTAMYY | 197 | YAYSTCNMG | 203 | AFISDGSTYYADSVKG | 209 | NCYRRLRNY | 942 | FTFSHSGMS | 946 | TINSGGASTYYTDSVKG | 231 | GGSGYGDASRMTSP |

TABLE 1A-continued

| Name | SEQ ID NO: | Sequence of dual VHH dimer | SEQ ID NO: CDR1 | CDR1 | SEQ ID NO: CDR2 | CDR2 | SEQ ID NO: CDR3 | CDR3 | SEQ ID NO: CDR4 | CDR4 | SEQ ID NO: CDR5 | CDR5 | SEQ ID NO: CDR6 | CDR6 |
|---|---|---|---|---|---|---|---|---|---|---|---|---|---|---|
| | | CKASCVRGRGISEYWGQGTQVTVSS | | | | | | | | | | | | |
| DR595-hIL27Ra-VHH19 | 34 | QVQLQESGGGSVQAGGSLTLSCAASEYAYSTCNMGWYRQAPGKERELVSAFISDGSTYYADSVKGRFTITRDNAKNTVYLQMNSLKPEDTAIYYCSANCYRRLRNYWGQGTQVTVSSGGGSQVQLQESGGGSVQAGGSLRLSCRASGSTYSNYCLGWFRQITGKEREGVAVINWVGGMLYFADSVKGRFTVSQDQAKNTVYLQMNSLKPEDTAMYYCAAESVSSFSCGGWLTRPDRVPYWGQGTQVTVSS | 197 | YAYSTCNMG | 203 | AFISDGSTYYADSVKG | 209 | NCYRRLRNY | 942 | FTFSHSGMS | 946 | TINSGGASTYYTDSVKG | 231 | GGSGYGDASRMTSP |
| DR595-hIL27Ra-VHH20 | 631 | QVQLQESGGGSVQAGGSLTLSCAASEYAYSTCNMGWYRQAPGKERELVSAFISDGSTYYADSVKGRFTITRDNAKNTVYLQMNSLKPEDTAIYYCSANCYRRLRNYWGQGTQVTVSSGGGSQVQLQESGGGLVQPGGSLRLSCAASGFTFSSYPMSWVRQAPGKGLEWVSTISSGGDTTLYADSVKGRFTSSRDNAKNTLYLQLNSLKTEDTAMYYCAKRIDCNSGYCYKRSYWGQGTQVTVSS | 197 | YAYSTCNMG | 203 | AFISDGSTYYADSVKG | 209 | NCYRRLRNY | 942 | FTFSHSGMS | 946 | TINSGGASTYYTDSVKG | 231 | GGSGYGDASRMTSP |
| DR595-hIL27Ra-VHH21 | 35 | QVQLQESGGGSVQAGGSLTLSCAASEYAYSTCNMGWYRQAPGKERELVSAFISDGSTYYADSVKGRFTITRDNAKNTVYLQMNSLKPEDTAIYYCSANCYRRLRNYWGQGTQVTVSSGGGSQVQLQESGGGLVQPGGSLRLSCAASGFTFSLSSMSWVRQAPGKGLEWVSAISSGGASTYYTDSVKGRFTISRDNAKNMLYLQLNSLKTEDTAMYYCAKGGSGYGDASRMTSPGSQGTQVTVSS | 197 | YAYSTCNMG | 203 | AFISDGSTYYADSVKG | 209 | NCYRRLRNY | 942 | FTFSHSGMS | 946 | TINSGGASTYYTDSVKG | 231 | GGSGYGDASRMTSP |
| DR595-hIL27Ra-VHH22 | 632 | QVQLQESGGGSVQAGGSLTLSCAASEYAYSTCNMGWYRQAPGKERELVSAFISDGSTYYADSVKGRFTITRDNAKNTVYLQMNSLKPEDTAIYYCSANCYRRLRNYWGQGTQVTVSSGGGSQVQLQESGGGSVQAGGSLRLSCRASGSTYSNYCLGWFRQTTGKEREGVAVINWVGGMLYFADSVKGRFTVSQDQAKNTVYLQMNSLKPEDTAMYYCAAESVSSFSCGGWLTRPDRVPYWGQGTQVTVSS | 197 | YAYSTCNMG | 203 | AFISDGSTYYADSVKG | 209 | NCYRRLRNY | 942 | FTFSHSGMS | 946 | TINSGGASTYYTDSVKG | 231 | GGSGYGDASRMTSP |
| DR595-hIL27Ra-VHH23 | 633 | QVQLQESGGGSVQAGGSLTLSCAASEYAYSTCNMGWYRQAPGKERELVSAFISDGSTYYADSVKGRFTITRDNAKNTVYLQMNSLKPEDTAIYYCSANCYRRLRNYWGQGTQVTVSSGGGSQVQLQESGGGSVQAGGSLRLSCRASRSPYGNYCLGWFRQSTGKEREGVAVINWVGGMLYFADSVKGRFTVSQDHAKNTVTLQMNSLKPEDTAMYY | 197 | YAYSTCNMG | 203 | AFISDGSTYYADSVKG | 209 | NCYRRLRNY | 942 | FTFSHSGMS | 946 | TINSGGASTYYTDSVKG | 231 | GGSGYGDASRMTSP |

TABLE 1A-continued

| Name | SEQ ID NO: | Sequence of dual VHH dimer | SEQ ID NO: | CDR1 | SEQ ID NO: | CDR2 | SEQ ID NO: | CDR3 | SEQ ID NO: | CDR4 | SEQ ID NO: | CDR5 | SEQ ID NO: | CDR6 |
|---|---|---|---|---|---|---|---|---|---|---|---|---|---|---|
| | | CAAESVSSFSCGGWLTRP DRVPYWGQGTQVTVSS | | | | | | | | | | | | |
| DR595-hIL27Ra-VHH24 | 634 | QVQLQESGGGSVQAGGSL TLSCAASEYAYSTCNMGW YRQAPGKERELVSAFISD GSTYYADSVKGRFTITRD NAKNTVYLQMNSLKPEDT AIYYCSANCYRRLRNYWG QGTQVTVSSGGGSQVQLQ ESGGGLVQPGGSLRLSCA ASGFTFSHSGMSWVRQAP GKGLEWVSTINSGGASTY YTDSVKGRFTISRDNAKN MLYLQLNSLKTEDTAMYY CAKGGSGYGDASRMTSPG SQGTQVTVSS | 197 | YAYSTCNMG | 203 | AFISDGSTYYADSVKG | 209 | NCYRRLRNY | 942 | FTFSHSGMS | 946 | TINSGGASTYYTDSVKG | 231 | GGSGYGDASRMTSP |
| DR596-hIL27Ra-VHH1 | 36 | QVQLQESGGGLVQPGGSL RLSCTASGLTFDDSVMGW FRQAPGKGREAVSCISSS GANAFYADSVKGRFTISR DNAKNTLYLQMNSLKPED TATYYCKRGHACAGYYPI PYDDYWGQGTQVTVSSGG GSQVQLQESGGGLVQPGG SLRLSCAASGFTFSSYPM SWVRQAPGKGLEWISTIS AGGDTTLYADSVKGRFTS SRDNAKNTLYLQLNSLKT EDAAIYYCAKRIDCNSGY CYRRNYWGQGTQVTVSS | 198 | LTFDDSVMG | 204 | CISSSGANAFYADSVKG | 210 | GHACAGYYPIPYDDY | 942 | FTFSHSGMS | 946 | TINSGGASTYYTDSVKG | 231 | GGSGYGDASRMTSP |
| DR596-hIL27Ra-VHH2 | 635 | QVQLQESGGGLVQPGGSL RLSCTASGLTFDDSVMGW FRQAPGKGREAVSCISSS GANAFYADSVKGRFTISR DNAKNTLYLQMNSLKPED TATYYCKRGHACAGYYPI PYDDYWGQGTQVTVSSGG GSQVQLQESGGGLVQPGG SLRLSCAASGFTFSLGM SWVRQAPGKGLEWVSAIS SGGASTYYTDSVKGRFTI SRDNAKNILYLQLNSLKT EDTAMYYCAKGGSGYGDA SRMTSPGSQGTQVTVSS | 198 | LTFDDSVMG | 204 | CISSSGANAFYADSVKG | 210 | GHACAGYYPIPYDDY | 942 | FTFSHSGMS | 946 | TINSGGASTYYTDSVKG | 231 | GGSGYGDASRMTSP |
| DR596-hIL27Ra-VHH3 | 636 | QVQLQESGGGLVQPGGSL RLSCTASGLTFDDSVMGW FRQAPGKGREAVSCISSS GANAFYADSVKGRFTISR DNAKNTLYLQMNSLKPED TATYYCKRGHACAGYYPI PYDDYWGQGTQVTVSSGG GSQVQLQESGGGSVQAGG SLRLSCVASGYVSCDYFL PSWYRQAPGKEREFVSII DGTGSTSYAASVKGRFTA SEDKGKNIAYLQMNSLKP EDTAMYYCKASCVRGRAV SEYWGQGTQVTVSS | 198 | LTFDDSVMG | 204 | CISSSGANAFYADSVKG | 210 | GHACAGYYPIPYDDY | 942 | FTFSHSGMS | 946 | TINSGGASTYYTDSVKG | 231 | GGSGYGDASRMTSP |
| DR596-hIL27Ra-VHH4 | 37 | QVQLQESGGGLVQPGGSL RLSCTASGLTFDDSVMGW FRQAPGKGREAVSCISSS GANAFYADSVKGRFTISR DNAKNTLYLQMNSLKPED TATYYCKRGHACAGYYPI PYDDYWGQGTQVTVSSGG GSQVQLQESGGGLVQPGE SLRLSCTASGFTFSNYAM SWVRQAPGKGLEWVSGIN VAYGITSYADSVKGRFTI SRDNTKNTLYLQLNSLKT | 198 | LTFDDSVMG | 204 | CISSSGANAFYADSVKG | 210 | GHACAGYYPIPYDDY | 942 | FTFSHSGMS | 946 | TINSGGASTYYTDSVKG | 231 | GGSGYGDASRMTSP |

TABLE 1A-continued

| Name | SEQ ID NO: | Sequence of dual VHH dimer | SEQ ID NO: | CDR1 | SEQ ID NO: | CDR2 | SEQ ID NO: | CDR3 | SEQ ID NO: | CDR4 | SEQ ID NO: | CDR5 | SEQ ID NO: | CDR6 |
|---|---|---|---|---|---|---|---|---|---|---|---|---|---|---|
| | | EDTAIYYCVKHSGTTIPR GFISYTKRGQGTQVTVSS | | | | | | | | | | | | |
| DR596-hIL27Ra-VHH5 | 637 | QVQLQESGGGLVQPGGSL RLSCTASGLTFDDSVMGW FRQAPGKGREAVSCISSS GANAFYADSVKGRFTISR DNAKNTLYLQMNSLKPED TATYYCKRGHACAGYYPI PYDDYWGQGTQVTVSSGG GSQVQLQESGGGSVQAGG SLRLSCTASGYVSCDYFL PSWYRQAPGKEREFVSVI DGTGSTSYAASVKGRFTA SQDKGKNIAYLQMNSLKP EDTAMYYCKASCVRGRAI SEYWGQGTQVTVSS | 198 | L T F D D S V M G | 204 | CI SS SG AN AF YA DS VK G | 210 | GH AC AG YY PI PY DD Y | 942 | FTF SHS GMS | 946 | TIN SGG AST YYT DSV KG | 231 | GG SG YG DA SR MT SP |
| DR596-hIL27Ra-VHH6 | 38 | QVQLQESGGGLVQPGGSL RLSCTASGLTFDDSVMGW FRQAPGKGREAVSCISSS GANAFYADSVKGRFTISR DNAKNTLYLQMNSLKPED TATYYCKRGHACAGYYPI PYDDYWGQGTQVTVSSGG GSQVQLQESGGGLVQPGG SLRLSCAASGFSFSSYAM KWVRQAPGKGLEWVSTIS SGGSSTNYADSVKGRFTI SRDNAKNTLYLQLNSLKI EDTAMYYCAKAIVPTGAT MERGQGTQVTVSS | 198 | L T F D D S V M G | 204 | CI SS SG AN AF YA DS VK G | 210 | GH AC AG YY PI PY DD Y | 942 | FTF SHS GMS | 946 | TIN SGG AST YYT DSV KG | 231 | GG SG YG DA SR MT SP |
| DR596-hIL27Ra-VHH7 | 638 | QVQLQESGGGLVQPGGSL RLSCTASGLTFDDSVMGW FRQAPGKGREAVSCISSS GANAFYADSVKGRFTISR DNAKNTLYLQMNSLKPED TATYYCKRGHACAGYYPI PYDDYWGQGTQVTVSSGG GSQVQLQESGGGLVQPGG SLRLSCAASGFTFSSYPM SWVRQAPGKGLEWISTIS AGGDTTLYADSVKGRFTS SRDNAKNTLYLQLNSLKT EDTAIYYCAKRIDCNSGY CYRRNYWGQGTQVTVSS | 198 | L T F D D S V M G | 204 | CI SS SG AN AF YA DS VK G | 210 | GH AC AG YY PI PY DD Y | 942 | FTF SHS GMS | 946 | TIN SGG AST YYT DSV KG | 231 | GG SG YG DA SR MT SP |
| DR596-hIL27Ra-VHH8 | 639 | QVQLQESGGGLVQPGGSL RLSCTASGLTFDDSVMGW FRQAPGKGREAVSCISSS GANAFYADSVKGRFTISR DNAKNTLYLQMNSLKPED TATYYCKRGHACAGYYPI PYDDYWGQGTQVTVSSGG GSQVQLQESGGGSVQVGG SLRLSCAASGFTFSSYPM SWVRQAPGKGLEWISTIS AGGDTTLYADSVKGRFTS SRDNAKNTLYLQLNSLKT EDTAIYYCAKRIDCNSGY CYRRNYWGQGTQVTVSS | 198 | L T F D D S V M G | 204 | CI SS SG AN AF YA DS VK G | 210 | GH AC AG YY PI PY DD Y | 942 | FTF SHS GMS | 946 | TIN SGG AST YYT DSV KG | 231 | GG SG YG DA SR MT SP |
| DR596-hIL27Ra-VHH9 | 39 | QVQLQESGGGLVQPGGSL RLSCTASGLTFDDSVMGW FRQAPGKGREAVSCISSS GANAFYADSVKGRFTISR DNAKNTLYLQMNSLKPED TATYYCKRGHACAGYYPI PYDDYWGQGTQVTVSSGG GSQVQLQESGGGSVQSGG SLRLSCAASGFTYSTSNS WMAWFRQAPGKEREGVAA IYTVGGSIFYADSVRGRF TISQDATKNMFYLQMNTL KPEDTAMYYCAAASGRLR | 198 | L T F D D S V M G | 204 | CI SS SG AN AF YA DS VK G | 210 | GH AC AG YY PI PY DD Y | 942 | FTF SHS GMS | 946 | TIN SGG AST YYT DSV KG | 231 | GG SG YG DA SR MT SP |

TABLE 1A-continued

| Name | SEQ ID NO: | Sequence of dual VHH dimer | SEQ ID NO: | CDR1 | SEQ ID NO: | CDR2 | SEQ ID NO: | CDR3 | SEQ ID NO: | CDR4 | SEQ ID NO: | CDR5 | SEQ ID NO: | CDR6 |
|---|---|---|---|---|---|---|---|---|---|---|---|---|---|---|
| | | GKWFWPYEYNYWGQGTQVTVSS | | | | | | | | | | | | |
| DR596-hIL27Ra-VHH10 | 640 | QVQLQESGGGLVQPGGSLRLSCTASGLTFDDSVMGWFRQAPGKGREAVSCISSSGANAFYADSVKGRFTISRDNAKNTLYLQMNSLKPEDTATYYCKRGHACAGYYPIPYDDYWGQGTQVTVSSGGGSQVQLQESGGGSVQAGGSLRLSCRASGSTYSNYCLGWFRQITGKEREGVAVINWVGGMLYFADSVKGRFTVSQDQAKNTLYLQMNSLKPEDTAMYYCAAESVSSFSCGGWLTRPDRVPYWGQGTQVTVSS | 198 | LTFDDSVMG | 204 | CISSSGANAFYADSVKG | 210 | GHACAGYYPIPYDDY | 942 | FTFSHSGMS | 946 | TINSGGASTYYTDSVKG | 231 | GGSGYGDASRMTSP |
| DR596-hIL27Ra-VHH11 | 641 | QVQLQESGGGLVQPGGSLRLSCTASGLTFDDSVMGWFRQAPGKGREAVSCISSSGANAFYADSVKGRFTISRDNAKNTLYLQMNSLKPEDTATYYCKRGHACAGYYPIPYDDYWGQGTQVTVSSGGGSQVQLQESGGGSVQAGGSLRLSCRASGSTYSNYCLGWFRQSTGKEREGVAVINWVGGMLYFADSVKGRFTVSQDHAKNTVTLQMNSLKPEDTAMYYCAAESVSSFSCGGWLTRPGRVPYWGQGTQVTVSS | 198 | LTFDDSVMG | 204 | CISSSGANAFYADSVKG | 210 | GHACAGYYPIPYDDY | 942 | FTFSHSGMS | 946 | TINSGGASTYYTDSVKG | 231 | GGSGYGDASRMTSP |
| DR596-hIL27Ra-VHH12 | 642 | QVQLQESGGGLVQPGGSLRLSCTASGLTFDDSVMGWFRQAPGKGREAVSCISSSGANAFYADSVKGRFTISRDNAKNTLYLQMNSLKPEDTATYYCKRGHACAGYYPIPYDDYWGQGTQVTVSSGGGSQVQLQESGGGSVQAGESLRLSCRASGSTYSNYCLGWFRQITGKEREGVAVINWVGGMLYFADSVKGRFTVSQDQAKNTVYLEMNSLKPEDTAMYYCATESVSSFSCGGWLTRPDRVPYWGQGTQVTVSS | 198 | LTFDDSVMG | 204 | CISSSGANAFYADSVKG | 210 | GHACAGYYPIPYDDY | 942 | FTFSHSGMS | 946 | TINSGGASTYYTDSVKG | 231 | GGSGYGDASRMTSP |
| DR596-hIL27Ra-VHH13 | 643 | QVQLQESGGGLVQPGGSLRLSCTASGLTFDDSVMGWFRQAPGKGREAVSCISSSGANAFYADSVKGRFTISRDNAKNTLYLQMNSLKPEDTATYYCKRGHACAGYYPIPYDDYWGQGTQVTVSSGGGSQVQLQESGGGSVQAGGSLRLSCVASGYVSCDYFLPSWYRQAPGKEREFVSIIDGTGSTSYAASVKGRFTASQDRGKNIAYLQMNSLKPEDTAMYYCKASCVRGRTISEYWGQGTQVTVSS | 198 | LTFDDSVMG | 204 | CISSSGANAFYADSVKG | 210 | GHACAGYYPIPYDDY | 942 | FTFSHSGMS | 946 | TINSGGASTYYTDSVKG | 231 | GGSGYGDASRMTSP |
| DR596-hIL27Ra-VHH14 | 644 | QVQLQESGGGLVQPGGSLRLSCTASGLTFDDSVMGWFRQAPGKGREAVSCISSSGANAFYADSVKGRFTISRDNAKNTLYLQMNSLKPEDTATYYCKRGHACAGYYPIPYDDYWGQGTQVTVSSGGGSQVQLQESGGGSVQAGGSLRLSCVASGYVSCDYFLPSWYRQAPGKEREFVSII | 198 | LTFDDSVMG | 204 | CISSSGANAFYADSVKG | 210 | GHACAGYYPIPYDDY | 942 | FTFSHSGMS | 2 | TINSGGASTYYTDSVKG | 3 | GGSGYGDASRMTSP |

TABLE 1A-continued

| Name | SEQ ID NO: | Sequence of dual VHH dimer | SEQ ID NO: | CDR1 | SEQ ID NO: | CDR2 | SEQ ID NO: | CDR3 | SEQ ID NO: | CDR4 | SEQ ID NO: | CDR5 | SEQ ID NO: | CDR6 |
|---|---|---|---|---|---|---|---|---|---|---|---|---|---|---|
| | | DGTGSTSYAASVKGRFTA SQDKGKNIAYLQMNSLKP EDTAMYYCKASCVRGRAI SEYWGQGTQVTVSS | | | | | | | | | | | | |
| DR596-hIL27Ra-VHH15 | 40 | QVQLQESGGGLVQPGGSL RLSCTASGLTFDDSVMGW FRQAPGKGREAVSCISSS GANAFYADSVKGRFTISR DNAKNTLYLQMNSLKPED TATYYCKRGHACAGYYPI PYDDYWGQGTQVTVSSGG GSQVQLQESGGGSVQAGG SLRLSCVASGYVSCDYFL PSWYRQAPGKEREFVSII DGTGSTSYAASVKGRFTA SQDKGKNIAYLQMNTLKP EDTAMYYCKASCVRGRAI SEYWGQGTQVTVSS | 198 | L T F D D S V M G | 204 | CI SS SG AN AF YA DS VK G | 210 | GH AC AG YY PI PY DD Y | 942 | FTF SHS GMS | 946 | TIN SGG AST YYT DSV KG | 231 | GG SG YG DA SR MT SP |
| DR596-hIL27Ra-VHH16 | 645 | QVQLQESGGGLVQPGGSL RLSCTASGLTFDDSVMGW FRQAPGKGREAVSCISSS GANAFYADSVKGRFTISR DNAKNTLYLQMNSLKPED TATYYCKRGHACAGYYPI PYDDYWGQGTQVTVSSGG GSQVQLQESGGGSVQAGG SLRLSCRASGSTYSNYCL GWFRQITGKEREGVAVIN WVGGMLYFADSVKGRFTV SQDQAKNTVYLQMNSLKP EDTAMYYCAAESASSFSC GGWLTRPDRVPYWGQGTQ VTVSS | 198 | L T F D D S V M G | 204 | CI SS SG Al AF YA DS VK G | 210 | GH AC AG YY PI PY DD Y | 942 | FTF SHS GMS | 946 | TIN SGG AST YYT DSV KG | 231 | GG SG YG DA SR MT SP |
| DR596-hIL27Ra-VHH17 | 646 | QVQLQESGGGLVQPGGSL RLSCTASGLTFDDSVMGW FRQAPGKGREAVSCISSS GANAFYADSVKGRFTISR DNAKNTLYLQMNSLKPED TATYYCKRGHACAGYYPI PYDDYWGQGTQVTVSSGG GSQVQLQESGGGLVQPGG SLRLSCAASGFTFSLSGM SWVRQAPGKGLEWVSAIS SGGASTYYTDSVKGRFTI SRDNAKNMLYLQLNSLKT EDTAMYYCAKGGSGYGDA SRMTSPGSQGTQVTVSS | 198 | L T F D D S V M G | 204 | CI SS SG AN AF YA DS VK G | 210 | GH AC AG YY PI PY DD Y | 942 | FTF SHS GMS | 946 | TIN SGG AST YYT DSV KG | 231 | GG SG YG DA SR MT SP |
| DR596-hIL27Ra-VHH18 | 647 | QVQLQESGGGLVQPGGSL RLSCTASGLTFDDSVMGW FRQAPGKGREAVSCISSS GANAFYADSVKGRFTISR DNAKNTLYLQMNSLKPED TATYYCKRGHACAGYYPI PYDDYWGQGTQVTVSSGG GSQVQLQESGGGSVQAGG SLRLSCVASGYVSCDYFL PSWYRQAPGKEREFVSII DGTGSTSYAASVKGRFTA SQDKGKNIAYLQMNSLKP EDTAMYYCKASCVRGRGI SEYWGQGTQVTVSS | 198 | L T F D D S V M G | 204 | CI SS SG AN AF YA DS VK G | 210 | GH AC AG YY PI PY DD Y | 942 | FTF SHS GMS | 946 | TIN SGG AST YYT DSV KG | 231 | GG SG YG DA SR MT SP |
| DR596-hIL27Ra-VHH19 | 41 | QVQLQESGGGLVQPGGSL RLSCTASGLTFDDSVMGW FRQAPGKGREAVSCISSS GANAFYADSVKGRFTISR DNAKNTLYLQMNSLKPED TATYYCKRGHACAGYYPI PYDDYWGQGTQVTVSSGG GSQVQLQESGGGSVQAGG SLRLSCRASGSTYSNYCL GWFRQITGKEREGVAVIN | 198 | L T F D D S V M G | 204 | CI SS SG AN AF YA DS VK G | 210 | GH AC AG YY PI PY DD Y | 942 | FTF SHS GMS | 946 | TIN SGG AST YYT DSV KG | 231 | GG SG YG DA SR MT SP |

TABLE 1A-continued

| Name | SEQ ID NO: | Sequence of dual VHH dimer | SEQ ID NO: | CDR1 | SEQ ID NO: | CDR2 | SEQ ID NO: | CDR3 | SEQ ID NO: | CDR4 | SEQ ID NO: | CDR5 | SEQ ID NO: | CDR6 |
|---|---|---|---|---|---|---|---|---|---|---|---|---|---|---|
| | | WVGGMLYFADSVKGRFTV SQDQAKNTVYLQMNSLKP EDTAMYYCAAESVSSFSC GGWLTRPDRVPYWGQGTQ VTVSS | | | | | | | | | | | | |
| DR596-hIL27Ra-VHH20 | 648 | QVQLQESGGGLVQPGGSL RLSCTASGLTFDDSVMGW FRQAPGKGREAVSCISSS GANAFYADSVKGRFTISR DNAKNTLYLQMNSLKPED TATYYCKRGHACAGYYPI PYDDYWGQGTQVTVSSGG GSQVQLQESGGGLVQPGG SLRLSCAASGFTFSSYPM SWVRQAPGKGLEWVSTIS SGGDTTLYADSVKGRFTS SRDNAKNTLYLQLNSLKT EDTAMYYCAKRIDCNSGY CYKRSYWGQGTQVTVSS | 198 | LTFDDSVMG | 204 | CISSSGANAFYADSVKG | 210 | GHACAGYYPIPYDDY | 942 | FTFSSYPMS | 946 | TINSGGDTTLYADSVKG | 231 | GGSGYGDASRMTSP |
| DR596-hIL27Ra-VHH21 | 42 | QVQLQESGGGLVQPGGSL RLSCTASGLTFDDSVMGW FRQAPGKGREAVSCISSS GANAFYADSVKGRFTISR DNAKNTLYLQMNSLKPED TATYYCKRGHACAGYYPI PYDDYWGQGTQVTVSSGG GSQVQLQESGGGLVQPGG SLRLSCAASGFTFSLSSM SWVRQAPGKGLEWVSAIS SGGASTYYTDSVKGRFTI SRDNAKNMLYLQLNSLKT EDTAMYYCAKGGSGYGDA SRMTSPGSQGTQVTVSS | 198 | LTFDDSVMG | 204 | CISSSGANAFYADSVKG | 210 | GHACAGYYPIPYDDY | 942 | FTFSLSSMS | 946 | TINSGGDTTLYADSVKG | 231 | GGSGYGDASRMTSP |
| DR596-hIL27Ra-VHH22 | 649 | QVQLQESGGGLVQPGGSL RLSCTASGLTFDDSVMGW FRQAPGKGREAVSCISSS GANAFYADSVKGRFTISR DNAKNTLYLQMNSLKPED TATYYCKRGHACAGYYPI PYDDYWGQGTQVTVSSGG GSQVQLQESGGGSVQAGG SLRLSCRASGSTYSNYCL GWFRQTTGKEREGVAVIN WVGGMLYFADSVKGRFTV SQDQAKNTVYLQMNSLKP EDTAMYYCAAESVSSFSC GGWLTRPDRVPYWGQGTQ VTVSS | 198 | LTFDDSVMG | 204 | CISSSGANAFYADSVKG | 210 | GHACAGYYPIPYDDY | 942 | FTFSSYPMS | 946 | TINSGGDTTLYADSVKG | 231 | GGSGYGDASRMTSP |
| DR596-hIL27Ra-VHH23 | 650 | QVQLQESGGGLVQPGGSL RLSCTASGLTFDDSVMGW FRQAPGKGREAVSCISSS GANAFYADSVKGRFTISR DNAKNTLYLQMNSLKPED TATYYCKRGHACAGYYPI PYDDYWGQGTQVTVSSGG GSQVQLQESGGGSVQAGG SLRLSCRASRSPYGNYCL GWFRQSTGKEREGVAVIN WVGGMLYFADSVKGRFTV SQDHAKNTVTLQMNSLKP EDTAMYYCAAESVSSFSC GGWLTRPDRVPYWGQGTQ VTVSS | 198 | LTFDDSVMG | 204 | CISSSGANAFYADSVKG | 210 | GHACAGYYPIPYDDY | 942 | FTFSSYPMS | 946 | TINSGGDTTLYADSVKG | 231 | GGSGYGDASRMTSP |
| DR596-hIL27Ra-VHH24 | 651 | QVQLQESGGGLVQPGGSL RLSCTASGLTFDDSVMGW FRQAPGKGREAVSCISSS GANAFYADSVKGRFTISR DNAKNTLYLQMNSLKPED TATYYCKRGHACAGYYPI PYDDYWGQGTQVTVSSGG GSQVQLQESGGGLVQPGG | 198 | LTFDDSVMG | 240 | CISSSGANAFYADSVKG | 210 | GHACAGYYPIPYDDY | 942 | FTFSSYPMS | 946 | TINSGGDTTLYADSVKG | 231 | GGSGYGDASRMTSP |

TABLE 1A-continued

| Name | SEQ ID NO: | Sequence of dual VHH dimer | SEQ ID NO: CDR1 | CDR1 | SEQ ID NO: CDR2 | CDR2 | SEQ ID NO: CDR3 | CDR3 | SEQ ID NO: CDR4 | CDR4 | SEQ ID NO: CDR5 | CDR5 | SEQ ID NO: CDR6 | CDR6 |
|---|---|---|---|---|---|---|---|---|---|---|---|---|---|---|
| | | SLRLSCAASGFTFSHSGM SWVRQAPGKGLEWVSTIN SGGASTYYTDSVKGRFTI SRDNAKNMLYLQLNSLKT EDTAMYYCAKGGSYGDA SRMTSPGSQGTQVTVSS | | G | | G | | | | | | | | |
| hIL27Ra-VHH1-DR591 | 652 | QVQLQESGGGLVQPGGSL RLSCAASGFTFSSYPMSW VRQAPGKGLEWISTISAG GDTTLYADSVKGRFTSSR DNAKNTLYLQLNSLKTED AAIYYCAKRIDCNSGYCY RRNYWGQGTQVTVSSGGS GGSGGSGQVQLESGGGS VQAGGSLRLSCTASGAIA SGYIDSRWCMAWFRQAPG KEREGVAAIWPGGGLTVY ADSVKGRFTISRDHAKNT LYLQMNNLKPEDTAMYYC AAGSPRMCPSLEFGFDYW GQGTQVTVSS | 211 | F T S S Y P M S | 218 | TI SA GG DT TL YA DS VK G | 947 | RI DC NS GY CY RR NY | 943 | AIA SGY IDS RWC MA | 199 | AIW PGG GLT VYA DSV KG | 205 | GS PR MC PS LE FG FD Y |
| hIL27Ra-VHH2-DR591 | 653 | QVQLQESGGGLVQPGGSL RLSCAASGFTFSLSGMSW VRQAPGKGLEWVSAISSG GASTYYTDSVKGRFTISR DNAKNILYLQLNSLKTED TAMYYCAKGGSYGDASR MTSPGSQGTQVTVSSGGS GGSGGSGQVQLESGGGS VQAGGSLRLSCTASGAIA SGYIDSRWCMAWFRQAPG KEREGVAAIWPGGGLTVY ADSVKGRFTISRDHAKNT LYLQMNNLKPEDTAMYYC AAGSPRMCPSLEFGFDYW GQGTQVTVSS | 940 | F T S L S G M S | 224 | AI SS GG AS TY YT DS VK G | 231 | GG SG YG DA SR MT SP | 943 | AIA SGY IDS RWC MA | 199 | AIW PGG GLT VYA DSV KG | 205 | GS PR MC PS LE FG FD Y |
| hIL27Ra-VHH3-DR591 | 654 | QVQLQESGGGSVQAGGSL RLSCVASGYVSCDYFLPS WYRQAPGKEREFVSIIDG TGSTSYAASVKGRFTASE DKGKNIAYLQMNSLKPED TAMYYCKASCVRGRAVSE YWGQGTQVTVSSGGSGGS GGSGQVQLESGGGSVQA GGSLRLSCTASGAIASGY IDSRWCMAWFRQAPGKER EGVAAIWPGGGLTVYADS VKGRFTISRDHAKNTLYL QMNNLKPEDTAMYYCAAG SPRMCPSLEFGFDYWGQG TQVTVSS | 215 | Y V S C D Y F L P S | 222 | II DG TG ST SY AA SV KG | 948 | Sc VR GR AV SE Y | 943 | AIA SGY IDS RWC MA | 199 | AIW PGG GLT VYA DSV KG | 205 | GS PR MC PS LE FG FD Y |
| hIL27Ra-VHH4-DR591 | 655 | QVQLQESGGGLVQPGESL RLSCTASGFTFSNYAMSW VRQAPGKGLEWVSGINVA YGITSYADSVKGRFTISR DNTKNTLYLQLNSLKTED TAIYYCVKHSGTTIPRGF ISYTKRGQGTQVTVSSGG SGGSGGSGQVQLESGGG SVQAGGSLRLSCTASGAI ASGYIDSRWCMAWFRQAP GKEREGVAAIWPGGGLTV YADSVKGRFTISRDHAKN TLYLQMNNLKPEDTAMYY CAAGSPRMCPSLEFGFDY WGQGTQVTVSS | 212 | F T S N Y A M S | 219 | GI NV AY GI TS YA DS VK G | 226 | HS GT TI PR GF IS YT K | 943 | AIA SGY IDS RWC MA | 199 | AIW PGG GLT VYA DSV KG | 205 | GS PR MC PS LE FG FD Y |
| hIL27Ra-VHH5-DR591 | 656 | QVQLQESGGGSVQAGGSL RLSCTASGYVSCDYFLPS WYRQAPGKEREFVSVIDG TGSTSYAASVKGRFTASQ DKGKNIAYLQMNSLKPED | 215 | Y V S C D | 944 | VI DG TG ST SY | 229 | SC VR GR AI SE | 943 | AIA SGY IDS RWC MA | 199 | AIW PGG GLT VYA DSV | 205 | GS PR MC PS LE |

TABLE 1A-continued

| Name | SEQ ID NO: | Sequence of dual VHH dimer | SEQ ID NO: | CDR1 | SEQ ID NO: | CDR2 | SEQ ID NO: | CDR3 | SEQ ID NO: | CDR4 | SEQ ID NO: | CDR5 | SEQ ID NO: | CDR6 |
|---|---|---|---|---|---|---|---|---|---|---|---|---|---|---|
| | | TAMYYCKASCVRGRAISE YWGQGTQVTVSSGGSGGS GGSGQVQLQESGGGSVQA GGSLRLSCTASGAIASGY IDSRWCMAWFRQAPGKER EGVAAIWPGGGLTVYADS VKGRFTISRDHAKNTLYL QMNNLKPEDTAMYYCAAG SPRMCPSLEFGFDYWGQG TQVTVSS | | Y F L P S | | AA ST KG | | Y | | | | KG | | FG FD Y |
| hIL27Ra-VHH6-DR591 | 657 | QVQLQESGGGLVQPGGSL RLSCAASGFSFSSYAMKW VRQAPGKGLEWVSTISSG GSSTNYADSVKGRFTISR DNAKNTLYLQLNSLKIED TAMYYCAKAIVPTGATME RGQGTQVTVSSGGSGGSG GSGQVQLQESGGGSVQAG GSLRLSCTASGAIASGYI DSRWCMAWFRQAPGKERE GVAAIWPGGGLTVYADSV KGRFTISRDHAKNTLYLQ MNNLKPEDTAMYYCAAGS PRMCPSLEFGFDYWGQGT QVTVSS | 213 | F S S S Y A M K | 220 | TI SS SS TN YA DS VK G | 227 | AI VP TG AT ME | 943 | AIA SGY IDS RWC MA | 199 | AIW PGG GLT VYA DSV KG | 205 | GS PR MC PS LE FG FD Y |
| hIL27Ra-VHH7-DR591 | 658 | QVQLQESGGGLVQPGGSL RLSCAASGFTFSSYPMSW VRQAPGKGLEWISTISAG GDTTLYADSVKGRFTSSR DNAKNTLYLQLNSLKTED TAIYYCAKRIDCNSGYCY RRNYWGQGTQVTVSSGGS GGSGGSGQVQLQESGGGS VQAGGSLRLSCTASGAIA SGYIDSRWCMAWFRQAPG KEREGVAAIWPGGGLTVY ADSVKGRFTISRDHAKNT LYLQMNNLKPEDTAMYYC AAGSPRMCPSLEFGFDYW GQGTQVTVSS | 211 | F T F S S Y P M S | 218 | TI SA GG DT TL YA DS VK G | 947 | RI DC NS GY CY RR NY | 943 | AIA SGY IDS RWC MA | 199 | AIW PGG GLT VYA DSV KG | 205 | GS PR MC PS LE FG FD Y |
| hIL27Ra-VHH8-DR591 | 659 | QVQLQESGGGSVQVGGSL RLSCAASGFTFSSYPMSW VRQAPGKGLEWISTISAG GDTTLYADSVKGRFTSSR DNAKNTLYLQLNSLKTED TAIYYCAKRIDCNSGYCY RRNYWGQGTQVTVSSGGS GGSGGSGQVQLQESGGGS VQAGGSLRLSCTASGAIA SGYIDSRWCMAWFRQAPG KEREGVAAIWPGGGLTVY ADSVKGRFTISRDHAKNT LYLQMNNLKPEDTAMYYC AAGSPRMCPSLEFGFDYW GQGTQVTVSS | 211 | F T F S S Y P M S | 218 | TI SA GG DT TL YA DS VK G | 947 | RI DC NS GY CY RR NY | 943 | AIA SGY IDS RWC MA | 199 | AIW PGG GLT VYA DSV KG | 205 | GS PR MC PS LE FG FD Y |
| hIL27Ra-VHH9-DR591 | 660 | QVQLQESGGGSVQSGGSL RLSCAASGFTYSTSNSWM AWFRQAPGKEREGVAAIY TVGGSIFYADSVRGRFTI SQDATKNMFYLQMNTLKP EDTAMYYCAAASGRLRGK WFWPYEYNYWGQGTQVTV SSGGSGGSGGSGQVQLQE SGGGSVQAGGSLRLSCTA SGAIASGYIDSRWCMAWF RQAPGKEREGVAAIWPGG GLTVYADSVKGRFTISRD HAKNTLYLQMNNLKPEDT AMYYCAAGSPRMCPSLEF GFDYWGQGTQVTVSS | 214 | F T Y S T S N S W M A | 221 | AI YT VG GS IF YA DS VR G | 228 | AS GR LR GK WE WP YE YN VR Y | 943 | AIA SGY IDS RWC MA | 199 | AIW PGG GLT VYA DSV KG | 205 | GS PR MC PS LE FG FD Y |

TABLE 1A-continued

| Name | SEQ ID NO: | Sequence of dual VHH dimer | SEQ ID NO: | CDR1 | SEQ ID NO: | CDR2 | SEQ ID NO: | CDR3 | SEQ ID NO: | CDR4 | SEQ ID NO: | CDR5 | SEQ ID NO: | CDR6 |
|---|---|---|---|---|---|---|---|---|---|---|---|---|---|---|
| hIL27Ra-VHH10-DR591 | 661 | QVQLQESGGGSVQAGGSLRLSCRASGSTYSNYCLGWFRQITGKEREGVAVINWVGGMLYFADSVKGRFTVSQDQAKNTLYLQMNSLKPEDTAMYYCAAESVSSFSCGGWLTRPDRVPYWGQGTQVTVSSGGSGGSGGSGGSGQVQLQESGGGSVQAGGSLRLSCTASGAIASGYIDSRWCMAWFRQAPGKEREGVAAIWPGGGLTVYADSVKGRFTISRDHAKNTLYLQMNNLKPEDTAMYYCAAGSPRMCPSLEFGFDYWGQGTQVTVSS | 216 | STYSNYCL G | 223 | VINWVGGMLYFADSVKGL | 230 | ESVSSFSCGGWLTRPDRVPY | 943 | AIASGYIDSRWCMA | 199 | AIWPGGGLTVYADSVKG | 205 | GSPRMCPSLEFGFDY |
| hIL27Ra-VHH11-DR591 | 662 | QVQLQESGGGSVQAGGSLRLSCRASGSTYSNYCLGWFRQSTGKEREGVAVINWVGGMLYFADSVKGRFTVSQDHAKNTVTLQMNSLKPEDTAMYYCAAESVSSFSCGGWLTRPGRVPYWGQGTQVTVSSGGSGGSGGSGGSGQVQLQESGGGSVQAGGSLRLSCTASGAIASGYIDSRWCMAWFRQAPGKEREGVAAIWPGGGLTVYADSVKGRFTISRDHAKNTLYLQMNNLKPEDTAMYYCAAGSPRMCPSLEFGFDYWGQGTQVTVSS | 216 | STYSNYCL G | 223 | VINWVGGMLYFADSVKGL | 994 | ESVSSFSCGGWLTRPGRVPY | 943 | AIASGYIDSRWCMA | 199 | AIWPGGGLTVYADSVKG | 205 | GSPRMCPSLEFGFDY |
| hIL27Ra-VHH12-DR591 | 663 | QVQLQESGGGSVQAGESLRLSCRASGSTYSNYCLGWFRQITGKEREGVAVINWVGGMLYFADSVKGRFTVSQDQAKNTVYLEMNSLKPEDTAMYYCATESVSSFSCGGWLTRPDRVPYWGQGTQVTVSSGGSGGSGGSGGSGQVQLQESGGGSVQAGGSLRLSCTASGAIASGYIDSRWCMAWFRQAPGKEREGVAAIWPGGGLTVYADSVKGRFTISRDHAKNTLYLQMNNLKPEDTAMYYCAAGSPRMCPSLEFGFDYWGQGTQVTVSS | 216 | STYSNYCL G | 223 | VINWVGGMLYFADSVKGL | 230 | ESVSSFSCGGWITRPDRVPY | 943 | AIASGYIDSRWCMA | 199 | AIWPGGGLTVYADSVKG | 205 | GSPRMCPSLEFGFDY |
| hIL27Ra-VHH13-DR591 | 664 | QVQLQESGGGSVQAGGSLRLSCVASGYVSCDYFLPSWYRQAPGKEREFVSIIDGTGSTSYAASVKGRFTASQDRGKNIAYLQMNSLKPEDTAMYYCKASCVRGRTISEYWGQGTQVTVSSGGSGGSGGSGGSGQVQLQESGGGSVQAGGSLRLSCTASGAIASGYIDSRWCMAWFRQAPGKEREGVAAIWPGGGLTVYADSVKGRFTISRDHAKNTLYLQMNNLKPEDTAMYYCAAGSPRMCPSLEFGFDYWGQGTQVTVSS | 215 | YVSCDYFLPS | 222 | IIDGTGSTSYAASVKGFLPS | 950 | SCVRGRTISEY | 943 | AIASGYIDSRWCMA | 199 | AIWPGGGLTVYADSVKG | 205 | GSPRMCPSLEFGFDY |
| hIL27Ra-VHH14-DR591 | 665 | QVQLQESGGGSVQAGGSLRLSCVASGYVSCDYFLPSWYRQAPGKEREFVSIIDGTGSTSYAASVKGRFTASQDKGKNIAYLQMNSLKPEDTAMYYCKASCVRGRAISEYWGQGTQVTVSSGGSGGSGGSGGSGQVQLQESGGGSVQAGGSLRLSCTASGAIASGYIDSRWCMAWFRQAPGKEREGVAAIWPGGGLTVYADSVKGRFTISRDHAKNTLYL | 215 | YVSCDYFLPS | 222 | IIDGTGSTSYAASVKGFLPS | 229 | SCVRGRAISEY | 943 | AIASGYIDSRWCMA | 199 | AIWPGGGLTVYADSVKG | 205 | GSPRMCPSLEFGFDFY |

TABLE 1A-continued

| Name | SEQ ID NO: | Sequence of dual VHH dimer | SEQ ID NO: CDR1 | | SEQ ID NO: CDR2 | | SEQ ID NO: CDR3 | | SEQ ID NO: CDR4 | | SEQ ID NO: CDR5 | | SEQ ID NO: CDR6 | |
|---|---|---|---|---|---|---|---|---|---|---|---|---|---|---|
| | | QMNNLKPEDTAMYYCAAG SPRMCPSLEFGFDYWGQG TQVTVSS | | | | | | | | | | | | |
| hIL27Ra-VHH15-DR591 | 666 | QVQLQESGGGSVQAGGSL RLSCVASGYVSCDYFLPS WYRQAPGKEREFVSIIDG TGSTSYAASVKGRFTASQ DKGKNIAYLQMNTLKPED TAMYYCKASCVRGRAISE YWGQGTQVTVSSGGSGGS GGSGQVQLQESGGGSVQA GGSLRLSCTASGAIASGY IDSRWCMAWFRQAPGKER EGVAAIWPGGGLTVYADS VKGRFTISRDHAKNTLYL QMNNLKPEDTAMYYCAAG SPRMCPSLEFGFDYWGQG TQVTVSS | 215 | YVSCDYFLPS | 222 | IIDGTGSTSYAASVKG | 229 | SCVRGRAISEY | 943 | AIASGYIDSRWCMA | 199 | AIWPGGGLTVYADSVKG | 205 | GSPRMCPSLEFGFDY |
| hIL27Ra-VHH16-DR591 | 667 | QVQLQESGGGSVQAGGSL RLSCRASGSTYSNYCLGW FRQITGKEREGVAVINWV GGMLYFADSVKGRFTVSQ DQAKNTVYLQMNSLKPED TAMYYCAAESASSFSCGG WLTRPDRVPYWGQGTQVT VSSGGSGGSGGSGQVQLQ ESGGGSVQAGGSLRLSCT ASGAIASGYIDSRWCMAW FRQAPGKEREGVAAIWPG GGLTVYADSVKGRFTISR DHAKNTLYLQMNNLKPED TAMYYCAAGSPRMCPSLE FGFDYWGQGTQVTVSS | 216 | STYSNYCLG | 223 | VINWVGGMLYFADSVKG | 951 | ESASSFSCGGWLTRPDRVPY | 943 | AIASGYIDSRWCMA | 199 | AIWPGGGLTVYADSVKG | 205 | GSPRMCPSLEFGFDY |
| hIL27Ra-VHH17-DR591 | 668 | QVQLQESGGGLVQPGGSL RLSCAASGFTFSLSGMSW VRQAPGKGLEWVSAISGG GASTYYTDSVKGRFTISR DNAKNMLYLQLNSLKTED TAMYYCAKGGSGYGDASR MTSPGSQGTQVTVSSGGS GGSGGSGQVQLQESGGGS VQAGGSLRLSCTASGAIA SGYIDSRWCMAWFRQAPG KEREGVAAIWPGGGLTVY ADSVKGRFTISRDHAKNT LYLQMNNLKPEDTAMYYC AAGSPRMCPSLEFGFDYW GQGTQVTVSS | 940 | FTFSLSGMS | 224 | AISGGGASTYYTDSVKG | 231 | GGSGYGDASRMTSP | 943 | AIASGYIDSRWCMA | 199 | AIWPGGGLTVYADSVKG | 250 | GSPRMCPSLEFGFDY |
| hIL27Ra-VHH18-DR591 | 669 | QVQLQESGGSVQAGGSL RLSCVASGYVSCDYFLPS WYRQAPGKEREFVSIIDG TGSTSYAASVKGRFTASQ DKGKNIAYLQMNSLKPED TAMYYCKASCVRGRGISE YWGQGTQVTVSSGGSGGS GGSGQVQLQESGGGSVQA GGSLRLSCTASGAIASGY IDSRWCMAWFRQAPGKER EGVAAIWPGGGLTVYADS VKGRFTISRDHAKNTLYL QMNNLKPEDTAMYYCAAG SPRMCPSLEFGFDYWGQG TQVTVSS | 215 | YVSCDYFLPS | 222 | IIDGTGSTSYAASVKG | 952 | SCVRGRGISEY | 943 | AIASGYIDSRWCMA | 199 | AIWPGGGLTVYADSVKG | 205 | GSPRMCPSLEFGFDY |
| hIL27Ra-VHH19-DR591 | 670 | QVQLQESGGGSVQAGGSL RLSCRASGSTYSNYCLGW FRQITGKEREGVAVINWV GGMLYFADSVKGRFTVSQ DQAKNTVYLQMNSLKPED TAMYYCAAESVSSFSCGG WLTRPDRVPYWGQGTQVT VSSGGSGGSGGSGQVQLQ | 216 | STYSNYCLG | 223 | VINWVGGMLYFADSVKG | 230 | ESVSSFSCGGWLTRPD | 943 | AIASGYIDSRWCMA | 199 | AIWPGGGLTVYADSVKG | 205 | GSPRMCPSLEFGFDY |

TABLE 1A-continued

| Name | SEQ ID NO: | Sequence of dual VHH dimer | SEQ ID NO: | CDR1 | SEQ ID NO: | CDR2 | SEQ ID NO: | CDR3 | SEQ ID NO: | CDR4 | SEQ ID NO: | CDR5 | SEQ ID NO: | CDR6 |
|---|---|---|---|---|---|---|---|---|---|---|---|---|---|---|
| | | ESGGGSVQAGGSLRLSCT ASGAIASGYIDSRWCMAW FRQAPGKEREGVAAIWPG GGLTVYADSVKGRFTISR DHAKNTLYLQMNNLKPED TAMYYCAAGSPRMCPSLE FGFDYWGQGTQVTVSS | | G | | G | | RV PY | | | | | | |
| hIL27Ra-VHH20-DR591 | 671 | QVQLQESGGGLVQPGGSL RLSCAASGFTFSSYPMSW VRQAPGKGLEWVSTISSG GDTTLYADSVKGRFTSSR DNAKNTLYLQLNSLKTED TAMYYCAKRIDCNSGYCY KRSYWGQGTQVTVSSGGS GGSGGSGQVQLESGGGS VQAGGSLRLSCTASGAIA SGYIDSRWCMAWFRQAPG KEREGVAAIWPGGGLTVY ADSVKGRFTISRDHAKNT LYLQMNNLKPEDTAMYYC AAGSPRMCPSLEFGFDYW GQGTQVTVSS | 211 | FTFSSYPMS | 945 | TISSGGDTTLYADSVKG | 953 | RIDCNSGYCYKRSY | 943 | AIASGYIDSRWCMA | 199 | AIWPGGGLTVYADSVKG | 205 | GSPRMCPSLEFGFDY |
| hIL27Ra-VHH21-DR591 | 672 | QVQLQESGGGLVQPGGSL RLSCAASGFTFSLSSMSW VRQAPGKGLEWVSAISSG GASTYYTDSVKGRFTISR DNAKNMLYLQLNSLKTED TAMYYCAKGGSGYGDASR MTSPGSQGTQVTVSSGGS GGSGGSGQVQLESGGGS VQAGGSLRLSCTASGAIA SGYIDSRWCMAWFRQAPG KEREGVAAIWPGGGLTVY ADSVKGRFTISRDHAKNT LYLQMNNLKPEDTAMYYC AAGSPRMCPSLEFGFDYW GQGTQVTVSS | 217 | FTFSLSSMS | 224 | AISSGGASTYYTDSVKG | 231 | GGSGYGDASRMTSP | 943 | AIASGYIDSRWCMA | 199 | AIWPGGGLTVYADSVKG | 205 | GSPRMCPSLEFGFDY |
| hIL27Ra-VHH22-DR591 | 673 | QVQLQESGGGSVQAGGSL RLSCRASGSTYSNYCLGW FRQTTGKEREGVAVINWV GGMLYFADSVKGRFTVSQ DQAKNTVYLQMNSLKPED TAMYYCAAESVSSFSCGG WLTRPDRVPYWGQGTQVT VSSGGSGGSGGSGQVQLQ ESGGGSVQAGGSLRLSCT ASGAIASGYIDSRWCMAW FRQAPGKEREGVAAIWPG GGLTVYADSVKGRFTISR DHAKNTLYLQMNNLKPED TAMYYCAAGSPRMCPSLE FGFDYWGQGTQVTVSS | 216 | STYSNYCLG | 223 | VINWVGGMLYFADSVKG | 230 | ESVSSFSCGGWLTRPDRVPY | 943 | AIASGYIDSRWCMA | 199 | AIWPGGGLTVYADSVKG | 205 | GSPRMCPSLEFGFDY |
| hIL27Ra-VHH23-DR591 | 674 | QVQLQESGGGSVQAGGSL RLSCRASRSPYGNYCLGW FRQSTGKEREGVAVINWV GGMLYFADSVKGRFTVSQ DHAKNTVTLQMNSLKPED TAMYYCAAESVSSFSCGG WLTRPDRVPYWGQGTQVT VSSGGSGGSGGSGQVQLQ ESGGGSVQAGGSLRLSCT ASGAIASGYIDSRWCMAW FRQAPGKEREGVAAIWPG GGLTVYADSVKGRFTISR DHAKNTLYLQMNNLKPED TAMYYCAAGSPRMCPSLE FGFDYWGQGTQVTVSS | 941 | SPYGNYCLG | 223 | VINWVGGMLYFADSVKG | 230 | ESVSSFSCGGWLTRPDRVPY | 943 | AIASGYIDSRWCMA | 199 | AIWPGGGLTVYADSVKG | 205 | GSPRMCPSLEFGFDY |
| hIL27Ra-VHH24-DR591 | 675 | QVQLQESGGGLVQPGGSL RLSCAASGFTFSHSGMSW VRQAPGKGLEWVSTINSG GASTYYTDSVKGRFTISR | 942 | FTFSHSGMS | 946 | TINSGGASTYYTDSVKG | 231 | GGSGYGDA | 943 | AIASGYIDSRWCMA | 199 | AIWPGGGLTVYADSVKG | 205 | GSPRMCPS |

TABLE 1A-continued

| Name | SEQ ID NO: | Sequence of dual VHH dimer | SEQ ID NO: | CDR1 | SEQ ID NO: | CDR2 | SEQ ID NO: | CDR3 | SEQ ID NO: | CDR4 | SEQ ID NO: | CDR5 | SEQ ID NO: | CDR6 |
|---|---|---|---|---|---|---|---|---|---|---|---|---|---|---|
| | | DNAKNMLYLQLNSLKTED TAMYYCAKGGSGYGDASR MTSPGSQGTQVTVSSGGS GGSGGSGQVQLQESGGGS VQAGGSLRLSCTASGAIA SGYIDSRWCMAWFRQAPG KEREGVAAIWPGGGLTVY ADSVKGRFTISRDHAKNT LYLQMNNLKPEDTAMYYC AAGSPRMCPSLEFGFDYW GQGTQVTVSS | | H S G M S | | TY YT DS VK G | | SR MT SP | | MA | | DSV KG | | LE FG FD Y |
| hIL27Ra-VHH1-DR592 | 676 | QVQLQESGGGLVQPGGSL RLSCAASGFTFSSYPMSW VRQAPGKGLEWISTISAG GDTTLYADSVKGRFTSSR DNAKNTLYLQLNSLKTED AAIYYCAKRIDCNSGYCY RRNYWGQGTQVTVSSGGS GGSGGSGQVQLQESGGGS VQAGGSLRLSCTAPGFTS NSCGMDWYRQAPGKEREF VSSISTDGTTGYADSVKG RFTISKDKAKDTVYLQMN SLKPEDTGMYSCKTKDGT IATMELCDFGYWGQGTQV TVSS | 211 | F T F S S Y P M S | 218 | TI SA GG DT TL YA DS VK G | 947 | RI DC NS GY CY RR NY | 194 | FTS NSC GMD | 200 | SIS TDG TTG YAD SVK G | 206 | KD GT IA TM EL CD FG Y |
| hIL27Ra-VHH2-DR592 | 677 | QVQLQESGGGLVQPGGSL RLSCAASGFTFSLSGMSW VRQAPGKGLEWVSAISSG GASTYYTDSVKGRFTISR DNAKNILYLQLNSLKTED TAMYYCAKGGSGYGDASR MTSPGSQGTQVTVSSGGS GGSGGSGQVQLQESGGGS VQAGGSLRLSCTAPGFTS NSCGMDWYRQAPGKEREF VSSISTDGTTGYADSVKG RFTISKDKAKDTVYLQMN SLKPEDTGMYSCKTKDGT IATMELCDFGYWGQGTQV TVSS | 940 | F T F S L S G M S | 224 | AI SS GG AS TY YT DS VK G | 231 | GG SG YG DA SR MT SP | 194 | FTS NSC GMD | 200 | SIS TDG TTG YAD SVK G | 206 | KD GT IA TM EL CD FG Y |
| hIL27Ra-VHH3-DR592 | 678 | QVQLQESGGGSVQAGGSL RLSCVASGYVSCDYFLPS WYRQAPGKEREFVSIIDG TGSTSYAASVKGRFTASE DKGKNIAYLQMNSLKPED TAMYYCKASCVRGRAVSE YWGQGTQVTVSSGGSGGS GGSGQVQLQESGGGSVQA GGSLRLSCTAPGFTSNSC GMDWYRQAPGKEREFVSS ISTDGTTGYADSVKGRFT ISKDKAKDTVYLQMNSLK PEDTGMYSCKTKDGTIAT MELCDFGYWGQGTQVTVS S | 215 | Y V S C D Y F L P S | 222 | II DG TG ST SY AA SV KG | 948 | SC VR GR AV SE Y | 194 | FTS NSC GMD | 200 | SIS TDG TTG YAD SVK G | 206 | KD GT IA TM EL CD FG Y |
| hIL27Ra-VHH4-DR592 | 679 | QVQLQESGGGLVQPGESL RLSCTASGFTFSNYAMSW VRQAPGKGLEWVSGINVA YGITSYADSVKGRFTISR DNTKNTLYLQLNSLKTED TAIYYCVKHSGTTIPRGF ISYTKRGQGTQVTVSSGG SGGSGGSGQVQLQESGGG SVQAGGSLRLSCTAPGFT SNSCGMDWYRQAPGKERE FVSSISTDGTTGYADSVK GRFTISKDKAKDTVYLQM NSLKPEDTGMYSCKTKDG TIATMELCDFGYWGQGTQ VTVSS | 212 | F T F S N Y A M S | 219 | GI NV AY GI TS YA DS VK G | 226 | HS GT TI PR GF IS YT K | 194 | FTS NSC GMD | 200 | SIS TDG TTG YAD SVK G | 206 | KD GT IA TM EL CI FG Y |

TABLE 1A-continued

| Name | SEQ ID NO: | Sequence of dual VHH dimer | SEQ ID NO: | CDR1 | SEQ ID NO: | CDR2 | SEQ ID NO: | CDR3 | SEQ ID NO: | CDR4 | SEQ ID NO: | CDR5 | SEQ ID NO: | CDR6 |
|---|---|---|---|---|---|---|---|---|---|---|---|---|---|---|
| hIL27Ra-VHH5-DR592 | 680 | QVQLQESGGGSVQAGGSLRLSCTASGYVSCDYFLPSWYRQAPGKEREFVSVIDGTGSTSYAASVKGRFTASQDKGKNIAYLQMNSLKPEDTAMYYCKASCVRGRAISEYWGQGTQVTVSSGGSGGSGGSGQVQLQESGGGSVQAGGSLRLSCTAPGFTSNSCGMDWYRQAPGKEREFVSSISTDGTTGYADSVKGRFTISKDKAKDTVYLQMNSLKPEDTGMYSCKTKDGTIATMELCDFGYWGQGTQVTVSS | 215 | YVSCDYFLPS | 944 | VIDGTGSTSYAASVKG | 229 | SCVRGRAISEY | 194 | FTSNSCGMD | 200 | SISTDGTTGYADSVKG | 206 | KDGTIATMELCDFGY |
| hIL27Ra-VHH6-DR592 | 681 | QVQLQESGGGLVQPGGSLRLSCAASGFSFSSYAMKWVRQAPGKGLEWVSTISSGGSSTNYADSVKGRFTISRDNAKNTLYLQLNSLKIEDTAMYYCAKAIVPTGATMERGQGTQVTVSSGGSGGSGGSGQVQLQESGGGSVQAGGSLRLSCTAPGFTSNSCGMDWYRQAPGKEREFVSSISTDGTTGYADSVKGRFTISKDKAKDTVYLQMNSLKPEDTGMYSCKTKDGTIATMELCDFGYWGQGTQVTVSS | 213 | FSFSSYAMK | 220 | TISSGGSSTNYADSVKG | 227 | AIVPTGATMERG | 194 | FTSNSCGMD | 200 | SISTDGTTGYADSVKG | 206 | KDGTIATMELCDFGY |
| hIL27Ra-VHH7-DR592 | 682 | QVQLQESGGGLVQPGGSLRLSCAASGFTFSSYPMSWVRQAPGKGLEWISTISAGGDTTLYADSVKGRFTSSRDNAKNTLYLQLNSLKTEDTAIYYCAKRIDCNSGYCYRRNYWGQGTQVTVSSGGSGGSGGSGQVQLQESGGGSVQAGGSLRLSCTAPGFTSNSCGMDWYRQAPGKEREFVSSISTDGTTGYADSVKGRFTISKDKAKDTVYLQMNSLKPEDTGMYSCKTKDGTIATMELCDFGYWGQGTQVTVSS | 211 | FTFSSYPMS | 218 | TISAGGDTTLYADSVKG | 947 | RIDCNSGYCYRRNY | 194 | FTSNSCGMD | 200 | SISTDGTTGYADSVKG | 206 | KDGTIATMELCDFGY |
| hIL27Ra-VHH8-DR592 | 683 | QVQLQESGGGSVQVGGSLRLSCAASGFTFSSYPMSWVRQAPGKGLEWISTISAGGDTTLYADSVKGRFTSSRDNAKNTLYLQLNSLKTEDTAIYYCAKRIDCNSGYCYRRNYWGQGTQVTVSSGGSGGSGGSGQVQLQESGGGSVQAGGSLRLSCTAPGFTSNSCGMDWYRQAPGKEREFVSSISTDGTTGYADSVKGRFTISKDKAKDTVYLQMNSLKPEDTGMYSCKTKDGTIATMELCDFGYWGQGTQVTVSS | 211 | FTFSSYPMS | 218 | TISAGGDTTLYADSVKG | 947 | RIDCNSGYCYRRNY | 194 | FTSNSCGMD | 200 | SISTDGTTGYADSVKG | 206 | KDGTIATMELCDFGY |
| hIL27Ra-VHH9-DR592 | 684 | QVQLQESGGGSVQSGGSLRLSCAASGFTYSTNSWMAWFRQAPGKEREGVAAIYTVGGSIFYADSVRGRFTISQDATKNMFYLQMNTLKPEDTAMYYCAAASGRLRGKWFWPYEYNYWGQGTQVTVSSGGSGGSGSGGSGQVQLQESGGGSVQAGGSLRLSCTAPGFTSNSCGMDWYRQAPGKEREFVSSISTDGTTGYADSVKGRFTISKDKAKDTVYLQMNSLKPEDTGMYSCK | 214 | FTYSTNSWMA | 221 | AIYTVGGSIFYADSVRG | 228 | ASGRLRGKWFWPYEYNY | 194 | FTSNSCGMD | 200 | SISTDGTTGYADSVKG | 206 | KDGTIATMELCDFGY |

TABLE 1A-continued

| Name | SEQ ID NO: | Sequence of dual VHH dimer | SEQ ID NO: | CDR1 | SEQ ID NO: | CDR2 | SEQ ID NO: | CDR3 | SEQ ID NO: | CDR4 | SEQ ID NO: | CDR5 | SEQ ID NO: | CDR6 |
|---|---|---|---|---|---|---|---|---|---|---|---|---|---|---|
| | | TKDGTIATMELCDFGYWQGTQVTVSS | | | | | | | | | | | | |
| hIL27Ra-VHH10-DR592 | 685 | QVQLQESGGGSVQAGGSLRLSCRASGSTYSNYCLGWFRQITGKEREGVAVINWVGGMLYFADSVKGRFTVSQDQAKNTLYLQMNSLKPEDTAMYYCAAESVSSFSCGGWLTRPDRVPYWQGTQVTVSSGGSGGSGGSGQVQLQESGGGSVQAGGSLRLSCTAPGFTSNSCGMDWYRQAPGKEREFVSSISTDGTTGYADSVKGRFTISKDKAKDTVYLQMNSLKPEDTGMYSCKTKDGTIATMELCDFGYWGQGTQVTVSS | 216 | STSNYCLG | 223 | VINWYGGMLYFADSVKG | 230 | ESVSSFSCGGWLTRPDRVPY | 194 | FTSNSCGMD | 200 | SISTDGTTGYADSVKG | 206 | KDGTIATMELCDFGY |
| hIL27Ra-VHH11-DR592 | 686 | QVQLQESGGGSVQAGGSLRLSCRASGSTYSNYCLGWFRQSTGKEREGVAVINWVGGMLYFADSVKGRFTVSQDHAKNTVTLQMNSLKPEDTAMYYCAAESVSSFSCGGWLTRPGRVPYWQGTQVTVSSGGSGGSGGSGQVQLQESGGGSVQAGGSLRLSCTAPGFTSNSCGMDWYRQAPGKEREFVSSISTDGTTGYADSVKGRFTISKDKAKDTVYLQMNSLKPEDTGMYSCKTKDGTIATMELCDFGYWGQGTQVTVSS | 216 | STSNYCLG | 223 | VINWYGGMLYFADSVKG | 949 | ESVSSFSCGGWLTRPGRVPY | 194 | FTSNSCGMD | 200 | SISTDGTTGYADSVKG | 206 | KDGTIATMELCDFGY |
| hIL27Ra-VHH12-DR592 | 678 | QVQLQESGGGSVQAGESLRLSCRASGSTYSNYCLGWFRQITGKEREGVAVINWVGGMLYFADSVKGRFTVSQDQAKNTVYLEMNSLKPEDTAMYYCATESVSSFSCGGWLTRPDRVPYWQGTQVTVSSGGSGGSGGSGQVQLQESGGGSVQAGGSLRLSCTAPGFTSNSCGMDWYRQAPGKEREFVSSISTDGTTGYADSVKGRFTISKDKAKDTVYLQMNSLKPEDTGMYSCKTKDGTIATMELCDFGYWGQGTQVTVSS | 216 | STSNYCLG | 232 | VINWYGGMLYFADSVKG | 230 | ESVSSFSCGGWLTRPDRVPY | 194 | FTSNSCGMD | 200 | SISTDGTTGYADSVKG | 206 | KDGTIATMELCDFG |
| hIL27Ra-VHH13-DR592 | 688 | QVQLQESGGGSVQAGGSLRLSCVASGYVSCDYFLPSWYRQAPGKEREFVSIIDGTGSTSYAASVKGRFTASQDRGKNIAYLQMNSLKPEDTAMYYCKASCVRGRTISEYWGQGTQVTVSSGGSGGSGGSGQVQLQESGGGSVQAGGSLRLSCTAPGFTSNSCGMDWYRQAPGKEREFVSSISTDGTTGYADSVKGRFTISKDKAKDTVYLQMNSLKPEDTGMYSCKTKDGTIATMELCDFGYWGQGTQVTVSS | 215 | YVSCDYFLPS | 222 | IIDGTGSTSYAASVKG | 950 | SCVRGRTISEY | 194 | FTSNSCGMD | 200 | SISTDGTTGYADSVKG | 206 | KDGTIATMELCDFCY |
| hIL27Ra-VHH14-DR592 | 689 | QVQLQESGGGSVQAGGSLRLSCVASGYVSCDYFLPSWYRQAPGKEREFVSIIDGTGSTSYAASVKGRFTASQDKGKNIAYLQMNSLKPEDTAMYYCKASCVRGRAISEYWGQGTQVTVSSGGSGGSGGSGQVQLQESGGGSVQAGGSLRLSCTAPGFTSNSC | 215 | YVSCDYFLPS | 222 | IIDGTGSTSYAASVKG | 229 | SCVRGRAISEY | 194 | FTSNSCGMD | 200 | SISTDGTTGYADSVKG | 206 | KDGTIATMELCDFGY |

TABLE 1A-continued

| Name | SEQ ID NO: | Sequence of dual VHH dimer | SEQ ID NO: | CDR1 | SEQ ID NO: | CDR2 | SEQ ID NO: | CDR3 | SEQ ID NO: | CDR4 | SEQ ID NO: | CDR5 | SEQ ID NO: | CDR6 |
|---|---|---|---|---|---|---|---|---|---|---|---|---|---|---|
| | | GMDWYRQAPGKEREFVSS ISTDGTTGYADSVKGRFT ISKDKAKDTVYLQMNSLK PEDTGMYSCKTKDGTIAT MELCDFGYWGQGTQVTVS S | | S | | | | | | | | | | |
| hIL27Ra-VHH15-DR592 | 690 | QVQLQESGGGSVQAGGSL RLSCVASGYVSCDYFLPS WYRQAPGKEREFVSIIDG TGSTSYAASVKGRFTASQ DKGKNIAYLQMNTLKPED TAMYYCKASCVRGRAISE YWGQGTQVTVSSGGSGGS GGSGQVQLQESGGGSVQA GGSLRLSCTAPGFTSNSC GMDWYRQAPGKEREFVSS ISTDGTTGYADSVKGRFT ISKDKAKDTVYLQMNSLK PEDTGMYSCKTKDGTIAT MELCDFGYWGQGTQVTVS S | 215 | Y V S C D Y F L P S | 222 | II DG TG ST SY AA SV KG | 229 | SC VR GR AI SE Y | 194 | FTS NSC GMD | 200 | SIS TDG TTG YAD SVK G | 206 | KD GT IA TM EL CD FG Y |
| hIL27Ra-VHH16-DR592 | 691 | QVQLQESGGGSVQAGGSL RLSCRASGSTYSNYCLGW FRQITGKEREGVAVINWV GGMLYFADSVKGRFTVSQ DQAKNTVYLQMNSLKPED TAMYYCAAESASSFSCGG WLTRPDRVPYWGQGTQVT VSSGGSGGSGGSGQVQLQ ESGGGSVQAGGSLRLSCT APGFTSNSCGMDWYRQAP GKEREFVSSISTDGTTGY ADSVKGRFTISKDKAKDT VYLQMNSLKPEDTGMYSC KTKDGTIATMELCDFGYW GQGTQVTVSS | 216 | S T Y S N Y C L G | 223 | VI NW VG GM LY FA DS VK G | 951 | ES AS SF SC GG WL TR PD RV PY | 194 | FTS NSC GMD | 200 | SIS TDG TTG YAD SVK G | 206 | KD GT IA TM EL CD FG Y |
| hIL27Ra-VHH17-DR592 | 692 | QVQLQESGGGLVQPGGSL RLSCAASGFTFSLSGMSW VRQAPGKGLEWVSAISSG GASTYYTDSVKGRFTISR DNAKNMLYLQLNSLKTED TAMYYCAKGGSGYGDASR MTSPGSQGTQVTVSSGGS GGSGGSGQVQLQESGGGS VQAGGSLRLSCTAPGFTS NSCGMDWYRQAPGKEREF VSSISTDGTTGYADSVKG RFTISKDKAKDTVYLQMN SLKPEDTGMYSCKTKDGT IATMELCDFGYWGQGTQV TVSS | 940 | F T E S L S G M S | 224 | AI SS GG AS TY YT DS VK G | 231 | GG SG YG DA SR MT SP | 194 | FTS NSC GMD | 200 | SIS TDG TTG YAD SVK G | 206 | KD GT IA TM EL CD FG Y |
| hIL27Ra-VHH18-DR592 | 693 | QVQLQESGGGSVQAGGSL RLSCVASGYVSCDYFLPS WYRQAPGKEREFVSIIDG TGSTSYAASVKGRFTASQ DKGKNIAYLQMNSLKPED TAMYYCKASCVRGRGISE YWGQGTQVTVSSGGSGGS GGSGQVQLQESGGGSVQA GGSLRLSCTAPGFTSNSC GMDWYRQAPGKEREFVSS ISTDGTTGYADSVKGRFT ISKDKAKDTVYLQMNSLK PEDTGMYSCKTKDGTIAT MELCDFGYWGQGTQVTVS S | 215 | Y V S C D Y F L P S | 222 | II DG TG ST SY AA SV KG | 952 | SC VR GR GI SE Y | 194 | FTS NSC GMD | 200 | SIS TDG TTG YAD SVK G | 206 | KD GT IA TM EL CD FG Y |
| hIL27Ra-VHH19-DR592 | 694 | QVQLQESGGGSVQAGGSL RLSCRASGSTYSNYCLGW FRQITGKEREGVAVINWV GGMLYFADSVKGRFTVSQ DQAKNTVYLQMNSLKPED | 216 | S T Y S N | 223 | VI NW VG GM LY | 230 | ES VS SF SC GG | 194 | FTS NSC GMD | 200 | SIS TDG TTG YAD SVK | 206 | KD GT IA TM EL |

TABLE 1A-continued

| Name | SEQ ID NO: | Sequence of dual VHH dimer | SEQ ID NO: | CDR1 | SEQ ID NO: | CDR2 | SEQ ID NO: | CDR3 | SEQ ID NO: | CDR4 | SEQ ID NO: | CDR5 | SEQ ID NO: | CDR6 |
|---|---|---|---|---|---|---|---|---|---|---|---|---|---|---|
| | | TAMYYCAAESVSSFSCGG WLTRPDRVPYWGQGTQVT VSSGGSGGSGGSGQVQLQ ESGGGSVQAGGSLRLSCT APGFTSNSCGMDWYRQAP GKEREFVSSISTDGTTGY ADSVKGRFTISKDKAKDT VYLQMNSLKPEDTGMYSC KTKDGTIATMELCDFGYW GQGTQVTVSS | | Y C L G | | FA DS VK G | | WL TR PD RV PY | | | | G | | CD FG Y |
| hIL27Ra-VHH20-DR592 | 695 | QVQLQESGGGLVQPGGSL RLSCAASGFTFSSYPMSW VRQAPGKGLEWVSTISSG GDTTLYADSVKGRFTSSR DNAKNTLYLQLNSLKTED TAMYYCAKRIDCNSGYCY KRSYWGQGTQVTVSSGGS GGSGGSGQVQLQESGGGS VQAGGSLRLSCTAPGFTS NSCGMDWYRQAPGKEREF VSSISTDGTTGYADSVKG RFTISKDKAKDTVYLQMN SLKPEDTGMYSCKTKDGT IATMELCDFGYWGQGTQV TVSS | 211 | F T S S S Y P M S | 945 | TI SS GG DT TL YA DS VK G | 953 | RI DC NS GY CY KR SY | 194 | FTS NSC GMD | 200 | SIS TDG TTG YAD SVK G | 206 | KD GT IA TM EL CD FG Y |
| hIL27Ra-VHH21-DR592 | 696 | QVQLQESGGGLVQPGGSL RLSCAASGFTFSLSSMSW VRQAPGKGLEWVSAISSG GASTYYTDSVKGRFTISR DNAKNMLYLQLNSLKTED TAMYYCAKGGSGYGDASR MTSPGSQGTQVTVSSGGS GGSGGSGQVQLQESGGGS VQAGGSLRLSCTAPGFTS NSCGMDWYRQAPGKEREF VSSISTDGTTGYADSVKG RFTISKDKAKDTVYLQMN SLKPEDTGMYSCKTKDGT IATMELCDFGYWGQGTQV TVSS | 217 | F T F S L S S M S | 224 | AI SS GG AS TY YT DS VK G | 231 | GG SG YG DA SR MT SP | 194 | FTS NSC GMD | 200 | SIS TDG TTG YAD SVK G | 206 | KD GT IA TM EL CD FG Y |
| hIL27Ra-VHH22-DR592 | 697 | QVQLQESGGGSVQAGGSL RLSCRASGSTYSNYCLGW FRQTTGKEREGVAVINWV GGMLYFADSVKGRFTVSQ DQAKNTVYLQMNSLKPED TAMYYCAAESVSSFSCGG WLTRPDRVPYWGQGTQVT VSSGGSGGSGGSGQVQLQ ESGGGSVQAGGSLRLSCT APGFTSNSCGMDWYRQAP GKEREFVSSISTDGTTGY ADSVKGRFTISKDKAKDT VYLQMNSLKPEDTGMYSC KTKDGTIATMELCDFGYW GQGTQVTVSS | 216 | S T Y S N Y C L G | 223 | VI NW VG GM LY FA DS VI G | 230 | ES VS SF SC GG WL TR PD RV PY | 194 | FTS NSC GMD | 200 | SIS TDG TTG YAD SVK G | 206 | KD GT IA TM EL CD FG Y |
| hIL27Ra-VHH23-DR592 | 698 | QVQLQESGGGSVQAGGSL RLSCRASRSPYGNYCLGW FRQSTGKEREGVAVINWV GGMLYFADSVKGRFTVSQ DHAKNTVTLQMNSLKPED TAMYYCAAESVSSFSCGG WLTRPDRVPYWGQGTQVT VSSGGSGGSGGSGQVQLQ ESGGGSVQAGGSLRLSCT APGFTSNSCGMDWYRQAP GKEREFVSSISTDGTTGY ADSVKGRFTISKDKAKDT VYLQMNSLKPEDTGMYSC KTKDGTIATMELCDFGYW GQGTQVTVSS | 941 | S P Y G N Y C L G | 223 | VI NW VG GM LY FA DS VK G | 230 | ES VS SF SC GG WL TR PD RV PY | 194 | FTS NSC GMD | 200 | SIS TDG TTG YAD SVK G | 206 | KD GT IA TM EL CD FG Y |

TABLE 1A-continued

| Name | SEQ ID NO: | Sequence of dual VHH dimer | SEQ ID NO: | CDR1 | SEQ ID NO: | CDR2 | SEQ ID NO: | CDR3 | SEQ ID NO: | CDR4 | SEQ ID NO: | CDR5 | SEQ ID NO: | CDR6 |
|---|---|---|---|---|---|---|---|---|---|---|---|---|---|---|
| hIL27Ra-VHH24-DR592 | 699 | QVQLQESGGGLVQPGGSLRLSCAASGFTFSHSGMSWVRQAPGKGLEWVSTINSGGASTYYTDSVKGRFTISRDNAKNMLYLQLNSLKTEDTAMYYCAKGGSGYGDASRMTSPGSQGTQVTVSSGGSGGGSGGVQLQESGGGSVQAGGSLRLSCTAPGFTSNSCGMDWYRQAPGKEREFVSSISTDGTTGYADSVKGRFTISKDKAKDTVYLQMNSLKPEDTGMYSCKTKDGTIATMELCDFGYWGQGTQVTVSS | 942 | FTFSHSGMS | 946 | TINSGGASTYYTDSVKG | 231 | GGSGYGDASRMTSP | 194 | FTSNSCGMD | 200 | SISTDGTTGYADSVKG | 206 | KDGTIATMELCDFGY |
| hIL27Ra-VHH1-DR593 | 700 | QVQLQESGGGLVQPGGSLRLSCAASGFTFSSYPMSWVRQAPGKGLEWISTISAGGDTTLYADSVKGRFTSSRDNAKNTLYLQLNSLKTEDAAIYYCAKRIDCNSGYCYRRNYWGQGTQVTVSSGGSGGGSGGVQLQESGGGSVQAGGSLRLSCAASGYPYSNGYMGWFRQAPGKEREGVATIYTGDRTYYADSVKGRFTISRDNAKNTVDLQMSSLKPEDTAMYYCAARAAPLYSSGSPLTRARYNVWGQGTQVTVSS | 942 | FTFSSYPMS | 946 | TISAGGDTTLYADSVKG | 231 | GGSGYGDASRMTSP | 195 | YPYSNGYMG | 201 | TIYTGDRTYYADSVKG | 207 | RAAPLYSSGSPLTRAFYNV |
| hIL27Ra-VHH2-DR593 | 701 | QVQLQESGGGLVQPGGSLRLSCAASGFTFSLSGMSWVRQAPGKGLEWVSAISSGGASTYYTDSVKGRFTISRDNAKNILYLQLNSLKTEDTAMYYCAKGGSGYGDASRMTSPGSQGTQVTVSSGGSGGGSGGVQLQESGGGSVQAGGSLRLSCAASGYPYSNGYMGWFRQAPGKEREGVATIYTGDRTYYADSVKGRFTISRDNAKNTVDLQMSSLKPEDTAMYYCAARAAPLYSSGSPLTRARYNVWGQGTQVTVSS | 942 | FTFSLSGMS | 946 | AISSGGASTYYTDSVKG | 231 | GGSGYGDASRMTSP | 195 | YPYSNGYMG | 201 | TIYTGDRTYYADSVKG | 207 | RAAPLYSSGSPLTRARYNV |
| hIL27Ra-VHH3-DR593 | 702 | QVQLQESGGGSVQAGGSLRLSCVASGYVSCDYFLPSWYRQAPGKEREFVSIIDGTGSTSYAASVKGRFTASEDKGKNIAYLQMNSLKPEDTAMYYCKASCVRGRAVSEYWGQGTQVTVSSGGSGGGSGGVQLQESGGGSVQAGGSLRLSCAASGYPYSNGYMGWFRQAPGKEREGVATIYTGDRTYYADSVKGRFTISRDNAKNTVDLQMSSLKPEDTAMYYCAARAAPLYSSGSPLTRARYNVWGQGTQVTVSS | 942 | FTFSHSGMS | 946 | TIDGTGSTSYAASVKG | 231 | GGSGYGDASRMSP | 195 | YPYSNGYMG | 201 | TIYTGDRTYYADSVKG | 207 | RAAPLYSSGSPLTRARYNV |
| hIL27Ra VHH4-DR593 | 703 | QVQLQESGGGLVQPGESLRLSCTASGFTFSNYAMSWVRQAPGKGLEWVSGINVAYGITSYADSVKGRFTISRDNTKNTLYLQLNSLKTEDTAIYYCVKHSGTTIPRGFISYTKRGQGTQVTVSSGGSGGGSGGVQLQESGGGSVQAGGSLRLSCAASGYPYSNGYMGWFRQAPGKEREGVATIYTGDRTYYADSVKGRFTISRDNAKNTVDLQ | 942 | FTFSNYAMS | 946 | GINVAYGITSYADSVKG | 231 | GGSGYGDASRMSP | 195 | YPYSNGYMG | 201 | TIYTGDRTYYADSVKG | 207 | RAAPLYSSGSPLTRARYNV |

TABLE 1A-continued

| Name | SEQ ID NO: | Sequence of dual VHH dimer | SEQ ID NO: CDR1 | SEQ ID NO: CDR2 | SEQ ID NO: CDR3 | SEQ ID NO: CDR4 | SEQ ID NO: CDR5 | SEQ ID NO: CDR6 |
|---|---|---|---|---|---|---|---|---|
| | | MSSLKPEDTAMYYCAARA APLYSSGSPLTRARYNVW GQGTQVTVSS | | | | | | |
| hIL27Ra-VHH5-DR593 | 704 | QVQLQESGGGSVQAGGSL RLSCTASGYVSCDYFLPS WYRQAPGKEREFVSVIDG TGSTSYAASVKGRFTASQ DKGKNIAYLQMNSLKPED TAMYYCKASCVRGRAISE YWGQGTQVTVSSGGSGGS GGSGQVQLQESGGGSVQA GGSLRLSCAASGYPYSNG YMGWFRQAPGKEREGVAT IYTGDGRTYYADSVKGRF TISRDNAKNTVDLQMSSL KPEDTAMYYCAARAAPLY SSGSPLTRARYNVWGQGT QVTVSS | 942 F T F S H S G M S | 946 TI NS GG AS TY YT DS VK G | 231 GG SG YG DA SR MT SP | 195 YPY SNG YMG | 201 TIY TGD GRT YYA DSV KG | 207 RA AP LY SS GS PL TR AR YN V |
| hIL27Ra-VHH6-DR593 | 705 | QVQLQESGGGLVQPGGSL RLSCAASGFSFSSYAMKW VRQAPGKGLEWVSTISSG GSSTNYADSVKGRFTISR DNAKNTLYLQLNSLKIED TAMYYCAKAIVPTGATME RGQGTQVTVSSGGSGGSG GSGQVQLQESGGGSVQAG GSLRLSCAASGYPYSNGY MGWFRQAPGKEREGVATI YTGDGRTYYADSVKGRFT ISRDNAKNTVDLQMSSLK PEDTAMYYCAARAAPLYS SGSPLTRARYNVWGQGTQ VTVSS | 942 F T F S H S G M S | 946 TI NS GG AS TY YT DS VK G | 231 GG SG YG DA SR MT SP | 195 YPY SNG YMG | 201 TIY TGD GRT YYA DSV KG | 207 RA AP LY SS GS PL TR AR YN V |
| hIL27Ra-VHH7-DR593 | 706 | QVQLQESGGGLVQPGGSL RLSCAASGFTFSSYPMSW VRQAPGKGLEWISTISAG GDTTLYADSVKGRFTSSR DNAKNTLYLQLNSLKTED TAIYYCAKRIDCNSGYCY RRNYWGQGTQVTVSSGGS GGSGGSGQVQLQESGGGS VQAGGSLRLSCAASGYPY SNGYMGWFRQAPGKEREG VATIYTGDGRTYYADSVK GRFTISRDNAKNTVDLQM SSLKPEDTAMYYCAARAA PLYSSGSPLTRARYNVWG QGTQVTVSS | 942 F T F S H S G M S | 946 TI NS GG AS TY YT DS VK G | 231 GG SG YG DA SR MT SP | 195 YPY SNG YMG | 201 TIY TGD GRT YYA DSV KG | 207 RA AP LY SS GS PL TR AR YN V |
| hIL27Ra-VHH8-DR593 | 707 | QVQLQESGGGSVQVGGSL RLSCAASGFTFSSYPMSW VRQAPGKGLEWISTISAG GDTTLYADSVKGRFTSSR DNAKNTLYLQLNSLKTED TAIYYCAKRIDCNSGYCY RRNYWGQGTQVTVSSGGS GGSGGSGQVQLQESGGGS VQAGGSLRLSCAASGYPY SNGYMGWFRQAPGKEREG VATIYTGDGRTYYADSVK GRFTISRDNAKNTVDLQM SSLKPEDTAMYYCAARAA PLYSSGSPLTRARYNVWG QGTQVTVSS | 942 F T F S H S G M S | 946 TI NS GG AS TY YT DS VK G | 231 GG SG YG DA SR MT SP | 195 YPY SNG YMG | 201 TIY TGD GRT YYA DSV KG | 207 RA AP LY SS GS PL TR AR YN V |
| hIL27Ra-VHH9-DR593 | 708 | QVQLQESGGGSVQSGGSL RLSCAASGFTYSTSNSWM AWFRQAPGKEREGVAAIY TVGGSIFYADSVRGRFTI SQDATKNMFYLQMNTLKP EDTAMYYCAAASGRLRGK WFWPYEYNYWGQGTQVTV SSGGSGGSGGSGQVQLQE | 942 F T F S H S G M | 946 TI NS GG AS TY YT DS VK | 231 GG SG YG DA SR MT SP | 195 YPY SNG YMG | 201 TIY TGD GRT YYA DSV KG | 207 RA AP LY SS GS PL TR AR |

TABLE 1A-continued

| Name | SEQ ID NO: | Sequence of dual VHH dimer | SEQ ID NO: CDR1 | CDR1 | SEQ ID NO: CDR2 | CDR2 | SEQ ID NO: CDR3 | CDR3 | SEQ ID NO: CDR4 | CDR4 | SEQ ID NO: CDR5 | CDR5 | SEQ ID NO: CDR6 | CDR6 |
|---|---|---|---|---|---|---|---|---|---|---|---|---|---|---|
| | | SGGGSVQAGGSLRLSCAA SGYPYSNGYMGWFRQAPG KEREGVATIYTGDGRTYY ADSVKGRFTISRDNAKNT VDLQMSSLKPEDTAMYYC AARAAPLYSSGSPLTRAR YNVWGQGTQVTVSS | | S | | G | | | | | | | | YN V |
| hIL27Ra-VHH10-DR593 | 709 | QVQLQESGGGSVQAGGSL RLSCRASGSTYSNYCLGW FRQITGKEREGVAVINWV GGMLYFADSVKGRFTVSQ DQAKNTLYLQMNSLKPED TAMYYCAAESVSSFSCGG WLTRPDRVPYWGQGTQVT VSSGGSGGSGGSGQVQLQ ESGGGSVQAGGSLRLSCA ASGYPYSNGYMGWFRQAP GKEREGVATIYTGDGRTY YADSVKGRFTISRDNAKN TVDLQMSSLKPEDTAMYY CAARAAPLYSSGSPLTRA RYNVWGQGTQVTVSS | 942 | F T F S H S G M S | 946 | TI NS GG AS TY YT DS TK G | 231 | GG SG YG DA SR MT SP | 195 | YPY SNG YMG | 201 | TIY TGD GRT YYA DSV KG | 207 | RA AP LY SS GS PL TR AR YN V |
| hIL27Ra-VHH11-DR593 | 710 | QVQLQESGGGSVQAGGSL RLSCRASGSTYSNYCLGW FRQSTGKEREGVAVINWV GGMLYFADSVKGRFTVSQ DHAKNTVTLQMNSLKPED TAMYYCAAESVSSFSCGG WLTRPGRVPYWGQGTQVT VSSGGSGGSGGSGQVQLQ ESGGGSVQAGGSLRLSCA ASGYPYSNGYMGWFRQAP GKEREGVATIYTGDGRTY YADSVKGRFTISRDNAKN TVDLQMSSLKPEDTAMYY CAARAAPLYSSGSPLTRA RYNVWGQGTQVTVSS | 942 | F T F S H S G M S | 946 | TI NS GG AS TY YT DS VK G | 231 | GG SG YG DA SR MT SP | 195 | YPY SNG YMG | 201 | TIY TGD GRT YYA DSV KG | 207 | RA AP LY SS GS PL TR AR YN V |
| hIL27Ra-VHH12-DR593 | 711 | QVQLQESGGGSVQAGESL RLSCRASGSTYSNYCLGW FRQITGKEREGVAVINWV GGMLYFADSVKGRFTVSQ DQAKNTVYLEMNSLKPED TAMYYCATESVSSFSCGG WLTRPDRVPYWGQGTQVT VSSGGSGGSGGSGQVQLQ ESGGGSVQAGGSLRLSCA ASGYPYSNGYMGWFRQAP GKEREGVATIYTGDGRTY YADSVKGRFTISRDNAKN TVDLQMSSLKPEDTAMYY CAARAAPLYSSGSPLTRA RYNVWGQGTQVTVSS | 942 | F T F S H S G M S | 946 | TI NS GG AS TY YT DS VK G | 231 | GG SG YG DA SR MT SP | 195 | YPY SNG YMG | 201 | TIY TGD GRT YYA DSV KG | 207 | RA AP LY SS GS PL TR AR YN V |
| hIL27Ra-VHH13-DR593 | 712 | QVQLQESGGGSVQAGGSL RLSCVASGYVSCDYFLPS WYRQAPGKEREFVSIIDG TGSTSYAASVKGRFTASQ DRGKNIAYLQMNSLKPED TAMYYCKASCVRGRTISE YWGQGTQVTVSSGGSGGS GGSGQVQLQESGGGSVQA GGSLRLSCAASGYPYSNG YMGWFRQAPGKEREGVAT IYTGDGRTYYADSVKGRF TISRDNAKNTVDLQMSSL KPEDTAMYYCAARAAPLY SSGSPLTRARYNVWGQGT QVTVSS | 942 | F T F S H S G M S | 946 | TI NS GG AS TY YT DS VK G | 231 | GG SG YG DA SR MT SP | 195 | YPY SNG YMG | 201 | TIY TGD GRT YYA DSV KG | 207 | RA AP LY SS GS PL TR AR YN V |
| hIL27Ra-VHH14-DR593 | 713 | QVQLQESGGGSVQAGGSL RLSCVASGYVSCDYFLPS WYRQAPGKEREFVSIIDG TGSTSYAASVKGRFTASQ | 942 | F T F S | 946 | TI NS GG AS | 231 | GG SG YG DA | 195 | YPY SNG YMG | 201 | TIY TGD GRT YYA | 207 | RA AP LY SS |

TABLE 1A-continued

| Name | SEQ ID NO: | Sequence of dual VHH dimer | SEQ ID NO: | CDR1 | SEQ ID NO: | CDR2 | SEQ ID NO: | CDR3 | SEQ ID NO: | CDR4 | SEQ ID NO: | CDR5 | SEQ ID NO: | CDR6 |
|---|---|---|---|---|---|---|---|---|---|---|---|---|---|---|
| | | DKGKNIAYLQMNSLKPED TAMYYCKASCVRGRAISE YWGQGTQVTVSSGGSGGS GGSGQVQLQESGGGSVQA GGSLRLSCAASGYPYSNG YMGWFRQAPGKEREGVAT IYTGDGRTYYADSVKGRF TISRDNAKNTVDLQMSSL KPEDTAMYYCAARAAPLY SSGSPLTRARYNVWGQGT QVTVSS | | H S G M S | | TY YT DS VK G | | SR MT SP | | | | DSV KG | | GS PL TR AR YN V |
| hIL27Ra-VHH15-DR593 | 714 | QVQLQESGGGSVQAGGSL RLSCVASGYVSCDYFLPS WYRQAPGKEREFVSIIDG TGSTSYAASVKGRFTASQ DKGKNIAYLQMNTLKPED TAMYYCKASCVRGRAISE YWGQGTQVTVSSGGSGGS GGSGQVQLQESGGGSVQA GGSLRLSCAASGYPYSNG YMGWFRQAPGKEREGVAT IYTGDGRTYYADSVKGRF TISRDNAKNTVDLQMSSL KPEDTAMYYCAARAAPLY SSGSPLTRARYNVWGQGT QVTVSS | 942 | F T F S H S G M S | 946 | TI NS GG AS TY YT DS VK G | 231 | GG SG YG DA SR MT SP | 195 | YPY SNG YMG | 201 | TIY TGD GRT YYA DSV KG | 207 | RA AP LY SS GS PL TR AR YN V |
| hIL27Ra-VHH16-DR593 | 715 | QVQLQESGGGSVQAGGSL RLSCRASGSTYSNYCLGW FRQITGKEREGVAVINWV GGMLYFADSVKGRFTVSQ DQAKNTVYLQMNSLKPED TAMYYCAAESASSFSCGG WLTRPDRVPYWGQGTQVT VSSGGSGGSGGSGQVQLQ ESGGGSVQAGGSLRLSCA ASGYPYSNGYMGWFRQAP GKEREGVATIYTGDGRTY YADSVKGRFTISRDNAKN TVDLQMSSLKPEDTAMYY CAARAAPLYSSGSPLTRA RYNVWGQGTQVTVSS | 942 | F T F S H S G M S | 946 | TI NS GG AS TY YT DS VK G | 231 | GG SG YG DA SR MT SP | 195 | YPY SNG YMG | 201 | TIY TGD GRT YYA DSV KG | 207 | RA AP LY SS GS PL TR AR YN V |
| hIL27Ra-VHH17-DR593 | 716 | QVQLQESGGGLVQPGGSL RLSCAASGFTFSLSGMSW VRQAPGKGLEWVSAISSG GASTYYTDSVKGRFTISR DNAKNMLYLQLNSLKTED TAMYYCAKGGSGYGDASR MTSPGSQGTQVTVSSGGS GGSGGSGQVQLQESGGGS VQAGGSLRLSCAASGYPY SNGYMGWFRQAPGKEREG VATIYTGDGRTYYADSVK GRFTISRDNAKNTVDLQM SSLKPEDTAMYYCAARAA PLYSSGSPLTRARYNVWG QGTQVTVSS | 942 | F T F S H S G M S | 946 | TI NS GG AS TY YT DS VK G | 231 | GG SG YG DA SR MT SP | 195 | YPY SNG YMG | 201 | TIY TGD GRT YYA DSV KG | 207 | RA AP LY SS GS PL TR AR YN V |
| hIL27Ra-VHH18-DR593 | 717 | QVQLQESGGGSVQAGGSL RLSCVASGYVSCDYFLPS WYRQAPGKEREFVSIIDG TGSTSYAASVKGRFTASQ DKGKNIAYLQMNSLKPED TAMYYCKASCVRGRGISE YWGQGTQVTVSSGGSGGS GGSGQVQLQESGGGSVQA GGSLRLSCAASGYPYSNG YMGWFRQAPGKEREGVAT IYTGDGRTYYADSVKGRF TISRDNAKNTVDLQMSSL KPEDTAMYYCAARAAPLY SSGSPLTRARYNVWGQGT QVTVSS | 942 | F T F S H S G M S | 946 | TI NS GG AS TY YT DS VK G | 231 | GG SG YG DA SR MT SP | 195 | YPY SNG YMG | 201 | TIY TGD GRT YYA DSV KG | 207 | RA AP LY SS GS PL TR AR YN V |

TABLE 1A-continued

| Name | SEQ ID NO: | Sequence of dual VHH dimer | SEQ ID NO: | CDR1 | SEQ ID NO: | CDR2 | SEQ ID NO: | CDR3 | SEQ ID NO: | CDR4 | SEQ ID NO: | CDR5 | SEQ ID NO: | CDR6 |
|---|---|---|---|---|---|---|---|---|---|---|---|---|---|---|
| hIL27Ra-VHH19-DR593 | 718 | QVQLQESGGGSVQAGGSL RLSCRASGSTYSNYCLGW FRQITGKEREGVAVINWV GGMLYFADSVKGRFTVSD DQAKNTVYLQMNSLKPED TAMYYCAAESVSSFSCGG WLTRPDRVPYWGQGTQVT VSSGGSGGSGGSGQVQLQ ESGGGSVQAGGSLRLSCA ASGYPYSNGYMGWFRQAP GKEREGVATIYTGDGRTY YADSVKGRFTISRDNAKN TVDLQMSSLKPEDTAMYY CAARAAPLYSSGSPLTRA RYNVWGQGTQVTVSS | 942 | F T F S H S G M S | 946 | TI NS GG AS TY YT DS VK G | 231 | GG SG YG DA SR MT SP | 195 | YPY SNG YMG | 201 | TIY TGD GRT YYA DSV KG | 207 | RA AP LY SS GS PL TR AR YN V |
| hIL27Ra-VHH20-DR593 | 719 | QVQLQESGGGLVQPGGSL RLSCAASGFTFSSYPMSW VRQAPGKGLEWVSTISSG GDTTLYADSVKGRFTSSR DNAKNTLYLQLNSLKTED TAMYYCAKRIDCNSGYCY KRSYWGQGTQVTVSSGGS GGSGGSGGSGQVQLQESGGGS VQAGGSLRLSCAASGYPY SNGYMGWFRQAPGKEREG VATIYTGDGRTYYADSVK GRFTISRDNAKNTVDLQM SSLKPEDTAMYYCAARAA PLYSSGSPLTRARYNVWG QGTQVTVSS | 942 | F T F S H S G M S | 946 | TI NS GG AS TY YT DS VK G | 231 | GG SG YG DA SR MT SP | 195 | YPY SNG YMG | 201 | TIY TGD GRT YYA DSV KG | 207 | RA AP LY SS GS PL TR AR YN V |
| hIL27Ra-VHH21-DR593 | 720 | QVQLQESGGGLVQPGGSL RLSCAASGFTFSLSSMSW VRQAPGKGLEWVSAISSG GASTYYTDSVKGRFTISR DNAKNMLYLQLNSLKTED TAMYYCAKGGSGYGDASR MTSPGSQGTQVTVSSGGS GGSGGSGQVQLQESGGGS VQAGGSLRLSCAASGYPY SNGYMGWFRQAPGKEREG VATIYTGDGRTYYADSVK GRFTISRDNAKNTVDLQM SSLKPEDTAMYYCAARAA PLYSSGSPLTRARYNVWG QGTQVTVSS | 942 | F T F S H S G M S | 946 | TI NS GG AS TY YT DS VK G | 231 | GG SG YG DA SR MT SP | 195 | YPY SNG YMG | 201 | TIY TGD GRT YYA DSV KG | 207 | RA AP LY SS GS PL TR AR YN V |
| hIL27Ra-VHH22-DR593 | 721 | QVQLQESGGGSVQAGGSL RLSCRASGSTYSNYCLGW FRQTTGKEREGVAVINWV GGMLYFADSVKGRFTVSQ DQAKNTVYLQMNSLKPED TAMYYCAAESVSSFSCGG WLTRPDRVPYWGQGTQVT VSSGGSGGSGGSGQVQLQ ESGGGSVQAGGSLRLSCA ASGYPYSNGYMGWFRQAP GKEREGVATIYTGDGRTY YADSVKGRFTISRDNAKN TVDLQMSSLKPEDTAMYY CAARAAPLYSSGSPLTRA RYNVWGQGTQVTVSS | 942 | F T F S H S G M S | 946 | TI NS GG AS TY YT DS VK G | 231 | GG SG YG DA SR MT SP | 195 | YPY SNG YMG | 201 | TIY TGD GRT YYA DSV KG | 207 | RA AP LY SS GS PL TR AR YN V |
| hIL27Ra-VHH23-DR593 | 722 | QVQLQESGGGSVQAGGSL RLSCRASRSPYGNYCLGW FRQSTGKEREGVAVINWV GGMLYFADSVKGRFTVSQ DHAKNTVTLQMNSLKPED TAMYYCAAESVSSFSCGG WLTRPDRVPYWGQGTQVT VSSGGSGGSGGSGQVQLQ ESGGGSVQAGGSLRLSCA ASGYPYSNGYMGWFRQAP GKEREGVATIYTGDGRTY YADSVKGRFTISRDNAKN | 942 | F T F S H S G M S | 946 | TI NS GG AS TY YT DS VK G | 231 | GG SG YG DA SR MT SP | 195 | YPY SNG YMG | 201 | TIY TGD GRT YYA DSV KG | 207 | RA AP LY SS GS PL TR AR YN V |

TABLE 1A-continued

| Name | SEQ ID NO: | Sequence of dual VHH dimer | SEQ ID NO: CDR1 | CDR1 | SEQ ID NO: CDR2 | CDR2 | SEQ ID NO: CDR3 | CDR3 | SEQ ID NO: CDR4 | CDR4 | SEQ ID NO: CDR5 | CDR5 | SEQ ID NO: CDR6 | CDR6 |
|---|---|---|---|---|---|---|---|---|---|---|---|---|---|---|
| | | TVDLQMSSLKPEDTAMYY CAARAAPLYSSGSPLTRA RYNVWGQTQVTVSS | | | | | | | | | | | | |
| hIL27Ra-VHH24-DR593 | 723 | QVQLQESGGGLVQPGGSL RLSCAASGFTFSHSGMSW VRQAPGKGLEWVSTINSG GASTYYTDSVKGRFTISR DNAKNMLYLQLNSLKTED TAMYYCAKGGSGYGDASR MTSPGSQGTQVTVSSGGS GGSGGSGQVQLQESGGGS VQAGGSLRLSCAASGYPY SNGYMGWFRQAPGKEREG VATIYTGDRTYYADSVK GRFTISRDNAKNTVDLQM SSLKPEDTAMYYCAARAA PLYSSGSPLTRARYNVWG QGTQVTVSS | 942 | FTFSHSGMS | 946 | TINSGGAS TYYTDSVKG | 231 | GGSGYG DASRMTSP | 195 | YPYSNG YMG | 201 | TIYTGD GRTYYA DSVKG | 207 | RAAPLYSS GSPLTRAR YNV |
| hIL27Ra-VHH1-DR594 | 724 | QVQLQESGGGLVQPGGSL RLSCAASGFTFSSYPMSW VRQAPGKGLEWISTISAG GDTTLYADSVKGRFTSSR DNAKNTLYLQLNSLKTED AAIYYCAKRIDCNSGYCY RRNYWGQGTQVTVSSGGS GGSGGSGQVQLQESGGGS VQAGGSLRLSCVASASTY CTYDMHWYRQAPGKGREF VSAIDSDGTTRYADSVKG RFTISQGTAKNTVYLQMN SLQPEDTAMYYCKTVCVV GSRWSDYWGQGTQVTVSS | 942 | FTFSHSGMS | 946 | TINSGGAS TYYTDSVKG | 231 | GGSGYG DASRMTSP | 196 | STYCTY DMH | 202 | AIDSDG TTRYAD SVKG | 954 | VCVVGSR WSDY |
| hIL27Ra-VHH2-DR594 | 725 | QVQLQESGGGLVQPGGSL RLSCAASGFTFSLSGMSW VRQAPGKGLEWVSAISSG GASTYYTDSVKGRFTISR DNAKNILYLQLNSLKTED TAMYYCAKGGSGYGDASR MTSPGSQGTQVTVSSGGS GGSGGSGQVQLQESGGGS VQAGGSLRLSCVASASTY CTYDMHWYRQAPGKGREF VSAIDSDGTTRYADSVKG RFTISQGTAKNTVYLQMN SLQPEDTAMYYCKTVCVV GSRWSDYWGQGTQVTVSS | 942 | FTFSHSGMS | 946 | TINSGGAS TYYTDSVKG | 231 | GGSGYG DASRMTSP | 196 | STYCTY DMH | 202 | AIDSDG TTRYAD SVKG | 954 | VCVVGSR WSDY |
| hIL27Ra-VHH3-DR594 | 726 | QVQLQESGGGSVQAGGSL RLSCVASGYVSCDYFLPS WYRQAPGKEREFVSIIDG TGSTSYAASVKGRFTASE DKGKNIAYLQMNSLKPED TAMYYCKASCVRGRAVSE YWGQGTQVTVSSGGSGGS GGSGQVQLQESGGGSVQA GGSLRLSCVASASTYCTY DMHWYRQAPGKGREFVSA IDSDGTTRYADSVKGRFT ISQGTAKNTVYLQMNSLQ PEDTAMYYCKTVCVVGSR WSDYWGQGTQVTVSS | 942 | FTFSHSGMS | 946 | TINSGGAS TYYTDSVKG | 231 | GGSGYG DASRMTSP | 196 | STYCTY DMH | 202 | AIDSDG TTRYAD SVKG | 954 | VCVVGSR WSDY |
| hIL27Ra-VHH4-DR594 | 727 | QVQLQESGGGLVQPGESL RLSCTASGFTFSNYAMSW VRQAPGKGLEWVSGINVA YGITSYADSVKGRFTISR DNTKNTLYLQLNSLKTED TAIYYCVKHSGTTIPRGF ISYTKRGQGTQVTVSSGG SGGSGGSGQVQLQESGGG SVQAGGSLRLSCVASAST YCTYDMHWYRQAPGKGRE FVSAIDSDGTTRYADSVK | 942 | FTFSHSGMS | 946 | TINSGGAS TYYTDSVKG | 231 | GGSGYG DASRMTSP | 196 | STYCTY DMH | 202 | AIDSDG TTRYAD SVKG | 954 | VCVVGSR WSDY |

TABLE 1A-continued

| Name | SEQ ID NO: | Sequence of dual VHH dimer | SEQ ID NO: | CDR1 | SEQ ID NO: | CDR2 | SEQ ID NO: | CDR3 | SEQ ID NO: | CDR4 | SEQ ID NO: | CDR5 | SEQ ID NO: | CDR6 |
|---|---|---|---|---|---|---|---|---|---|---|---|---|---|---|
| | | GRFTISQGTAKNTVYLQM NSLQPEDTAMYYCKTVCV VGSRWSDYWGQGTQVTVS S | | | | | | | | | | | | |
| hIL27Ra-VHH5-DR594 | 728 | QVQLQESGGGSVQAGGSL RLSCTASGYVSCDYFLPS WYRQAPGKEREFVSVIDG TGSTSYAASVKGRFTASQ DKGKNIAYLQMNSLKPED TAMYYCKASCVRGRAISE YWGQGTQVTVSSGGSGGS GGSGQVQLQESGGGSVQA GGSLRLSCVASASTYCTY DMHWYRQAPGKGREFVSA IDSDGTTRYADSVKGRFT ISQGTAKNTVYLQMNSLQ PEDTAMYYCKTVCVVGSR WSDYWGQGTQVTVSS | 942 | FTFSHSGMS | 946 | TINSGGASTYYTDSVKG | 231 | GGSGYGDASRMTSP | 196 | STYCTYDMH | 202 | AIDSDGTTRYADSVKG | 954 | VCVVGSRWSDY |
| hIL27Ra-VHH6-DR594 | 729 | QVQLQESGGGLVQPGGSL RLSCAASGFSFSSYAMKW VRQAPGKGLEWVSTISSG GSSTNYADSVKGRFTISR DNAKNTLYLQLNSLKIED TAMYYCAKAIVPTGATME RGQGTQVTVSSGGSGGSG GSGQVQLQESGGGSVQAG GSLRLSCVASASTYCTYD MHWYRQAPGKGREFVSAI DSDGTTRYADSVKGRFTI SQGTAKNTVYLQMNSLQP EDTAMYYCKTVCVVGSRW SDYWGQGTQVTVSS | 942 | FTFSHSGMS | 946 | TINSGGASTYYTDSVKG | 231 | GGSGYGDASRMTSP | 196 | STYCTYDMH | 202 | AIDSDGTTRYADSVKG | 954 | VCVVGSRWSDY |
| hIL27Ra-VHH7-DR594 | 730 | QVQLQESGGGLVQPGGSL RLSCAASGFTFSSYPMSW VRQAPGKGLEWISTISAG GDTTLYADSVKGRFTSSR DNAKNTLYLQLNSLKTED TAIYYCAKRIDCNSGYCY RRNYWGQGTQVTVSSGGS GGSGGSGQVQLQESGGGS VQAGGSLRLSCVASASTY CTYDMHWYRQAPGKGREF VSAIDSDGTTRYADSVKG RFTISQGTAKNTVYLQMN SLQPEDTAMYYCKTVCVV GSRWSDYWGQGTQVTVSS | 942 | FTFSHSGMS | 946 | TINSGGASTYYTDSVKG | 231 | GGSGYGDASRMTSP | 196 | STYCTYDMH | 202 | AIDSDGTTRYADSVKG | 954 | VCVVGSRWSDY |
| hIL27Ra-VHH8-DR594 | 731 | QVQLQESGGGSVQVGGSL RLSCAASGFTFSSYPMSW VRQAPGKGLEWISTISAG GDTTLYADSVKGRFTSSR DNAKNTLYLQLNSLKTED TAIYYCAKRIDCNSGYCY RRNYWGQGTQVTVSSGGS GGSGGSGQVQLQESGGGS VQAGGSLRLSCVASASTY CTYDMHWYRQAPGKGREF VSAIDSDGTTRYADSVKG RFTISQGTAKNTVYLQMN SLQPEDTAMYYCKTVCVV GSRWSDYWGQGTQVTVSS | 942 | FTFSHSGMS | 946 | TINSGGASTYYTDSVKG | 231 | GGSGYGDASRMTSP | 196 | STYCTYDMH | 220 | AIDSDGTTRYADSVKG | 954 | VCVVGSRWSDY |
| hIL27Ra-VHH9-DR594 | 732 | QVQLQESGGGSVQSGGSL RLSCAASGFTYSTSNSWM AWFRQAPGKEREGVAAIY TVGGSIFYADSVRGRFTI SQDATKNMFYLQMNTLKP EDTAMYYCAAASGRLRGK WFWPYEYNYWGQGTQVTV SSGGSGGSGGSGQVQLQE SGGGSVQAGGSLRLSCVA SASTYCTYDMHWYRQAPG KGREFVSAIDSDGTTRYA | 942 | FTFSHSGMS | 946 | TINSGGASTYYTDSVKG | 231 | GGSGYGDASRMTSP | 196 | STYCTYDMH | 202 | AIDSDGTTRYADSVKG | 954 | VCVVGSRWSDY |

TABLE 1A-continued

| Name | SEQ ID NO: | Sequence of dual VHH dimer | SEQ ID NO: CDR1 | CDR1 | SEQ ID NO: CDR2 | CDR2 | SEQ ID NO: CDR3 | CDR3 | SEQ ID NO: CDR4 | CDR4 | SEQ ID NO: CDR5 | CDR5 | SEQ ID NO: CDR6 | CDR6 |
|---|---|---|---|---|---|---|---|---|---|---|---|---|---|---|
| | | DSVKGRFTISQGTAKNTV YLQMNSLQPEDTAMYYCK TVCVVGSRWSDYWGQGTQ VTVSS | | | | | | | | | | | | |
| hIL27Ra-VHH10-DR594 | 733 | QVQLQESGGGSVQAGGSL RLSCRASGSTYSNYCLGW FRQITGKEREGVAVINWV GGMLYFADSVKGRFTVSQ DQAKNTLYLQMNSLKPED TAMYYCAAESVSSFSCGG WLTRPDRVPYWGQGTQVT VSSGGSGGSGGSGQVQLQ ESGGGSVQAGGSLRLSCV ASASTYCTYDMHWYRQAP GKGREFVSAIDSDGTTRY ADSVKGRFTISQGTAKNT VYLQMNSLQPEDTAMYYC KTVCVVGSRWSDYWGQGT QVTVSS | 942 | FTFSHSGMS | 946 | TINSGGASTYYTDSVKG | 231 | GGSGYGDASRMTSP | 196 | STYCTYDMH | 202 | AIDSDGTTRYADSVKG | 954 | VCVVGSRWSDY |
| hIL27Ra-VHH11-4 DR59 | 734 | QVQLQESGGGSVQAGGSL RLSCRASGSTYSNYCLGW FRQSTGKEREGVAVINWV GGMLYFADSVKGRFTVSQ DHAKNTVTLQMNSLKPED TAMYYCAAESVSSFSCGG WLTRPGRVPYWGQGTQVT VSSGGSGGSGGSGQVQLQ ESGGGSVQAGGSLRLSCV ASASTYCTYDMHWYRQAP GKGREFVSAIDSDGTTRY ADSVKGRFTISQGTAKNT VYLQMNSLQPEDTAMYYC KTVCVVGSRWSDYWGQGT QVTVSS | 942 | FTFSHSGMS | 946 | TINSGGASTYYTDSVKG | 231 | GGSGYGDASRMTSP | 196 | STYCTYDMH | 202 | AIDSDGTTRYADSVKG | 954 | VCVVGSRWSDY |
| hIL27Ra-VHH12-DR594 | 735 | QVQLQESGGGSVQAGESL RLSCRASGSTYSNYCLGW FRQITGKEREGVAVINWV GGMLYFADSVKGRFTVSQ DQAKNTVYLEMNSLKPED TAMYYCATESVSSFSCGG WLTRPDRVPYWGQGTQVT VSSGGSGGSGGSGQVQLQ ESGGGSVQAGGSLRLSCV ASASTYCTYDMHWYRQAP GKGREFVSAIDSDGTTRY ADSVKGRFTISQGTAKNT VYLQMNSLQPEDTAMYYC KTVCVVGSRWSDYWGQGT QVTVSS | 942 | FTFSHSGMS | 946 | TINSGGASTYYTDSVKG | 231 | GGSGYGDASRMTSP | 196 | STYCTYDMH | 202 | AIDSDGTTRYADSVKG | 954 | VCVVGSRWSDY |
| hIL27Ra-VHH13-DR594 | 736 | QVQLQESGGGSVQAGGSL RLSCVASGYVSCDYFLPS WYRQAPGKEREFVSIIDG TGSTSYAASVKGRFTASQ DRGKNIAYLQMNSLKPED TAMYYCKASCVRGRTISE YWGQGTQVTVSSGGSGGS GGSGQVQLQESGGGSVQA GGSLRLSCVASASTYCTY DMHWYRQAPGKGREFVSA IDSDGTTRYADSVKGRFT ISQGTAKNTVYLQMNSLQ PEDTAMYYCKTVCVVGSR WSDYWGQGTQVTVSS | 942 | FTFSHSGMS | 946 | TINSGGASTYYTDSVKG | 231 | GGSGYGDASRMTSP | 196 | STYCTYDMH | 202 | AIDSDGTTRYADSVKG | 954 | VCVVGSRWSDY |
| hIL27Ra-VHH14-DR594 | 737 | QVQLQESGGGSVQAGGSL RLSCVASGYVSCDYFLPS WYRQAPGKEREFVSIIDG TGSTSYAASVKGRFTASQ DKGKNIAYLQMNSLKPED TAMYYCKASCVRGRAISE YWGQGTQVTVSSGGSGGS GGSGQVQLQESGGGSVQA | 942 | FTFSHSGMS | 946 | TINSGGASTYYTDSVKG | 231 | GGSGYGDASRMTSP | 196 | STYCTYDMH | 202 | AIDSDGTTRYADSVKG | 954 | VCVVGSRWSDY |

TABLE 1A-continued

| Name | SEQ ID NO: | Sequence of dual VHH dimer | SEQ ID NO: | CDR1 | SEQ ID NO: | CDR2 | SEQ ID NO: | CDR3 | SEQ ID NO: | CDR4 | SEQ ID NO: | CDR5 | SEQ ID NO: | CDR6 |
|---|---|---|---|---|---|---|---|---|---|---|---|---|---|---|
| | | GGSLRLSCVASASTYCTY DMHWYRQAPGKGREFVSA IDSDGTTRYADSVKGRFT ISQGTAKNTVYLQMNSLQ PEDTAMYYCKTVCVVGSR WSDYWGQGTQVTVSS | | S | | G | | | | | | | | |
| hIL27Ra-VHH15-DR594 | 738 | QVQLQESGGGSVQAGGSL RLSCVASGYVSCDYFLPS WYRQAPGKEREFVSIIDG TGSTSYAASVKGRFTASQ DKGKNIAYLQMNTLKPED TAMYYCKASCVRGRAISE YWGQGTQVTVSSGGSGGS GGSGQVQLQESGGGSVQA GGSLRLSCVASASTYCTY DMHWYRQAPGKGREFVSA IDSDGTTRYADSVKGRFT ISQGTAKNTVYLQMNSLQ PEDTAMYYCKTVCVVGSR WSDYWGQGTQVTVSS | 942 | F T F S H S G M S | 946 | TI NS GG AS TY YT DS VK G | 231 | GG SG YG DA SR MT SP | 196 | STY CTY DMH | 202 | AID SDG TTR YAD SVK G | 954 | VC VV GS RW SD Y |
| hIL27Ra-VHH16-DR594 | 739 | QVQLQESGGGSVQAGGSL RLSCRASGSTYSNYCLGW FRQITGKEREGVAVINWV GGMLYFADSVKGRFTVSQ DQAKNTVYLQMNSLKPED TAMYYCAAESASSFSCGG WLTRPDRVPYWGQGTQVT VSSGGSGGSGGSGQVQLQ ESGGGSVQAGGSLRLSCV ASASTYCTYDMHWYRQAP GKGREFVSAIDSDGTTRY ADSVKGRFTISQGTAKNT VYLQMNSLQPEDTAMYYC KTVCVVGSRWSDYWGQGT QVTVSS | 942 | F T F S H S G M S | 946 | TI NS GG AS TY YT DS VK G | 231 | GG SG YG DA SR MT SP | 196 | STY CTY DMH | 202 | AID SDG TTR YAD SVK G | 954 | VC VV GS RW SD Y |
| hIL27Ra-VHH17-DR594 | 740 | QVQLQESGGGLVQPGGSL RLSCAASGFTFSLSGMSW VRQAPGKGLEWVSAISSG GASTYYTDSVKGRFTISR DNAKNMLYLQLNSLKTED TAMYYCAKGGSGYGDASR MTSPGSQGTQVTVSSGGS GGSGGSGQVQLQESGGGS VQAGGSLRLSCVASASTY CTYDMHWYRQAPGKGREF VSAIDSDGTTRYADSVKG RFTISQGTAKNTVYLQMN SLQPEDTAMYYCKTVCVV GSRWSDYWGQGTQVTVSS | 942 | F T F S H S G M S | 946 | TI NS GG AS TY YT DS VK G | 231 | GG SG YG DA SR MT SP | 196 | STY CTY DMH | 202 | AID SDG TTR YAD SVK G | 954 | VC VI GS RW SD Y |
| hIL27Ra-VHH18-DR594 | 741 | QVQLQESGGGSVQAGGSL RLSCVASGYVSCDYFLPS WYRQAPGKEREFVSIIDG TGSTSYAASVKGRFTASQ DKGKNIAYLQMNSLKPED TAMYYCKASCVRGRGISE YWGQGTQVTVSSGGSGGS GGSGQVQLQESGGGSVQA GGSLRLSCVASASTYCTY DMHWYRQAPGKGREFVSA IDSDGTTRYADSVKGRFT ISQGTAKNTVYLQMNSLQ PEDTAMYYCKTVCVVGSR WSDYWGQGTQVTVSS | 942 | F T F S H S G M S | 946 | TI NS GG AS TY YT DS VK G | 231 | GG SG YG DA SR MT SP | 196 | STY CTY DMH | 202 | AID SDG TTR YAD SVK G | 954 | VC VV GS RW S Y |
| hIL27Ra-VHH19-DR594 | 742 | QVQLQESGGGSVQAGGSL RLSCRASGSTYSNYCLGW FRQITGKEREGVAVINWV GGMLYFADSVKGRFTVSQ DQAKNTVYLQMNSLKPED TAMYYCAAESVSSFSCGG WLTRPDRVPYWGQGTQVT VSSGGSGGSGGSGQVQLQ | 924 | F T F S H S G M | 946 | TI NS GG AS TY YT DS VK | 231 | GG SG YG DA SR MT SP | 196 | STY CTY DMH | 202 | AID SDG TTR YAD SVK G | 954 | VC VV GS RW SD Y |

TABLE 1A-continued

| Name | SEQ ID NO: | Sequence of dual VHH dimer | SEQ ID NO: CDR1 | SEQ ID NO: CDR2 | SEQ ID NO: CDR3 | SEQ ID NO: CDR4 | SEQ ID NO: CDR5 | SEQ ID NO: CDR6 |
|---|---|---|---|---|---|---|---|---|
| | | ESGGGSVQAGGSLRLSCV ASASTYCTYDMHWYRQAP GKGREFVSAIDSDGTTRY ADSVKGRFTISQGTAKNT VYLQMNSLQPEDTAMYYC KTVCVVGSRWSDYWGQGT QVTVSS | | S | G | | | |
| hIL27Ra-VHH20-DR594 | 743 | QVQLQESGGGLVQPGGSL RLSCAASGFTFSSYPMSW VRQAPGKGLEWVSTISSG GDTTLYADSVKGRFTSSR DNAKNTLYLQLNSLKTED TAMYYCAKRIDCNSGYCY KRSYWGQGTQVTVSSGGS GGSGGSGQVQLQESGGGS VQAGGSLRLSCVASASTY CTYDMHWYRQAPGKGREF VSAIDSDGTTRYADSVKG RFTISQGTAKNTVYLQMN SLQPEDTAMYYCKTVCVV GSRWSDYWGQGTQVTVSS | 942 F T F S H S G M S | 946 TI NS GG AS TY YT DS VK G | 231 GG SG YG DA SR MT SP | 196 STY CTY DMH | 202 AID SDG TTR YAD SVK G | 954 VC VV GS RW SD Y |
| hIL27Ra-VHH21-DR594 | 744 | QVQLQESGGGLVQPGGSL RLSCAASGFTFSLSSSMSW VRQAPGKGLEWVSAISSG GASTYYTDSVKGRFTISR DNAKNMLYLQLNSLKTED TAMYYCAKGGSGYGDASR MTSPGSQGTQVTVSSGGS GGSGGSGQVQLQESGGGS VQAGGSLRLSCVASASTY CTYDMHWYRQAPGKGREF VSAIDSDGTTRYADSVKG RFTISQGTAKNTVYLQMN SLQPEDTAMYYCKTVCVV GSRWSDYWGQGTQVTVSS | 942 F T F S H S G M S | 946 TI NS GG AS TY YT DS VK G | 231 GG SG YG DA SR MT SP | 196 STY CTY DMH | 202 AID SDG TTR YAD SVK G | 954 VC VV GS RW SD Y |
| hIL27Ra-VHH22-DR594 | 745 | QVQLQESGGGSVQAGGSL RLSCRASGSTYSNYCLGW FRQTTGKEREGVAVINWV GGMLYFADSVKGRFTVSQ DQAKNTVYLQMNSLKPED TAMYYCAAESVSSFSCGG WLTRPDRVPYWGQGTQVT VSSGGSGGSGGSGQVQLQ ESGGGSVQAGGSLRLSCV ASASTYCTYDMHWYRQAP GKGREFVSAIDSDGTTRY ADSVKGRFTISQGTAKNT VYLQMNSLQPEDTAMYYC KTVCVVGSRWSDYWGQGT QVTVSS | 942 F T F S H S G M S | 946 TI NS GG AS TY YT DS VK G | 231 GG SG YG DA SR MT SP | 196 STY CTY DMH | 202 AID SDG TTR YAD SVK G | 954 VC VV GS RW SD Y |
| hIL27Ra-VHH23-DR594 | 746 | QVQLQESGGGSVQAGGSL RLSCRASRSPYGNYCLGW FRQSTGKEREGVAVINWV GGMLYFADSVKGRFTVSQ DHAKNTVTLQMNSLKPED TAMYYCAAESVSSFSCGG WLTRPDRVPYWGQGTQVT VSSGGSGGSGGSGQVQLQ ESGGGSVQAGGSLRLSCV ASASTYCTYDMHWYRQAP GKGREFVSAIDSDGTTRY ADSVKGRFTISQGTAKNT VYLQMNSLQPEDTAMYYC KTVCVVGSRWSDYWGQGT QVTVSS | 942 F T F S H S G M S | 946 TI NS GG AS TY YT DS VI G | 231 GG SG YG DA SR MT SP | 196 STY CTY DMH | 202 AID SDG TTR YAD SVK G | 945 VC wv GS RW SD Y |
| hIL27Ra-VHH24-DR594 | 747 | QVQLQESGGGLVQPGGSL RLSCAASGFTFSHSGMSW VRQAPGKGLEWVSTINSG GASTYYTDSVKGRFTISR DNAKNMLYLQLNSLKTED TAMYYCAKGGSGYGDASR | 942 F T F S H S | 946 TI NS GG AS TY YT | 231 GG SG YG DA SR MT | 196 STY CTY DMH | 202 AID SDG TTR YAD SVK G | 954 VC VV GS RW SD Y |

TABLE 1A-continued

| Name | SEQ ID NO: | Sequence of dual VHH dimer | SEQ ID NO: CDR1 | SEQ ID NO: CDR2 | SEQ ID NO: CDR3 | SEQ ID NO: CDR4 | SEQ ID NO: CDR5 | SEQ ID NO: CDR6 |
|---|---|---|---|---|---|---|---|---|
| | | MTSPGSQGTQVTVSSGGS GGSGGSGQVQLQESGGGS VQAGGSLRLSCVASASTY CTYDMHWYRQAPGKGREF VSAIDSDGTTRYADSVKG RFTISQGTAKNTVYLQMN SLQPEDTAMYYCKTVCVV GSRWSDYWGQGTQVTVSS | | G M S | | DS VK G | | SP | |
| hIL27Ra-VHH1-DR595 | 748 | QVQLQESGGGLVQPGGSL RLSCAASGFTFSSYPMSW VRQAPGKGLEWISTISAG GDTTLYADSVKGRFTSSR DNAKNTLYLQLNSLKTED AAIYYCAKRIDCNSGYCY RRNYWGQGTQVTVSSGGS GGSGGSGQVQLQESGGGS VQAGGSLTLSCAASEYAY STCNMGWYRQAPGKEREL VSAFISDGSTYYADSVKG RFTITRDNAKNTVYLQMN SLKPEDTAIYYCSANCYR RLRNYWGQGTQVTVSS | 942 | F T F S H S G M S | 946 | TI NS G AS TY YT DS VK G | 231 | GG SG YG DA SR MT SP | 197 | YAY STC NMG | 203 | AFI SDG STY YAD SVK G | 209 | NC YR RL RN Y |
| hIL27Ra-VHH2-DR595 | 749 | QVQLQESGGGLVQPGGSL RLSCAASGFTFSLSGMSW VRQAPGKGLEWVSAISSG GASTYYTDSVKGRFTISR DNAKNILYLQLNSLKTED TAMYYCAKGGSGYGDASR MTSPGSQGTQVTVSSGGS GGSGGSGQVQLQESGGGS VQAGGSLTLSCAASEYAY STCNMGWYRQAPGKEREL VSAFISDGSTYYADSVKG RFTITRDNAKNTVYLQMN SLKPEDTAIYYCSANCYR RLRNYWGQGTQVTVSS | 942 | F T F S H S G M S | 946 | TI NS GG AS TY YT DS VK G | 231 | GG SG YG DA SR MT SP | 197 | YAY STC NMG | 203 | AFI SDG STY YAD SVK G | 209 | NC YR RL RN Y |
| hIL27Ra-VHH3-DR595 | 750 | QVQLQESGGGSVQAGGSL RLSCVASGYVSCDYFLPS WYRQAPGKEREFVSIIDG TGSTSYAASVKGRFTASE DKGKNIAYLQMNSLKPED TAMYYCKASCVRGRAVSE YWGQGTQVTVSSGGSGGS GGSGQVQLQESGGGSVQA GGSLTLSCAASEYAYSTC NMGWYRQAPGKERELVSA FISDGSTYYADSVKGRFT ITRDNAKNTVYLQMNSLK PEDTAIYYCSANCYRRLR NYWGQGTQVTVSS | 942 | F T F S H S G M S | 946 | TI NS GG AS TY YT DS VK G | 231 | GG SG YG DA SR MT SP | 197 | YAY STC NMG | 203 | AFI SDG STY YAD SVK G | 209 | NC YR RL RN Y |
| hIL27Ra-VHH4-DR595 | 751 | QVQLQESGGGLVQPGESL RLSCTASGFTFSNYAMSW VRQAPGKGLEWVSGINVA YGITSYADSVKGRFTISR DNTKNTLYLQLNSLKTED TAIYYCVKHSGTTIPRGF ISYTKRGQGTQVTVSSGG SGGSGGSGQVQLQESGGG SVQAGGSLTLSCAASEYA YSTCNMGWYRQAPGKERE LVSAFISDGSTYYADSVK GRFTITRDNAKNTVYLQM NSLKPEDTAIYYCSANCY RRLRNYWGQGTQVTVSS | 942 | F T F S H S G M S | 946 | TI NS GG AS TY YT DS VK G | 231 | GG SG YG DA SR MT SP | 197 | YAY STC NMG | 203 | AFI SDG STY YAD SVK G | 209 | NC YR RL RN Y |
| hIL27Ra-VHH5-DR595 | 752 | QVQLQESGGGSVQAGGSL RLSCTASGYVSCDYFLPS WYRQAPGKEREFVSVIDG TGSTSYAASVKGRFTASQ DKGKNIAYLQMNSLKPED TAMYYCKASCVRGRAISE YWGQGTQVTVSSGGSGGS | 942 | F T F S H S G | 946 | TI NS GG AS TY YT DS | 231 | GG SG YG DA SR MT SP | 197 | YAY STC NMG | 203 | AFI SDG STY YAD SVK G | 209 | NC YR RL RN Y |

TABLE 1A-continued

| Name | SEQ ID NO: | Sequence of dual VHH dimer | SEQ ID NO: CDR1 | SEQ ID NO: CDR2 | SEQ ID NO: CDR3 | SEQ ID NO: CDR4 | SEQ ID NO: CDR5 | SEQ ID NO: CDR6 |
|---|---|---|---|---|---|---|---|---|
| | | GGSGQVQLQESGGGSVQA GGSLTLSCAASEYAYSTC NMGWYRQAPGKERELVSA FISDGSTYYADSVKGRFT ITRDNAKNTVYLQMNSLK PEDTAIYYCSANCYRRLR NYWGQGTQVTVSS | | M S | VK G | | | |
| hIL27Ra-VHH6-DR595 | 753 | QVQLQESGGGLVQPGGSL RLSCAASGFSFSSYAMKW VRQAPGKGLEWVSTISSG GSSTNYADSVKGRFTISR DNAKNTLYLQLNSLKIED TAMYYCAKAIVPTGATME RGQGTQVTVSSGGSGGSG GSGQVQLQESGGGSVQAG GSLTLSCAASEYAYSTCN MGWYRQAPGKERELVSAF ISDGSTYYADSVKGRFTI TRDNAKNTVYLQMNSLKP EDTAIYYCSANCYRRLRN YWGQGTQVTVSS | 942 | F T F S H S G M S | 946 | TI NS GG AS TY YT DS VK G | 231 | GG SG YG DA SR MT SP | 197 | YAY STC NMG | 203 | AFI SDG STY YAD SVK G | 209 | NC YR RL RN Y |
| hIL27Ra-VHH7-DR595 | 754 | QVQLQESGGGLVQPGGSL RLSCAASGFTFSSYPMSW VRQAPGKGLEWISTISAG GDTTLYADSVKGRFTSSR DNAKNTLYLQLNSLKTED TAIYYCAKRIDCNSGYCY RRNYWGQGTQVTVSSGGS GGSGGSGQVQLQESGGGS VQAGGSLTLSCAASEYAY STCNMGWYRQAPGKEREL VSAFISDGSTYYADSVKG RFTITRDNAKNTVYLQMN SLKPEDTAIYYCSANCYR RLRNYWGQGTQVTVSS | 942 | F T F S H S G M S | 946 | TI NS GG AS TY YT DS VK G | 231 | GG SG YG DA SR MT SP | 197 | YAY STC NMG | 203 | AFI SDG STY YAD SVK G | 209 | NC YR RL RN Y |
| hIL27Ra-VHH8-DR595 | 755 | QVQLQESGGGSVQVGGSL RLSCAASGFTFSSYPMSW VRQAPGKGLEWISTISAG GDTTLYADSVKGRFTSSR DNAKNTLYLQLNSLKTED TAIYYCAKRIDCNSGYCY RRNYWGQGTQVTVSSGGS GGSGGSGQVQLQESGGGS VQAGGSLTLSCAASEYAY STCNMGWYRQAPGKEREL VSAFISDGSTYYADSVKG RFTITRDNAKNTVYLQMN SLKPEDTAIYYCSANCYR RLRNYWGQGTQVTVSS | 942 | F T F S H S G M S | 946 | TI NS GG AS TY YT DS VK G | 231 | GG SG YG DA SR MT SP | 197 | YAY STC NMG | 203 | AFI SDG STY YAD SVK G | 209 | NC YR RL RN Y |
| hIL27Ra-VHH9-DR595 | 756 | QVQLQESGGGSVQSGGSL RLSCAASGFTYSTSNSWM AWFRQAPGKEREGVAAIY TVGGSIFYADSVRGRFTI SQDATKNMFYLQMNTLKP EDTAMYYCAAASGRLRGK WFWPYEYNYWGQGTQVTV SSGGSGGSGGSGQVQLQE SGGGSVQAGGSLTLSCAA SEYAYSTCNMGWYRQAPG KERELVSAFISDGSTYYA DSVKGRFTITRDNAKNTV YLQMNSLKPEDTAIYYCS ANCYRRLRNYWGQGTQVT VSS | 942 | F T F S H S G M S | 946 | TI NS GG AS TY YT DS VI G | 231 | GG SG YG DA SR MT SP | 197 | YAY STC NMG | 203 | AFI SDG STY YAD SVK G | 209 | NC YR RL RN Y |
| hIL27Ra-VHH10-DR595 | 757 | QVQLQESGGGSVQAGGSL RLSCRASGSTYSNYCLGW FRQITGKEREGVAVINWV GGMLYFADSVKGRFTVSQ DQAKNTLYLQMNSLKPED TAMYYCAAESVSSFSCGG WLTRPDRVPYWGQGTQVT | 942 | F T F S H S G | 946 | TI NS GG AS TY YT DS | 231 | GG SG YG DA SR MT SP | 197 | YAY STC NMG | 203 | AFI SDG STY YAD SVK G | 209 | NC YR RL RN Y |

TABLE 1A-continued

| Name | SEQ ID NO: | Sequence of dual VHH dimer | SEQ ID NO: | CDR1 | SEQ ID NO: | CDR2 | SEQ ID NO: | CDR3 | SEQ ID NO: | CDR4 | SEQ ID NO: | CDR5 | SEQ ID NO: | CDR6 |
|---|---|---|---|---|---|---|---|---|---|---|---|---|---|---|
| | | VSSGGSGGSGGSGQVLQ ESGGGSVQAGGSLTLSCA ASEYAYSTCNMGWYRQAP GKERELVSAFISDGSTYY ADSVKGRFTITRDNAKNT VYLQMNSLKPEDTAIYYC SANCYRRLRNYWGQGTQV TVSS | | M S | | VK G | | | | | | | | |
| hIL27Ra-VHH11-DR595 | 758 | QVQLQESGGGSVQAGGSL RLSCRASGSTYSNYCLGW FRQSTGKEREGVAVINWV GGMLYFADSVKGRFTVSQ DHAKNTVTLQMNSLKPED TAMYYCAAESVSSFSCGG WLTRPGRVPYWGQGTQVT VSSGGSGGSGGSGQVLQ ESGGGSVQAGGSLTLSCA ASEYAYSTCNMGWYRQAP GKERELVSAFISDGSTYY ADSVKGRFTITRDNAKNT VYLQMNSLKPEDTAIYYC SANCYRRLRNYWGQGTQV TVSS | 942 | F T F S H S G M S | 946 | TI NS GG AS TY YT DS VK G | 231 | GG SG YG DA SR MT SP | 197 | YAY STC NMG | 203 | AFI SDG STY YAD SVK G | 209 | NC YR RL RN Y |
| hIL27Ra-VHH12-DR595 | 759 | QVQLQESGGGSVQAGESL RLSCRASGSTYSNYCLGW FRQITGKEREGVAVINWV GGMLYFADSVKGRFTVSQ DQAKNTVYLEMNSLKPED TAMYYCATESVSSFSCGG WLTRPDRVPYWGQGTQVT VSSGGSGGSGGSGQVLQ ESGGGSVQAGGSLTLSCA ASEYAYSTCNMGWYRQAP GKERELVSAFISDGSTYY ADSVKGRFTITRDNAKNT VYLQMNSLKPEDTAIYYC SANCYRRLRNYWGQGTQV TVSS | 942 | F T F S H S G M S | 946 | TI NS GG AS TY YT DS VK G | 231 | GG SG YG DA SR MT SP | 197 | YAY STC NMG | 203 | AFI SDG STY YAD SVK G | 209 | NC YR RL RN Y |
| hIL27Ra-VHH13-DR595 | 760 | QVQLQESGGGSVQAGGSL RLSCVASGYVSCDYFLPS WYRQAPGKEREFVSIIDG TGSTSYAASVKGRFTASQ DRGKNIAYLQMNSLKPED TAMYYCKASCVRGRTISE YWGQGTQVTVSSGGSGGS GGSGQVLQESGGGSVQA GGSLTLSCAASEYAYSTC NMGWYRQAPGKERELVSA FISDGSTYYADSVKGRFT ITRDNAKNTVYLQMNSLK PEDTAIYYCSANCYRRLR NYWGQGTQVTVSS | 942 | F T F S H S G M S | 946 | TI NS GG AS TY YT DS VK G | 231 | GG SG YG DA SR MT SP | 197 | YAY STC NMG | 203 | AFI SDG STY YAD SVK G | 209 | NC YR RL RN Y |
| hIL27Ra-VHH14-DR595 | 761 | QVQLQESGGGSVQAGGSL RLSCVASGYVSCDYFLPS WYRQAPGKEREFVSIIDG TGSTSYAASVKGRFTASQ DKGKNIAYLQMNSLKPED TAMYYCKASCVRGRAISE YWGQGTQVTVSSGGSGGS GGSGQVLQESGGGSVQA GGSLTLSCAASEYAYSTC NMGWYRQAPGKERELVSA FISDGSTYYADSVKGRFT ITRDNAKNTVYLQMNSLK PEDTAIYYCSANCYRRLR NYWGQGTQVTVSS | 942 | F T F S H S G | 946 | TI NS GG AS TY YT DS VK G | 231 | GG SG YG DA SR MT SP | 197 | YAY STC NMG | 203 | AFI SDG STY YAD SVK G | 209 | NC YR RL RN Y |
| hIL27Ra-VHH15-DR595 | 762 | QVQLQESGGGSVQAGGSL RLSCVASGYVSCDYFLPS WYRQAPGKEREFVSIIDG TGSTSYAASVKGRFTASQ DKGKNIAYLQMNTLKPED | 942 | F T F S H | 946 | TI NS GG AS TY | 231 | GG SG YG DA SR | 197 | YAY STC NMG | 203 | AFI SDG STY YAD SVK | 209 | NC YR RL RN Y |

TABLE 1A-continued

| Name | SEQ ID NO: | Sequence of dual VHH dimer | SEQ ID NO: | CDR1 | SEQ ID NO: | CDR2 | SEQ ID NO: | CDR3 | SEQ ID NO: | CDR4 | SEQ ID NO: | CDR5 | SEQ ID NO: | CDR6 |
|---|---|---|---|---|---|---|---|---|---|---|---|---|---|---|
| | | TAMYYCKASCVRGRAISE YWGQGTQVTVSSGGSGGS GGSGQVQLQESGGGSVQA GGSLTLSCAASEYAYSTC NMGWYRQAPGKERELVSA FISDGSTYYADSVKGRFT ITRDNAKNTVYLQMNSLK PEDTAIYYCSANCYRRLR NYWGQGTQVTVSS | | S G M S | | YT DS VK G | | MT SP | | | | G | | |
| hIL27Ra-VHH16-DR595 | 763 | QVQLQESGGGSVQAGGSL RLSCRASGSTYSNYCLGW FRQITGKEREGVAVINWV GGMLYFADSVKGRFTVSQ DQAKNTVYLQMNSLKPED TAMYYCAAESASSFSCGG WLTRPDRVPYWGQGTQVT VSSGGSGGSGGSGQVQLQ ESGGGSVQAGGSLTLSCA ASEYAYSTCNMGWYRQAP GKERELVSAFISDGSTYY ADSVKGRFTITRDNAKNT VYLQMNSLKPEDTAIYYC SANCYRRLRNYWGQGTQV TVSS | 942 | F T F S H S G M S | 946 | TI NS GG AS TY YT DS VK G | 231 | GG SG YG DA SR MT SP | 197 | YAY STC NMG | 203 | AFI SDG STY YAD SVK G | 209 | NC YR RL RN Y |
| hIL27Ra-VHH17-DR595 | 764 | QVQLQESGGGLVQPGGSL RLSCAASGFTFSLSGMSW VRQAPGKGLEWVSAISSG GASTYYTDSVKGRFTISR DNAKNMLYLQLNSLKTED TAMYYCAKGGSGYGDASR MTSPGSQGTQVTVSSGGS GGSGGSGQVQLQESGGGS VQAGGSLTLSCAASEYAY STCNMGWYRQAPGKEREL VSAFISDGSTYYADSVKG RFTITRDNAKNTVYLQMN SLKPEDTAIYYCSANCYR RLRNYWGQGTQVTVSS | 942 | F T F S H S G M S | 946 | TI NS GG AS TY YT DS VK G | 231 | GG SG YG DA SR MT SP | 197 | YAY STC NMG | 203 | AFI SDG STY YAD SVK G | 209 | NC YR RL RN Y |
| hIL27Ra-VHH18-DR595 | 765 | QVQLQESGGGSVQAGGSL RLSCVASGYVSCDYFLPS WYRQAPGKEREFVSIIDG TGSTSYAASVKGRFTASQ DKGKNIAYLQMNSLKPED TAMYYCKASCVRGRGISE YWGQGTQVTVSSGGSGGS GGSGQVQLQESGGGSVQA GGSLTLSCAASEYAYSTC NMGWYRQAPGKERELVSA FISDGSTYYADSVKGRFT ITRDNAKNTVYLQMNSLK PEDTAIYYCSANCYRRLR NYWGQGTQVTVSS | 942 | F T F S H S G M S | 946 | TI NS GG AS TY YT DS VK G | 231 | GG SG YG DA SR MT SP | 197 | YAY STC NMG | 203 | AFI SDG STY YAD SVK G | 209 | NC YR RL RN Y |
| hIL27Ra-VHH19-DR595 | 766 | QVQLQESGGGSVQAGGSL RLSCRASGSTYSNYCLGW FRQITGKEREGVAVINWV GGMLYFADSVKGRFTVSQ DQAKNTVYLQMNSLKPED TAMYYCAAESVSSFSCGG WLTRPDRVPYWGQGTQVT VSSGGSGGSGGSGQVQLQ ESGGGSVQAGGSLTLSCA ASEYAYSTCNMGWYRQAP GKERELVSAFISDGSTYY ADSVKGRFTITRDNAKNT VYLQMNSLKPEDTAIYYC SANCYRRLRNYWGQGTQV TVSS | 942 | F T F S H S G M S | 946 | TI NS GG AS TY YT DS VK G | 231 | GG SG YG DA SR MT SP | 197 | YAY STC NMG | 203 | AFI SDG STY YAD SVK G | 209 | NC YR RL RN Y |
| hIL27Ra-VHH20-DR595 | 767 | QVQLQESGGGLVQPGGSL RLSCAASGFTFSSYPMSW VRQAPGKGLEWVSTISSG GDTTLYADSVKGRFTSSR | 942 | F T F S | 946 | TI NS GG AS | 231 | GG SG YG DA | 197 | YAY STC NMG | 203 | AFI SDG STY YAD | 209 | NC YR RL RN |

TABLE 1A-continued

| Name | SEQ ID NO: | Sequence of dual VHH dimer | SEQ ID NO: | CDR1 | SEQ ID NO: | CDR2 | SEQ ID NO: | CDR3 | SEQ ID NO: | CDR4 | SEQ ID NO: | CDR5 | SEQ ID NO: | CDR6 |
|---|---|---|---|---|---|---|---|---|---|---|---|---|---|---|
| | | DNAKNTLYLQLNSLKTED TAMYYCAKRIDCNSGYCY KRSYWGQGTQVTVSSGGS GGSGGSGQVQLQESGGGS VQAGGSLTLSCAASEYAY STCNMGWYRQAPGKEREL VSAFISDGSTYYADSVKG RFTITRDNAKNTVYLQMN SLKPEDTAIYYCSANCYR RLRNYWGQGTQVTVSS | | H S G M S | | TY YT DS VK G | | SR MT SP | | | | SVK G | | Y |
| hIL27Ra-VHH21-DR595 | 768 | QVQLQESGGGLVQPGGSL RLSCAASGFTFSLSSMSW VRQAPGKGLEWVSAISSG GASTYYTDSVKGRFTISR DNAKNMLYLQLNSLKTED TAMYYCAKGGSGYGDASR MTSPGSQGTQVTVSSGGS GGSGGSGQVQLQESGGGS VQAGGSLTLSCAASEYAY STCNMGWYRQAPGKEREL VSAFISDGSTYYADSVKG RFTITRDNAKNTVYLQMN SLKPEDTAIYYCSANCYR RLRNYWGQGTQVTVSS | 942 | F T F S H S G M S | 946 | TI NS GG AS TY YT DS VK G | 231 | GG SG YG DA SR MT SP | 197 | YAY STC NMG | 203 | AFI SDG STY YAD SVK G | 209 | NC YR RL RN Y |
| hIL27Ra-VHH22-DR595 | 769 | QVQLQESGGGSVQAGGSL RLSCRASGSTYSNYCLGW FRQTTGKEREGVAVINWV GGMLYFADSVKGRFTVSQ DQAKNTVYLQMNSLKPED TAMYYCAAESVSSFSCGG WLTRPDRVPYWGQGTQVT VSSGGSGGSGGSGQVQLQ ESGGGSVQAGGSLTLSCA ASEYAYSTCNMGWYRQAP GKERELVSAFISDGSTYY ADSVKGRFTITRDNAKNT VYLQMNSLKPEDTAIYYC SANCYRRLRNYWGQGTQV TVSS | 942 | F T F S H S G M S | 946 | TI NS GG AS TY YT DS VK G | 231 | GG SG YG DA SR MT SP | 197 | YAY STC NMG | 203 | AFI SDG STY YAD SVK G | 209 | NC YR RL RN Y |
| hIL27Ra-VHH23-DR595 | 770 | QVQLQESGGGSVQAGGSL RLSCRASRSPYGNYCLGW FRQSTGKEREGVAVINWV GGMLYFADSVKGRFTVSQ DHAKNTVTLQMNSLKPED TAMYYCAAESVSSFSCGG WLTRPDRVPYWGQGTQVT VSSGGSGGSGGSGQVQLQ ESGGGSVQAGGSLTLSCA ASEYAYSTCNMGWYRQAP GKERELVSAFISDGSTYY ADSVKGRFTITRDNAKNT VYLQMNSLKPEDTAIYYC SANCYRRLRNYWGQGTQV TVSS | 942 | F T F S H S G M S | 946 | TI NS GG AS TY YT DS VK G | 231 | GG SG YG DA SR MT SP | 197 | YAY STC NMG | 203 | AFI SDG STY YAD SVK G | 209 | NC YR RL RN Y |
| hIL27Ra-VHH24-DR595 | 771 | QVQLQESGGGLVQPGGSL RLSCAASGFTFSHSGMSW VRQAPGKGLEWVSTINSG GASTYYTDSVKGRFTISR DNAKNMLYLQLNSLKTED TAMYYCAKGGSGYGDASR MTSPGSQGTQVTVSSGGS GGSGGSGQVQLQESGGGS VQAGGSLTLSCAASEYAY STCNMGWYRQAPGKEREL VSAFISDGSTYYADSVKG RFTITRDNAKNTVYLQMN SLKPEDTAIYYCSANCYR RLRNYWGQGTQVTVSS | 942 | F T F S H S G M S | 946 | TI NS GG AS TY YT DS VK G | 231 | GG SG YG DA SR MT SP | 197 | YAY STC NMG | 203 | AFI SDG STY YAD SVK G | 209 | NC YR RL RN Y |
| hIL27Ra-VHH1-DR596 | 772 | QVQLQESGGGLVQPGGSL RLSCAASGFTFSSYPMSW VRQAPGKGLEWISTISAG | 942 | F T F | 946 | T: NS GG | 231 | GG SG YG | 198 | LTF DDS VMG | 204 | CIS SSG ANA | 210 | GH AC AG |

TABLE 1A-continued

| Name | SEQ ID NO: | Sequence of dual VHH dimer | SEQ ID NO: | CDR1 | SEQ ID NO: | CDR2 | SEQ ID NO: | CDR3 | SEQ ID NO: | CDR4 | SEQ ID NO: | CDR5 | SEQ ID NO: | CDR6 |
|---|---|---|---|---|---|---|---|---|---|---|---|---|---|---|
| | | GDTTLYADSVKGRFTSSR DNAKNTLYLQLNSLKTED AAIYYCAKRIDCNSGYCY RRNYWGQGTQVTSSGGS GGSGGSGQVQLQESGGGL VQPGGSLRLSCTASGLTF DDSVMGWFRQAPGKGREA VSCISSSGANAFYADSVK GRFTISRDNAKNTLYLQM NSLKPEDTATYYCKRGHA CAGYYPIPYDDYWGQGTQ VTVSS | | S H S G M S | | AS TY YI DS VK G | | DA SR MT SP | | | | FYA DSV KG | | YY PI PY DD Y |
| hIL27Ra-VHH2-DR596 | 773 | QVQLQESGGGLVQPGGSL RLSCAASGFTFSLSGMSW VRQAPGKGLEWVSAISSG GASTYYTDSVKGRFTISR DNAKNILYLQLNSLKTED TAMYYCAKGGSGYGDASR MTSPGSQGTQVTVSSGGS GGSGGSGQVQLQESGGGL VQPGGSLRLSCTASGLTF DDSVMGWFRQAPGKGREA VSCISSSGANAFYADSVK GRFTISRDNAKNTLYLQM NSLKPEDTATYYCKRGHA CAGYYPIPYDDYWGQGTQ VTVSS | 942 | F T F S H S G M S | 946 | TI NS GG AS TY YT DS VK G | 231 | GG SG YG DA SR MT SP | 198 | LTF DDS VMG | 204 | CIS SSG ANA FYA DSV KG | 210 | GH AC AG YY PI PY DD Y |
| hIL27Ra-VHH3-DR596 | 774 | QVQLQESGGGSVQAGGSL RLSCVASGYVSCDYFLPS WYRQAPGKEREFVSIIDG TGSTSYAASVKGRFTASE DKGKNIAYLQMNSLKPED TAMYYCKASCVRGRAVSE YWGQGTQVTVSSGGSGGS GGSGQVQLQESGGGLVQP GGSLRLSCTASGLTFDDS VMGWFRQAPGKGREAVSC ISSSGANAFYADSVKGRF TISRDNAKNTLYLQMNSL KPEDTATYYCKRGHACAG YYPIPYDDYWGQGTQVTV SS | 942 | F T F S H S G M S | 946 | TI NS GG AS TY YT DS VK G | 231 | GG SG YG DA SR MT SP | 198 | LTF DDS VMG | 204 | CIS SSG ANA FYA DSV KG | 210 | GH AC AG YY PI PY DD Y |
| hIL27Ra-VHH4-DR596 | 775 | QVQLQESGGGLVQPGESL RLSCTASGFTFSNYAMSW VRQAPGKGLEWVSGINVA YGITSYADSVKGRFTISR DNTKNTLYLQLNSLKTED TAIYYCVKHSGTTIPRGF ISYTKRGQGTQVTVSSGG SGGSGGSGQVQLQESGGG LVQPGGSLRLSCTASGLT FDDSVMGWFRQAPGKGRE AVSCISSSGANAFYADSV KGRFTISRDNAKNTLYLQ MNSLKPEDTATYYCKRGH ACAGYYPIPYDDYWGQGT QVTVSS | 942 | F T F S H S G M S | 946 | HZ NS GG AS TY YT DS VK G | 231 | GG SG YG DA SR MT SP | 198 | LTF DDS VMG | 204 | CIS SSG ANA FYA DSV KG | 210 | GH AC AG YY PI PY DD Y |
| hIL27Ra VHH5-DR596 | 776 | QVQLQESGGGSVQAGGSL RLSCTASGYVSCDYFLPS WYRQAPGKEREFVSVIDG TGSTSYAASVKGRFTASQ DKGKNIAYLQMNSLKPED TAMYYCKASCVRGRAISE YWGQGTQVTVSSGGSGGS GGSGQVQLQESGGGLVQP GGSLRLSCTASGLTFDDS VMGWFRQAPGKGREAVSC ISSSGANAFYADSVKGRF TISRDNAKNTLYLQMNSL KPEDTATYYCKRGHACAG YYPIPYDDYWGQGTQVTV SS | 942 | F T F S H S G M S | 946 | TI NS GG AS TY YT DS VK G | 231 | GG SG YG DA SR MT SP | 198 | LTF DDS VMG | 240 | CIS SSG ANA FYA DSV KG | 210 | GH AC AG YY PI PY DD Y |

TABLE 1A-continued

| Name | SEQ ID NO: | Sequence of dual VHH dimer | SEQ ID NO: | CDR1 | SEQ ID NO: | CDR2 | SEQ ID NO: | CDR3 | SEQ ID NO: | CDR4 | SEQ ID NO: | CDR5 | SEQ ID NO: | CDR6 |
|---|---|---|---|---|---|---|---|---|---|---|---|---|---|---|
| hIL27Ra-VHH6-DR596 | 777 | QVQLQESGGGLVQPGGSL RLSCAASGFSFSSYAMKW VRQAPGKGLEWVSTISSG GSSTNYADSVKGRFTISR DNAKNTLYLQLNSLKIED TAMYYCAKAIVPTGATME RGQGTQVTVSSGGSGGSG GSGGQVQLQESGGGLVQPG GSLRLSCTASGLTFDDSV MGWFRQAPGKGREAVSCI SSSGANAFYADSVKGRFT ISRDNAKNTLYLQMNSLK PEDTATYYCKRGHACAGY YPIPYDDYWGQGTQVTVS S | 942 | F T F S H S G M S | 946 | TI NS GG AS TY YT DS VK G | 231 | GG SG YG DA SR MT SP | 198 | LTF DDS VMG | 204 | CIS SSG ANA FYA DSV KG | 210 | GH AC AG YY PI PY DD Y |
| hIL27Ra-VHH7-DR596 | 778 | QVQLQESGGGLVQPGGSL RLSCAASGFTFSSYPMSW VRQAPGKGLEWISTISAG GDTTLYADSVKGRFTSSR DNAKNTLYLQLNSLKTED TAIYYCAKRIDCNSGYCY RRNYWGQGTQVTVSSGGS GGSGGSGQVQLQESGGGL VQPGGSLRLSCTASGLTF DDSVMGWFRQAPGKGREA VSCISSSGANAFYADSVK GRFTISRDNAKNTLYLQM NSLKPEDTATYYCKRGHA CAGYYPIPYDDYWGQGTQ VTVSS | 942 | F T F S H S G M S | 946 | TI NS GG AS TY YT DS VK G | 231 | GG SG YG DA SR MT SP | 198 | LTF DDS VMG | 204 | CIS SSG ANA FYA DSV KG | 210 | GH AC AG YY PI PY DD Y |
| hIL27Ra-VHH8-DR596 | 779 | QVQLQESGGGSVQVGGSL RLSCAASGFTFSSYPMSW VRQAPGKGLEWISTISAG GDTTLYADSVKGRFTSSR DNAKNTLYLQLNSLKTED TAIYYCAKRIDCNSGYCY RRNYWGQGTQVTVSSGGS GGSGGSGQVQLQESGGGL VQPGGSLRLSCTASGLTF DDSVMGWFRQAPGKGREA VSCISSSGANAFYADSVK GRFTISRDNAKNTLYLQM NSLKPEDTATYYCKRGHA CAGYYPIPYDDYWGQGTQ VTVSS | 942 | F T F S H S G M S | 946 | TI NS GG AS TY YT DS VK G | 231 | GG SG YG DA SR MT SP | 198 | LTF DDS VMG | 204 | CIS SSG ANA FYA DSV KG | 210 | GH AC AG YY PI PY DD Y |
| hIL27Ra-VHH9-DR596 | 780 | QVQLQESGGGSVQSGGSL RLSCAASGFTYSTSNSWM AWFRQAPGKEREGVAAIY TVGGSIFYADSVRGRFTI SQDATKNMFYLQMNTLKP EDTAMYYCAAASGRLRGK WFWPYEYNYWGQGTQVTV SSGGSGGSGGSGQVQLQE SGGGLVQPGGSLRLSCTA SGLTFDDSVMGWFRQAPG KGREAVSCISSSGANAFY ADSVKGRFTISRDNAKNT LYLQMNSLKPEDTATYYC KRGHACAGYYPIPYDDYW GQGTQVTVSS | 942 | F T F S H S G M S | 946 | TI NS GG AS TY YT DS VK G | 231 | GG SG YG DA SR MT SP | 198 | LTF DDS VMG | 204 | CIS SSG ANA FYA DSV KG | 210 | GH AC AG YY PI PY DD Y |
| hIL27Ra-VHH10-DR596 | 781 | QVQLQESGGGSVQAGGSL RLSCRASGSTYSNYCLGW FRQITGKEREGVAVINWV GGMLYFADSVKGRFTVSQ DQAKNTLYLQMNSLKPED TAMYYCAAESVSSFSCGG WLTRPDRVPYWGQGTQVT VSSGGSGGSGGSGQVQLQ ESGGGLVQPGGSLRLSCT ASGLTFDDSVMGWFRQAP GKGREAVSCISSSGANAF YADSVKGRFTISRDNAKN | 942 | F T F S H S G M S | 946 | TI NS GG AS TY YT DS VK G | 231 | GG SG YG DA SR MT SP | 198 | LTF DDS VMG | 204 | CIS SSG ANA FYA DSV KG | 210 | GH AC AG YY PI PY DD Y |

TABLE 1A-continued

| Name | SEQ ID NO: | Sequence of dual VHH dimer | SEQ ID NO: | CDR1 | SEQ ID NO: | CDR2 | SEQ ID NO: | CDR3 | SEQ ID NO: | CDR4 | SEQ ID NO: | CDR5 | SEQ ID NO: | CDR6 |
|---|---|---|---|---|---|---|---|---|---|---|---|---|---|---|
| | | TLYLQMNSLKPEDTATYY CKRGHACAGYYPIPYDDY WGQGTQVTVSS | | | | | | | | | | | | |
| hIL27Ra-VHH11-DR596 | 782 | QVQLQESGGGSVQAGGSL RLSCRASGSTYSNYCLGW FRQSTGKEREGVAVINWV GGMLYFADSVKGRFTVSQ DHAKNTVTLQMNSLKPED TAMYYCAAESVSSFSCGG WLTRPGRVPYWGQGTQVT VSSGGSGGSGGSGGQVQLQ ESGGGLVQPGGSLRLSCT ASGLTFDDSVMGWFRQAP GKGREAVSCISSSGANAF YADSVKGRFTISRDNAKN TLYLQMNSLKPEDTATYY CKRGHACAGYYPIPYDDY WGQGTQVTVSS | 942 | F T F S H S G M S | 946 | TI NS GG AS TY YT DS VK G | 231 | GG SG YG DA SR MT SP | 198 | LTF DDS VMG | 204 | CIS SSG ANA FYA DSV KG | 210 | GH AC AG YY PI PY DD Y |
| hIL27Ra-VHH12-DR596 | 783 | QVQLQESGGGSVQAGESL RLSCRASGSTYSNYCLGW FRQITGKEREGVAVINWV GGMLYFADSVKGRFTVSQ DQAKNTVLEMNSLKPED TAMYYCATESVSSFSCGG WLTRPDRVPYWGQGTQVT VSSGGSGGSGGSGGQVQLQ ESGGGLVQPGGSLRLSCT ASGLTFDDSVMGWFRQAP GKGREAVSCISSSGANAF YADSVKGRFTISRDNAKN TLYLQMNSLKPEDTATYY CKRGHACAGYYPIPYDDY WGQGTQVTVSS | 942 | F T F S H S G M S | 946 | TI NS GG AS TY YT DS VK G | 231 | GG SG YG DA SR MT SP | 198 | LTF DDS VMG | 204 | CIS SSG ANA FYA DSV KG | 210 | GH AC AG YY PI PY DD Y |
| hIL27Ra-VHH13-DR596 | 784 | QVQLQESGGGSVQAGGSL RLSCVASGYVSCDYFLPS WYRQAPGKEREFVSIIDG TGSTSYAASVKGRFTASQ DRGKNIAYLQMNSLKPED TAMYYCKASCVRGRTISE YWGQGTQVTVSSGGSGGS GGSGQVQLQESGGGLVQP GGSLRLSCTASGLTFDDS VMGWFRQAPGKGREAVSC ISSSGANAFYADSVKGRF TISRDNAKNTLYLQMNSL KPEDTATYYCKRGHACAG YYPIPYDDYWGQGTQVTV SS | 942 | F T F S H S G M S | 946 | TI NS GG AS TY YT DS VK G | 231 | GG SG YG DA SR MT SP | 198 | LTF DDS VMG | 204 | CIS SSG ANA FYA DSV KG | 210 | GH AC AG YY PI PY DD Y |
| hIL27Ra-VHH14-DR596 | 785 | QVQLQESGGGSVQAGGSL RLSCVASGYVSCDYFLPS WYRQAPGKEREFVSIIDG TGSTSYAASVKGRFTASQ DKGKNIAYLQMNSLKPED TAMYYCKASCVRGRAISE YWGQGTQVTVSSGGSGGS GGSGQVQLQESGGGLVQP GGSLRLSCTASGLTFDDS VMGWFRQAPGKGREAVSC ISSSGANAFYADSVKGRF TISRDNAKNTLYLQMNSL KPEDTATYYCKRGHACAG YYPIPYDDYWGQGTQVTV SS | 942 | F T F S H S G M S | 946 | TI NS GG AS TY YT DS VK G | 231 | GG SG YG DA SR MT SP | 198 | LTF DDS VMG | 204 | CIS SSG ANA FYA DSV KG | 210 | GH AC AG YY PI PY DD Y |
| hIL27Ra-VHH15-DR596 | 786 | QVQLQESGGGSVQAGGSL RLSCVASGYVSCDYFLPS WYRQAPGKEREFVSIIDG TGSTSYAASVKGRFTASQ DKGKNIAYLQMNTLKPED TAMYYCKASCVRGRAISE YWGQGTQVTVSSGGSGGS GGSGQVQLQESGGGLVQP | 942 | F T F S H S G M | 946 | TI NS GG AS TY YT DS VK | 231 | GG SG YG DA SR MT SP | 198 | LTF DDS VMG | 204 | CIS SSG ANA FYA DSV KG | 210 | GH AC AG YY PI PY DD Y |

TABLE 1A-continued

| Name | SEQ ID NO: | Sequence of dual VHH dimer | SEQ ID NO: | CDR1 | SEQ ID NO: | CDR2 | SEQ ID NO: | CDR3 | SEQ ID NO: | CDR4 | SEQ ID NO: | CDR5 | SEQ ID NO: | CDR6 |
|---|---|---|---|---|---|---|---|---|---|---|---|---|---|---|
| | | GGSLRLSCTASGLTFDDS VMGWFRQAPGKREAVSC ISSSGANAFYADSVKGRF TISRDNAKNTLYLQMNSL KPEDTATYYCKRGHACAG YYPIPYDDYWGQGTQVTV SS | | S | | | | | | | | | | |
| hIL27Ra-VHH16-DR596 | 787 | QVQLQESGGGSVQAGGSL RLSCRASGSTYSNYCLGW FRQITGKEREGVAVINWV GGMLYFADSVKGRFTVSQ DQAKNTVYLQMNSLKPED TAMYYCAAESASSFSCGG WLTRPDRVPYWGQGTQVT VSSGGSGGSGGSGQVQLQ ESGGGLVQPGGSLRLSCT ASGLTFDDSVMGWFRQAP GKGREAVSCISSSGANAF YADSVKGRFTISRDNAKN TLYLQMNSLKPEDTATYY CKRGHACAGYYPIPYDDY WGQGTQVTVSS | 942 | F T F S H S G M S | 946 | TI NS GG AS TY YT DS VK G | 231 | GG SG YG DA SR MT SP | 198 | LTF DDS VMG | 204 | CIS SSG ANA FYA DSV KG | 210 | GH AC AG YY PI PY DD Y |
| hIL27Ra-VHH17-DR596 | 788 | QVQLQESGGGLVQPGGSL RLSCAASGFTFSLSGMSW VRQAPGKGLEWVSAISSG GASTYYTDSVKGRFTISR DNAKNMLYLQLNSLKTED TAMYYCAKGGSGYGDASR MTSPGSQGTQVTVSSGGS GGSGGSGQVQLESGGGL VQPGGSLRLSCTASGLTF DDSVMGWFRQAPGKGREA VSCISSSGANAFYADSVK GRFTISRDNAKNTLYLQM NSLKPEDTATYYCKRGHA CAGYYPIPYDDYWGQGTQ VTVSS | 942 | F T F S H S G M S | 946 | TI NS GG AS TY YT DS VK G | 231 | GG SG YG DA SR MT SP | 198 | LTF DDS VMG | 204 | CIS SSG ANA FYA DSV KG | 210 | GH AC AG YY PI PY DD Y |
| hIL27Ra-VHH18-DR596 | 789 | QVQLQESGGGSVQAGGSL RLSCVASGYVSCDYFLPS WYRQAPGKEREFVSIIDG TGSTSYAASVKGRFTASQ DKGKNIAYLQMNSLKPED TAMYYCKASCVRGRGISE YWGQGTQVTVSSGGSGGS GGSGQVQLQESGGGLVQP GGSLRLSCTASGLTFDDS VMGWFRQAPGKGREAVSC ISSSGANAFYADSVKGRF TISRDNAKNTLYLQMNSL KPEDTATYYCKRGHACAG YYPIPYDDYWGQGTQVTV SS | 942 | F T F S H S G M S | 946 | TI NS GG AS TY YT DS VK G | 231 | GG SG YG DA SR MT SP | 198 | LTF DDS VMG | 204 | CIS SSG ANA FYA DSV KG | 210 | GH AC AG YY PI PY DD Y |
| hIL27Ra-VHH19-DR596 | 790 | QVQLQESGGGSVQAGGSL RLSCRASGSTYSNYCLGW FRQITGKEREGVAVINWV GGMLYFADSVKGRFTVSQ DQAKNTVYLQMNSLKPED TAMYYCAAESVSSFSCGG WLTRPDRVPYWGQGTQVT VSSGGSGGSGGSGQVQLQ ESGGGLVQPGGSLRLSCT ASGLTFDDSVMGWFRQAP GKGREAVSCISSSGANAF YADSVKGRFTISRDNAKN TLYLQMNSLKPEDTATYY CKRGHACAGYYPIPYDDY WGQGTQVTVSS | 942 | F T F S H S G M S | 946 | TI NS GG AS TY YT DS VK G | 231 | GG SG YG DA SR MT SP | 198 | LTF DDS VMG | 204 | CIS SSG ANA FYA DSV KG | 210 | GH AC AG YY PI PY DD Y |
| hIL27Ra-VHH20-DR596 | 791 | QVQLQESGGGLVQPGGSL RLSCAASGFTFSSYPMSW VRQAPGKGLEWVSTISSG GDTTLYADSVKGRFTSSR | 942 | F T F S | 946 | TI NS GG AS | 231 | GG SG YG DA | 198 | LTF DDS VMG | 204 | CIS SSG ANA FYA | 210 | GH AC AG YY |

TABLE 1A-continued

| Name | SEQ ID NO: | Sequence of dual VHH dimer | SEQ ID NO: | CDR1 | SEQ ID NO: | CDR2 | SEQ ID NO: | CDR3 | SEQ ID NO: | CDR4 | SEQ ID NO: | CDR5 | SEQ ID NO: | CDR6 |
|---|---|---|---|---|---|---|---|---|---|---|---|---|---|---|
| | | DNAKNTLYLQLNSLKTED TAMYYCAKRIDCNSGYCY KRSYWGQGTQVTVSSGGS GGSGGSGQVQLQESGGGL VQPGGSLRLSCTASGLTF DDSVMGWFRQAPGKGREA VSCISSSGANAFYADSVK GRFTISRDNAKNTLYLQM NSLKPEDTATYYCKRGHA CAGYYPIPYDDYWGQGTQ VTVSS | | H S G M S | | TY YT DS VK G | | SR MT SP | | | | DSV KG | | PI PY DD Y |
| hIL27Ra-VHH21-DR596 | 792 | QVQLQESGGGLVQPGGSL RLSCAASGFTFSLSSMSW VRQAPGKGLEWVSAISSG GASTYYTDSVKGRFTISR DNAKNMLYLQLNSLKTED TAMYYCAKGGSGYGDASR MTSPGSQGTQVTVSSGGS GGSGGSGQVQLQESGGGL VQPGGSLRLSCTASGLTF DDSVMGWFRQAPGKGREA VSCISSSGANAFYADSVK GRFTISRDNAKNTLYLQM NSLKPEDTATYYCKRGHA CAGYYPIPYDDYWGQGTQ VTVSS | 942 | F T F S H S G M S | 946 | TI NS GG AS TY YT DS VK G | 231 | GG SG YG DA SR MT SP | 198 | LTF DDS VMG | 204 | CIS SSG ANA FYA DSV KG | 210 | GH AC AG YY PI PY DE DD Y |
| hIL27Ra-VHH22-DR596 | 793 | QVQLQESGGGSVQAGGSL RLSCRASGSTYSNYCLGW FRQTTGKEREGVAVINWV GGMLYFADSVKGRFTVSQ DQAKNTVYLQMNSLKPED TAMYYCAAESVSSFSCGG WLTRPDRVPYWGQGTQVT VSSGGSGGSGGSGQVQLQ ESGGGLVQPGGSLRLSCT ASGLTFDDSVMGWFRQAP GKGREAVSCISSSGANAF YADSVKGRFTISRDNAKN TLYLQMNSLKPEDTATYY CKRGHACAGYYPIPYDDY WGQGTQVTVSS | 942 | F T F S H S G M S | 946 | TI NS GG AS TY YT DS VK G | 231 | GG SG YG DA SR MT SP | 198 | LTF DDS VMG | 204 | CIS SSG ANA FYA DSV KG | 210 | GH AC AG YY PI PY DD Y |
| hIL27Ra-VHH23-DR596 | 794 | QVQLQESGGGSVQAGGSL RLSCRASRSPYGNYCLGW FRQSTGKEREGVAVINWV GGMLYFADSVKGRFTVSQ DHAKNTVTLQMNSLKPED TAMYYCAAESVSSFSCGG WLTRPDRVPYWGQGTQVT VSSGGSGGSGGSGQVQLQ ESGGGLVQPGGSLRLSCT ASGLTFDDSVMGWFRQAP GKGREAVSCISSSGANAF YADSVKGRFTISRDNAKN TLYLQMNSLKPEDTATYY CKRGHACAGYYPIPYDDY WGQGTQVTVSS | 942 | F T F S H S G M S | 946 | TI NS GG AS TY YT DS VK G | 231 | GG SG YG DA SR MT SP | 198 | LTF DDS VMG | 204 | CIS SSG ANA FYA DSV KG | 210 | GH AC AG YY PI PY DD Y |
| hIL27Ra-VHH24-DR596 | 795 | QVQLQESGGGLVQPGGSL RLSCAASGFTFSHSGMSW VRQAPGKGLEWVSTINSG GASTYYTDSVKGRFTISR DNAKNMLYLQLNSLKTED TAMYYCAKGGSGYGDASR MTSPGSQGTQVTVSSGGS GGSGGSGQVQLQESGGGL VQPGGSLRLSCTASGLTF DDSVMGWFRQAPGKGREA VSCISSSGANAFYADSVK GRFTISRDNAKNTLYLQM NSLKPEDTATYYCKRGHA CAGYYPIPYDDYWGQGTQ VTVSS | 942 | F T F S H S G M S | 946 | TI NS GG AS TY YT DS VK G | 231 | GG SG YG DA SR MT SP | 198 | LTF DDS VMG | 204 | CIS SSG ANA FYA DSV KG | 210 | GH AC AG YY PI PY DD Y |

TABLE 1A-continued

| Name | SEQ ID NO: | Sequence of dual VHH dimer | SEQ ID NO: | CDR1 | SEQ ID NO: | CDR2 | SEQ ID NO: | CDR3 | SEQ ID NO: | CDR4 | SEQ ID NO: | CDR5 | SEQ ID NO: | CDR6 |
|---|---|---|---|---|---|---|---|---|---|---|---|---|---|---|
| DR591-hIL27Ra-VHH1 | 796 | QVQLQESGGGSVQAGGSLRLSCTASGAIASGYIDSRWCMAWFRQAPGKEREGVAAIWPGGGLTVYADSVKGRFTISRDHAKNTLYLQMNNLKPEDTAMYYCAAGSPRMCPSLEFGFDYWGQGTQVTVSSGGSGGSGGSGSGQVQLQESGGGLVQPGGSLRLSCAASGFTFSSYPMSWVRQAPGKGLEWISTISAGGDTTLYADSVKGRFTSSRDNAKNTLYLQLNSLKTEDAAIYYCAKRIDCNSGYCYRRNYWGQGTQVTVSS | 943 | AIASGYIDSRWCMA | 199 | AIWEGGGLTVYADSVKG | 205 | GSPRMCPSLEFGFDY | 211 | FTFSSYPMS | 218 | TISAGGDTTLYADSVKG | 947 | RIDCNSGYCYRRNY |
| DR591-hIL27Ra-VHH2 | 797 | QVQLQESGGGSVQAGGSLRLSCTASGAIASGYIDSRWCMAWFRQAPGKEREGVAAIWPGGGLTVYADSVKGRFTISRDHAKNTLYLQMNNLKPEDTAMYYCAAGSPRMCPSLEFGFDYWGQGTQVTVSSGGSGGSGGSGSGQVQLQESGGGLVQPGGSLRLSCAASGFTFSLSGMSWVRQAPGKGLEWVSAISSGGASTYYTDSVKGRFTISRDNAKNILYLQLNSLKTEDTAMYYCAKGGSGYGDASRMTSPGSQGTQVTVSS | 943 | AIASGYIDSRWCMA | 199 | AIWPGGGLTVYADSVKG | 205 | GSPRMCPSLEFGFDY | 940 | FTFSLSGMS | 224 | AISSGGASTYYTDSVKG | 231 | GGSGYGDASRMTSP |
| DR591-hIL27Ra-VHH3 | 798 | QVQLQESGGGSVQAGGSLRLSCTASGAIASGYIDSRWCMAWFRQAPGKEREGVAAIWPGGGLTVYADSVKGRFTISRDHAKNTLYLQMNNLKPEDTAMYYCAAGSPRMCPSLEFGFDYWGQGTQVTVSSGGSGGSGGSGSGQVQLQESGGGSVQAGGSLRLSCVASGYVSCDYFLPSWYRQAPGKEREFVSIIDGTGSTSYAASVKGRFTASEDKGKNIAYLQMNSLKPEDTAMYYCKASCVRGRAVSEYWGQGTQVTVSS | 943 | AIASGYIDSRWCMA | 199 | AIWPGGGLTVYADSVKG | 205 | GSPRMCPSLEFGFDY | 215 | YVSCDYFLPS | 222 | IIDGTGSTSYAASVKG | 948 | SCVRGRAVSEY |
| DR591-hIL27Ra-VHH4 | 799 | QVQLQESGGGSVQAGGSLRLSCTASGAIASGYIDSRWCMAWFRQAPGKEREGVAAIWPGGGLTVYADSVKGRFTISRDHAKNTLYLQMNNLKPEDTAMYYCAAGSPRMCPSLEFGFDYWGQGTQVTVSSGGSGGSGGSGSGQVQLQESGGGLVQPGESLRLSCTASGFTFSNYAMSWVRQAPGKGLEWVSGINVAYGITSYADSVKGRFTISRDNTKNTLYLQLNSLKTEDTAIYYCVKHSGTTIPRGFISYTKRGQGTQVTVSS | 943 | AIASGYIDSRWCMA | 199 | AIWPGGGLTVYADSVKG | 205 | GSPRMCPSLEFGFDY | 212 | FTFSNYAMS | 219 | GINVAYGITSYADSVKG | 226 | HSGTTIPRGFISYTK |
| DR591-hIL27Ra-VHH5 | 800 | QVQLQESGGGSVQAGGSLRLSCTASGAIASGYIDSRWCMAWFRQAPGKEREGVAAIWPGGGLTVYADSVKGRFTISRDHAKNTLYLQMNNLKPEDTAMYYCAAGSPRMCPSLEFGFDYWGQGTQVTVSSGGSGGSGGSGSGQVQLQESGGGSVQAGGSLRLSCTASGYVSCDYFLPSWYRQAPGKEREFVSIDGTGSTSYAASVKGRFTASQDKGKNC | 943 | AIASGYIDSRWCMA | 199 | AIWPGGGLTVYADSVKG | 205 | GSPRMCPSLEFGFDY | 215 | YVSCDYFLPS | 944 | VIDGTGSTSYAASVKG | 229 | SCVRGRAISEY |

TABLE 1A-continued

| Name | SEQ ID NO: | Sequence of dual VHH dimer | SEQ ID NO: | CDR1 | SEQ ID NO: | CDR2 | SEQ ID NO: | CDR3 | SEQ ID NO: | CDR4 | SEQ ID NO: | CDR5 | SEQ ID NO: | CDR6 |
|---|---|---|---|---|---|---|---|---|---|---|---|---|---|---|
| | | IAYLQMNSLKPEDTAMYY CKASCVRGRAISEYWGQG TQVTVSS | | M A | | | | | | | | | | |
| DR591-hIL27Ra-VHH6 | 801 | QVQLQESGGGSVQAGGSL RLSCTASGAIASGYIDSR WCMAWFRQAPGKEREGVA AIWPGGGLTVYADSVKGR FTISRDHAKNTLYLQMNN LKPEDTAMYYCAAGSPRM CPSLEFGFDYWGQGTQVT VSSGGSGGSGGSGQVQLQ ESGGGLVQPGGSLRLSCA ASGFSFSSYAMKWVRQAP GKGLEWVSTISSGGSSTN YADSVKGRFTISRDNAKN TLYLQLNSLKIEDTAMYY CAKAIVPTGATMERGQGT QVTVSS | 943 | A I A S G Y I D S R W C M A | 199 | AI WP GG GL TV YA DS VK G | 205 | GS PR MC PS LE FG FD Y | 213 | FSF SSY AMK | 220 | TIS SGG SST NYA DSV KG | 227 | AI VP TG AT ME |
| DR591-hIL27Ra-VHH7 | 802 | QVQLQESGGGSVQAGGSL RLSCTASGAIASGYIDSR WCMAWFRQAPGKEREGVA AIWPGGGLTVYADSVKGR FTISRDHAKNTLYLQMNN LKPEDTAMYYCAAGSPRM CPSLEFGFDYWGQGTQVT VSSGGSGGSGGSGQVQLQ ESGGGLVQPGGSLRLSCA ASGFTFSSYPMSWVRQAP GKGLEWISTISAGGDTTL YADSVKGRFTSSRDNAKN TLYLQLNSLKTEDTAIYY CAKRIDCNSGYCYRRNYW GQGTQVTVSS | 943 | A I A S G Y I D S R W C M A | 199 | AI WP GG GI TV YA DS VK G | 205 | GS PR MC PS LE FG FD Y | 211 | FTE SSY PMS | 218 | TIS AGG DTT LYA DSV KG | 947 | RI DC NS GY CY RR NY |
| DR591-hIL27Ra-VHH8 | 803 | QVQLQESGGGSVQAGGSL RLSCTASGAIASGYIDSR WCMAWFRQAPGKEREGVA AIWPGGGLTVYADSVKGR FTISRDHAKNTLYLQMNN LKPEDTAMYYCAAGSPRM CPSLEFGFDYWGQGTQVT VSSGGSGGSGGSGQVQLQ ESGGGSVQVGGSLRLSCA ASGFTFSSYPMSWVRÇAP GKGLEWISTISAGGDTTL YADSVKGRFTSSRDNAKN TLYLQLNSLKTEDTAIYY CAKRIDCNSGYCYRRNYW GQGTQVTVSS | 943 | A I A S G Y I D S R W C M A | 199 | AI WP GG GL TV YA G D S R W C M A | 205 | GS PR MC PS LE FG FD Y | 211 | FTF SSY PMS | 218 | TIS AGG DTT LYA DSV KG | 947 | RI DC NS GY CY RR NY |
| DR591-hIL27Ra-VHH9 | 804 | QVQLQESGGGSVQAGGSL RLSCTASGAIASGYIDSR WCMAWFRQAPGKEREGVA AIWPGGGLTVYADSVKGR FTISRDHAKNTLYLQMNN LKPEDTAMYYCAAGSPRM CPSLEFGFDYWGQGTQVT VSSGGSGGSGGSGQVQLQ ESGGGSVQSGGSLRLSCA ASGFTYSTSNSWMAWFRQ APGKEREGVAAIYTVGGS IFYADSVRGRFTISQDAT KNMFYLQMNTLKPEDTAM YYCAAASGRLRGKWFWPY EYNYWGQGTQVTVSS | 943 | A I A S G Y I D S R W C M A | 199 | AI WP GG GL TV YA DS VK G | 205 | GS PR MC PS LE FG FD Y | 214 | FTY STS NSW MA | 221 | AIY TVG GSI FYA DSV RG | 228 | AS GR LR GK WF WP YE YN Y |
| DR591-hIL27Ra-VHH10 | 805 | QVQLQESGGGSVQAGGSL RLSCTASGAIASGYIDSR WCMAWFRQAPGKEREGVA AIWPGGGLTVYADSVKGR FTISRDHAKNTLYLQMNN LKPEDTAMYYCAAGSPRM CPSLEFGFDYWGQGTQVT VSSGGSGGSGGSGQVQLQ | 943 | | 199 | AI WP GG GL TV YA DS VK | 205 | GS PR MC PS LE FG FD Y | 216 | STY SNY CLG | 223 | VIN WVG GML YFA DSV KG | 230 | ES VS SF SC GG WL TR PD |

TABLE 1A-continued

| Name | SEQ ID NO: | Sequence of dual VHH dimer | SEQ ID NO: | CDR1 | SEQ ID NO: | CDR2 | SEQ ID NO: | CDR3 | SEQ ID NO: | CDR4 | SEQ ID NO: | CDR5 | SEQ ID NO: | CDR6 |
|---|---|---|---|---|---|---|---|---|---|---|---|---|---|---|
| | | ESGGGSVQAGGSLRLSCR ASGSTYSNYCLGWFRQIT GKEREGVAVINWVGGMLY FADSVKGRFTVSQDQAKN TLYLQMNSLKPEDTAMYY CAAESVSSFSCGGWLTRP DRVPYWGQGTQVTVSS | | S R W C M A | | G | | | | | | | | | RV PY |
| DR591-hIL27Ra-VHH11 | 806 | QVQLQESGGGSVQAGGSL RLSCTASGAIASGYIDSR WCMAWFRQAPGKEREGVA AIWPGGGLTVYADSVKGR FTISRDHAKNTLYLQMNN LKPEDTAMYYCAAGSPRM CPSLEFGFDYWGQGTQVT VSSGGSGGSGGSGQVQLQ ESGGGSVQAGGSLRLSCR ASGSTYSNYCLGWFRQST GKEREGVAVINWVGGMLY FADSVKGRFTVSQDHAKN TVTLQMNSLKPEDTAMYY CAAESVSSFSCGGWLTRP GRVPYWGQGTQVTVSS | 943 | AIASGYIDS RWCMA | 199 | AIWPGGGLTVYADSVK G | 205 | GSPRMCPSLEFGFDY | 216 | STYSNYCLG | 223 | VINWVGGMLYFADSVKG | 949 | ESVSSFSCGGWLTRPGRYPY |
| DR591-hIL27Ra-VHH12 | 807 | QVQLQESGGGSVQAGGSL RLSCTASGAIASGYIDSR WCMAWFRQAPGKEREGVA AIWPGGGLTVYADSVKGR FTISRDHAKNTLYLQMNN LKPEDTAMYYCAAGSPRM CPSLEFGFDYWGQGTQVT VSSGGSGGSGGSGQVQLQ ESGGGSVQAGESLRLSCR ASGSTYSNYCLGWFRQIT GKEREGVAVINWVGGMLY FADSVKGRFTVSQDQAKN TVYLEMNSLKPEDTAMYY CATESVSSFSCGGWLTRP DRVPYWGQGTQVTVSS | 943 | AIASGYIDS RWCMA | 199 | AIWPGGGLTVYADSVK G | 205 | GSPRMCPSLEFGFDY | 216 | STYSNYCLG | 223 | VINWVGGMLYFADSVKG | 230 | ESVSSFSCGGWLTRPDRVP |
| DR591-hIL27Ra-VHH13 | 808 | QVQLQESGGGSVQAGGSL RLSCTASGAIASGYIDSR WCMAWFRQAPGKEREGVA AIWPGGGLTVYADSVKGR FTISRDHAKNTLYLQMNN LKPEDTAMYYCAAGSPRM CPSLEFGFDYWGQGTQVT VSSGGSGGSGGSGQVQLQ ESGGGSVQAGGSLRLSCV ASGYVSCDYFLPSWYRQA PGKEREFVSIIDGTGSTS YAASVKGRFTASQDRGKN IAYLQMNSLKPEDTAMYY CKASCVRGRTISEYWGQG TQVTVSS | 943 | AIASGYIDS RWCMA | 199 | AIWPGGGLTVYADSVK G | 205 | GSPRMCPSLEFGFDY | 215 | YVSCDYFLPS | 222 | IIDGTGSTSYAAS | 950 | SCVRGRTISEY |
| DR591-hIL27Ra-VHH14 | 809 | QVQLQESGGGSVQAGGSL RLSCTASGAIASGYIDSR WCMAWFRQAPGKEREGVA AIWPGGGLTVYADSVKGR FTISRDHAKNTLYLQMNN LKPEDTAMYYCAAGSPRM CPSLEFGFDYWGQGTQVT VSSGGSGGSGGSGQVQLQ ESGGGSVQAGGSLRLSCV ASGYVSCDYFLPSWYRQA PGKEREFVSIIDGTGSTS YAASVKGRFTASQDKGKN IAYLQMNSLKPEDTAMYY CKASCVRGRAISEYWGQG TQVTVSS | 943 | AIASGYIDS RWCMA | 199 | AIWPGGGLTVYADSVK G | 205 | GSPRMCPSLEFGFDY | 215 | YVSCDYFLPS | 222 | IIDGTGSTSYAAS | 229 | SCVRGRAISEY |
| DR591-hIL27Ra-VHH15 | 810 | QVQLQESGGGSVQAGGSL RLSCTASGAIASGYIDSR WCMAWFRQAPGKEREGVA AIWPGGGLTVYADSVKGR | 943 | AIASGYIDS RWCMA | 199 | AIWPGGGLTVYADSVK G | 205 | GSPRMCPSLEFGFDY | 215 | YVSCDYFLPS | 222 | IIDGTGSTSYAAS | 229 | SCVRGRAI |

TABLE 1A-continued

| Name | SEQ ID NO: | Sequence of dual VHH dimer | SEQ ID NO: | CDR1 | SEQ ID NO: | CDR2 | SEQ ID NO: | CDR3 | SEQ ID NO: | CDR4 | SEQ ID NO: | CDR5 | SEQ ID NO: | CDR6 |
|---|---|---|---|---|---|---|---|---|---|---|---|---|---|---|
| | | FTISRDHAKNTLYLQMNN LKPEDTAMYYCAAGSPRM CPSLEFGFDYWGQGTQVT VSSGGSGGSGGSGQVQLQ ESGGGSVQAGGSLRLSCV ASGYVSCDYFLPSWYRQA PGKEREFVSIIDGTGSTS YAASVKGRFTASQDKGKN IAYLQMNTLKPEDTAMYY CKASCVRGRAISEYWGQG TQVTVSS | | G Y I D S R W C M A | | TV YA DS VK G | | LE FG FD Y | | | | SVK G | | SE Y |
| DR591-hIL27Ra-VHH1 | 811 | QVQLQESGGGSVQAGGSL RLSCTASGAIASGYIDSR WCMAWFRQAPGKEREGVA AIWPGGGLTVYADSVKGR FTISRDHAKNTLYLQMNN LKPEDTAMYYCAAGSPRM CPSLEFGFDYWGQGTQVT VSSGGSGGSGGSGQVQLQ ESGGGSVQAGGSLRLSCR ASGSTYSNYCLGWFRQIT GKEREGVAVINWVGGMLY FADSVKGRFTVSQDQAKN TVYLQMNSLKPEDTAMYY CAAESASSFSCGGWLTRP DRVPYWGQGTQVTVSS | 943 | A I A S G Y I D S R W C M A | 199 | AI WP GG GL TV YA DS VK G | 205 | GS PR MC PS LE FG FD Y | 216 | STY SNY CLG | 223 | VIN WVG GML YFA DSV KG | 951 | ES AS SF SC GG WL TR PD RV PY |
| DR591-hIL27Ra-VHH17 | 812 | QVQLQESGGGSVQAGGSL RLSCTASGAIASGYIDSR WCMAWFRQAPGKEREGVA AIWPGGGLTVYADSVKGR FTISRDHAKNTLYLQMNN LKPEDTAMYYCAAGSPRM CPSLEFGFDYWGQGTQVT VSSGGSGGSGGSGQVQLQ ESGGGLVQPGGSLRLSCA ASGFTFSLSGMSWVRQAP GKGLEWVSAISSGGASTY YTDSVKGRFTISRDNAKN MLYLQLNSLKTEDTAMYY CAKGGSGYGDASRMTSPG SQGTQVTVSS | 943 | A I A S G Y I D S R W C M A | 199 | AI WP GG GL TV YA DS VK G | 205 | GS PR MC PS LE FG FD Y | 940 | FTF SLS GMS | 224 | AIS SGG AST YYT DSV KG | 231 | GG SG YG DA SR MT SP |
| DR591-hIL27Ra-VHH18 | 813 | QVQLQESGGGSVQAGGSL RLSCTASGAIASGYIDSR WCMAWFRQAPGKEREGVA AIWPGGGLTVYADSVKGR FTISRDHAKNTLYLQMNN LKPEDTAMYYCAAGSPRM CPSLEFGFDYWGQGTQVT VSSGGSGGSGGSGQVQLQ ESGGGSVQAGGSLRLSCV ASGYVSCDYFLPSWYRQA PGKEREFVSIIDGTGSTS YAASVKGRFTASQDKGKN TAYLQMNSLKPEDTAMYY CKASCVRGRGISEYWGQG TQVTVSS | 943 | A I A S G Y I D S R W C M A | 199 | AI WP GG GL TV YA DS VK G | 205 | GS PR MC PS LE FG FD Y | 215 | YVS CDY FLP S | 222 | IID GTG STS YAA SVK G | 952 | SC VR GR GI SE Y |
| DR591-hIL27Ra-VHH19 | 814 | QVQLQESGGGSVQAGGSL RLSCTASGAIASGYIDSR WCMAWFRQAPGKEREGVA AIWPGGGLTVYADSVKGR FTISRDHAKNTLYLQMNN LKPEDTAMYYCAAGSPRM CPSLEFGFDYWGQGTQVT VSSGGSGGSGGSGQVQLQ ESGGGSVQAGGSLRLSCR ASGSTYSNYCLGWFRQIT GKEREGVAVINWVGGMLY FADSVKGRFTVSQDQAKN TVYLQMNSLKPEDTAMYY CAAESVSSFSCGGWLTRP DRVPYWGQGTQVTVSS | 943 | A I A S G Y I D S R W C M A | 190 | AI WP GG GL TV YA DS VK G | 205 | GS PR MC PS LE FG FD Y | 216 | STY SNY CLG | 223 | VIN WVG GML YFA DSV KG | 230 | ES VS SF SC GG NI TR PD PY |

TABLE 1A-continued

| Name | SEQ ID NO: | Sequence of dual VHH dimer | SEQ ID NO: | CDR1 | SEQ ID NO: | CDR2 | SEQ ID NO: | CDR3 | SEQ ID NO: | CDR4 | SEQ ID NO: | CDR5 | SEQ ID NO: | CDR6 |
|---|---|---|---|---|---|---|---|---|---|---|---|---|---|---|
| DR591-hIL27Ra-VHH20 | 815 | QVQLQESGGGSVQAGGSLRLSCTASGAIASGYIDSRWCMAWFRQAPGKEREGVAAIWPGGGLTVYADSVKGRFTISRDHAKNTLYLQMNNLKPEDTAMYYCAAGSPRMCPSLEFGFDYWGQGTQVTVSSGGSGGSGGSGSGQVQLQESGGGLVQPGGSLRLSCAASGFTFSSYPMSWVRQAPGKGLEWVSTISSGDTTLYADSVKGRFTSSRDNAKNTLYLQLNSLKTEDTAMYYCAKRIDCNSGYCYKRSYWGQGTQVTVSS | 943 | AIASGYIDSRWCMA | 199 | AIWPGGGLTVYADSVKG | 205 | GSPRMCPSLEFGFDY | 211 | FTFSSYPMS | 945 | TISSGGDTTLYADSVKG | 953 | RIDCNSGYCYKRSY |
| DR591-hIL27Ra-VHH21 | 816 | QVQLQESGGGSVQAGGSLRLSCTASGAIASGYIDSRWCMAWFRQAPGKEREGVAAIWPGGGLTVYADSVKGRFTISRDHAKNTLYLQMNNLKPEDTAMYYCAAGSPRMCPSLEFGFDYWGQGTQVTVSSGGSGGSGGSGSGQVQLQESGGGLVQPGGSLRLSCAASGFTFSLSSMSWVRQAPGKGLEWVSAISSGGASTYYTDSVKGRFTISRDNAKNMLYLQLNSLKTEDTAMYYCAKGGSGYGDASRMTSPGSQGTQVTVSS | 943 | AIASGYIDSRWCMA | 199 | AIWPGGGLTVYADSVKG | 205 | GSPRMCPSLEFGFDY | 217 | FTFSLSSMS | 224 | AISSGGASTYYTDSVKG | 231 | GGSGYGDASRMTSP |
| DR591-hIL27Ra-VHH22 | 817 | QVQLQESGGGSVQAGGSLRLSCTASGAIASGYIDSRWCMAWFRQAPGKEREGVAAIWPGGGLTVYADSVKGRFTISRDHAKNTLYLQMNNLKPEDTAMYYCAAGSPRMCPSLEFGFDYWGQGTQVTVSSGGSGGSGGSGSGQVQLQESGGGSVQAGGSLRLSCRASGSTYSNYCLGWFRQTTGKEREGVAVINWVGGMLYFADSVKGRFTVSQDQAKNTVYLQMNSLKPEDTAMYYCAAESVSSFSCGGWLTRPDRVPYWGQGTQVTVSS | 943 | AIASGYIDSRWCMA | 199 | AIWPGGGLTVYADSVKG | 205 | GSPRMCPSLEFGFDY | 216 | STYSNYCLG | 223 | VINWVGGMLYFADSVKG | 230 | ESVSSFSCGGWLTRPDRVPY |
| DR591-hIL27Ra-VHH23 | 818 | QVQLQESGGGSVQAGGSLRLSCTASGAIASGYIDSRWCMAWFRQAPGKEREGVAAIWPGGGLTVYADSVKGRFTISRDHAKNTLYLQMNNLKPEDTAMYYCAAGSPRMCPSLEFGFDYWGQGTQVTVSSGGSGGSGGSGSGQVQLQESGGGSVQAGGSLRLSCRASRSPYGNYCLGWFRQSTGKEREGVAVINWVGGMLYFADSVKGRFTVSQDHAKNTVTLQMNSLKPEDTAMYYCAAESVSSFSCGGWLTRPDRVPYWGQGTQVTVSS | 943 | AIASGYIDSRWCMA | 199 | AIWPGGGITVYADSVKG | 205 | GSPRMCPSLEFGFDY | 941 | SPYGNYCLG | 223 | VINWVGGMLYFADSVKG | 230 | ESVSSFSCGGWLTRPDRVPY |
| DR591-hIL27Ra-VHH24 | 819 | QVQLQESGGGSVQAGGSLRLSCTASGAIASGYIDSRWCMAWFRQAPGKEREGVAAIWPGGGLTVYADSVKGRFTISRDHAKNTLYLQMNNLKPEDTAMYYCAAGSPRMCPSLEFGFDYWGQGTQVTVSSGGSGGSGGSGSGQVQLQESGGGLVQPGGSLRLSCAASGFTFSHSGMSWVRQAPGKGLEWVSTINSGGASTYYTDSVKGRFTISRDNAKN | 943 | AIASGYIDSRWCMA | 199 | AIWPGGGLTVYADSVKG | 205 | GSPRMCPSLEFGFDY | 942 | FTFSHSGMS | 946 | TINSGGASTYYTDSVKG | 231 | GGSGYGDASRMTSP |

TABLE 1A-continued

| Name | SEQ ID NO: | Sequence of dual VHH dimer | SEQ ID NO: | CDR1 | SEQ ID NO: | CDR2 | SEQ ID NO: | CDR3 | SEQ ID NO: | CDR4 | SEQ ID NO: | CDR5 | SEQ ID NO: | CDR6 |
|---|---|---|---|---|---|---|---|---|---|---|---|---|---|---|
| | | MLYLQLNSLKTEDTAMYY CAKGGSYGDASRMTSPG SQGTQVTVSS | | MA | | | | | | | | | | |
| DR592-hIL27Ra-VHH1 | 820 | QVQLQESGGGSVQAGGSL RLSCTAPGFTSNSCGMDW YRQAPGKEREFVSSISTD GTTGYADSVKGRFTISKD KAKDTVYLQMNSLKPEDT GMYSCKTKDGTIATMELC DFGYWGQGTQVTVSSGGS GGSGGSGQVQLQESGGGL VQPGGSLRLSCAASGFTF SSYPMSWVRQAPGKGLEW ISTISAGGDTTLYADSVK GRFTSSRDNAKNTLYLQL NSLKTEDAAIYYCAKRID CNSGYCYRRNYWGQGTQV TVSS | 194 | FTSNSCGMDWC G | 200 | SISTDGTTGYADSVKG | 206 | KDGTIATMELCDFGYWC | 211 | FTFSSYPMS | 218 | TISAGGDTTLYADSVKG | 947 | RIDCNSGYCYRRNY |
| DR592-hIL27Ra-VHH2 | 821 | QVQLQESGGGSVQAGGSL RLSCTAPGFTSNSCGMDW YRQAPGKEREFVSSISTD GTTGYADSVKGRFTISKD KAKDTVYLQMNSLKPEDT GMYSCKTKDGTIATMELC DFGYWGQGTQVTVSSGGS GGSGGSGQVQLQESGGGL VQPGGSLRLSCAASGFTF SLSGMSWVRQAPGKGLEW VSAISSGGASTYYTDSVK GRFTISRDNAKNILYLQL NSLKTEDTAMYYCAKGGS GYGDASRMTSPGSQGTQV TVSS | 194 | FTSNSCGMDWC G | 200 | SISTDGTTGYADSVKG | 206 | KDGTIATMELCDFGYWC | 940 | FTFSLSGMS | 224 | AISSGGASTYYTDSVKG | 231 | GGSGYGDASRMTSP |
| DR592-hIL27Ra-VHH3 | 822 | QVQLQESGGGSVQAGGSL RLSCTAPGFTSNSCGMDW YRQAPGKEREFVSSISTD GTTGYADSVKGRFTISKD KAKDTVYLQMNSLKPEDT GMYSCKTKDGTIATMELC DFGYWGQGTQVTVSSGGS GGSGGSGQVQLQESGGGS VQAGGSLRLSCVASGYVS CDYFLPSWYRQAPGKERE FVSIIDGTGSTSYAASVK GRFTASEDKGKNIAYLQM NSLKPEDTAMYYCKASCV RGRAVSEYWGQGTQVTVS S | 194 | FTSNSCGMDWC G | 200 | SISTDGTTGYADSVKG | 206 | KDGTIATMELCDFGYWC | 215 | YVSCDYFLPSW | 222 | IIDGTSTSYAASVKG | 948 | SCVRGRAVSEY |
| DR592-hIL27Ra-VHH4 | 823 | QVQLQESGGGSVQAGGSL RLSCTAPGFTSNSCGMDW YRQAPGKEREFVSSISTD GTTGYADSVKGRFTISKD KAKDTVYLQMNSLKPEDT GMYSCKTKDGTIATMELC DFGYWGQGTQVTVSSGGS GGSGGSGQVQLQESGGGL VQPGESLRLSCTASGFTF SNYAMSWVRQAPGKGLEW VSGINVAYGITSYADSVK GRFTISRDNTKNTLYLQL NSLKTEDTAIYYCVKHSG TTIPRGFISYTKRGQGTQ VTVSS | 194 | FTSNSCGMDWC G | 200 | SISTDGTTGYADSVKG | 206 | KDGTIATMELCDFGYWC | 212 | FTFSNYAMS | 219 | GINVAYGITSYADSVKG | 226 | HSGTTIPRGFISYTK |
| DR592-hIL27Ra-VHH5 | 824 | QVQLQESGGGSVQAGGSL RLSCTAPGFTSNSCGMDW YRQAPGKEREFVSSISTD GTTGYADSVKGRFTISKD KAKDTVYLQMNSLKPEDT GMYSCKTKDGTIATMELC DFGYWGQGTQVTVSSGGS GGSGGSGQVQLQESGGGS | 194 | FTSNSCGMDWC G | 200 | SISTDGTTGYADSVKG | 206 | KDGTIATMELCDFGYWC | 215 | YVSCDYFLPSW | 944 | VIDGTGSTSYAASVKG | 229 | SCVRGRAISEY |

TABLE 1A-continued

| Name | SEQ ID NO: | Sequence of dual VHH dimer | SEQ ID NO: | CDR1 | SEQ ID NO: | CDR2 | SEQ ID NO: | CDR3 | SEQ ID NO: | CDR4 | SEQ ID NO: | CDR5 | SEQ ID NO: | CDR6 |
|---|---|---|---|---|---|---|---|---|---|---|---|---|---|---|
| | | VQAGGSLRLSCTASGYVSCDYFLPSWYRQAPGKEREFVSVIDTGSTSYAASVKGRFTASQDKGKNIAYLQMNSLKPEDTAMYYCKASCVRGRAISEYWGQGTQVTVSS | | D | | | | | | | | | | |
| DR592-hIL27Ra-VHH6 | 825 | QVQLQESGGGSVQAGGSLRLSCTAPGFTSNSCGMDWYRQAPGKEREFVSSISTDGTTGYADSVKGRFTISKDKAKDTVYLQMNSLKPEDTGMYSCKTKDGTIATMELCDFGYWGQGTQVTVSSGGSGGSGGSGQVQLQESGGGLVQPGGSLRLSCAASGFSFSSYAMKWVRQAPGKGLEWVSTISSGGSSTNYADSVKGRFTISRDNAKNTLYLQLNSLKIEDTAMYYCAKAIVPTGATMERGQGTQVTVSS | 194 | FTSNSCGMD | 200 | SISTDGTTGYADSVKG | 206 | KDGTIATMELCDFGY | 213 | FSFSSYAMK | 220 | TISSGGSSTNYADSVKG | 227 | AIVPTGATME |
| DR592-hIL27Ra-VHH7 | 826 | QVQLQESGGGSVQAGGSLRLSCTAPGFTSNSCGMDWYRQAPGKEREFVSSISTDGTTGYADSVKGRFTISKDKAKDTVYLQMNSLKPEDTGMYSCKTKDGTIATMELCDFGYWGQGTQVTVSSGGSGGSGGSGQVQLQESGGGLVQPGGSLRLSCAASGFTFSSYPMSWVRQAPGKGLEWISTISAGGDTTLYADSVKGRFTSSRDNAKNTLYLQLNSLKTEDTAIYYCAKRIDCNSGYCYRRNYWGQGTQVTVSS | 194 | FTSNSCGMD | 200 | SISTDGTTGYADSVKG | 206 | KDGTIATMELCDFGY | 211 | FTFSSYPMS | 218 | TISAGGDTTLYADSVKG | 947 | RIDCNSGYCYRRNY |
| DR592-hIL27Ra-VHH8 | 827 | QVQLQESGGGSVQAGGSLRLSCTAPGFTSNSCGMDWYRQAPGKEREFVSSISTDGTTGYADSVKGRFTISKDKAKDTVYLQMNSLKPEDTGMYSCKTKDGTIATMELCDFGYWGQGTQVTVSSGGSGGSGGSGQVQLQESGGGSVQVGGSLRLSCAASGFTFSSYPMSWVRQAPGKGLEWISTISAGGDTTLYADSVKGRFTSSRDNAKNTLYLQLNSLKTEDTAIYYCAKRIDCNSGYCYRRNYWGQGTQVTVSS | 194 | FTSNSCGMD | 200 | SISTDGTTGYADSVKG | 206 | KDGTIATMELCDFGY | 211 | FTFSSYPMS | 218 | TISAGGDTTLYADSVKG | 947 | RIDCNSGYCYRRNY |
| DR592-hIL27Ra-VHH9 | 828 | QVQLQESGGGSVQAGGSLRLSCTAPGFTSNSCGMDWYRQAPGKEREFVSSISTDGTTGYADSVKGRFTISKDKAKDTVYLQMNSLKPEDTGMYSCKTKDGTIATMELCDFGYWGQGTQVTVSSGGSGGSGGSGQVQLQESGGGSVQSGGSLRLSCAASGFTYSTSNSWMAWFRQAPGKEREGVAAIYTVGGSIFYADSVRGRFTISQDATKNMFYLQMNTLKPEDTAMYYCAAASGRLRGKWFWPYEYNYWGQGTQVTVSS | 194 | FTYSTSNSWMA | 200 | SISTDGTTGYADSVKG | 206 | KDGTIATMELCDFGY | 214 | FTYSTSNSWMA | 221 | AIYTVGGSIFYADSVRG | 228 | ASGRLRGKWFWPYEYNYY |
| DR592-hIL27Ra-VHH10 | 829 | QVQLQESGGGSVQAGGSLRLSCTAPGFTSNSCGMDWYRQAPGKEREFVSSISTDGTTGYADSVKGRFTISKDKAKDTVYLQMNSLKPEDT | 194 | FTSNSCGMD | 200 | SISTDGTTGYADSVKG | 206 | KDGTIATMELCDFGY | 216 | STYSNYCLG | 223 | VINWVGGMLYFADSVRG | 230 | ESVSSFSCGG |

TABLE 1A-continued

| Name | SEQ ID NO: | Sequence of dual VHH dimer | SEQ ID NO: | CDR1 | SEQ ID NO: | CDR2 | SEQ ID NO: | CDR3 | SEQ ID NO: | CDR4 | SEQ ID NO: | CDR5 | SEQ ID NO: | CDR6 |
|---|---|---|---|---|---|---|---|---|---|---|---|---|---|---|
| | | GMYSCKTKDGTIATMELC DFGYWGQGTQVTVSSGGS GGSGGSGQVQLQESGGGS VQAGGSLRLSCRASGSTY SNYCLGWFRQITGKEREG VAVINWVGGMLYFADSVK GRFTVSQDQAKNTYLQM NSLKPEDTAMYYCAAESV SSFSCGGWLTRPDRVPYW GQGTQVTVSS | | C G M D | | AD SV KG | | CD FG Y | | | | KG | | WL TR PD RV PY |
| DR592-hIL27Ra-VHH11 | 830 | QVQLQESGGGSVQAGGSL RLSCTAPGFTSNSCGMDW YRQAPGKEREFVSSISTD GTTGYADSVKGRFTISKD KAKDTVYLQMNSLKPEDT GMYSCKTKDGTIATMELC DFGYWGQGTQVTVSSGGS GGSGGSGQVQLQESGGGS VQAGGSLRLSCRASGSTY SNYCLGWFRQSTGKEREG VAVINWVGGMLYFADSVK GRFTVSQDHAKNTVTLQM NSLKPEDTAMYYCAAESV SSFSCGGWLTRPGRVPYW GQGTQVTVSS | 194 | F T S N S C G M D | 200 | SI ST DG TT GY AD SV KG | 206 | KD GT IA TM EL CD FG Y | 216 | STY SNY CLG | 223 | VIN WVG GML YFA DSV KG | 949 | ES VS SF SC GG WL TR PG RI PY |
| DR592-hIL27Ra-VHH12 | 831 | QVQLQESGGGSVQAGGSL RLSCTAPGFTSNSCGMDW YRQAPGKEREFVSSISTD GTTGYADSVKGRFTISKD KAKDTVYLQMNSLKPEDT GMYSCKTKDGTIATMELC DFGYWGQGTQVTVSSGGS GGSGGSGQVQLQESGGGS VQAGESLRLSCRASGSTY SNYCLGWFRQITGKEREG VAVINWVGGMLYFADSVK GRFTVSQDQAKNTVYLEM NSLKPEDTAMYYCATESV SSFSCGGWLTRPDRVPYW GQGTQVTVSS | 194 | F T S N S C G M D | 200 | SI ST DG TT GY AD SV KG | 206 | KD GT IA TM EL CD FG Y | 216 | STY SNY CLG | 223 | VIN WVG GML YFA DSV KG | 230 | ES VS SF SC GG WL TR PD RV PY |
| DR592-hIL27Ra-VHH13 | 832 | QVQLQESGGGSVQAGGSL RLSCTAPGFTSNSCGMDW YRQAPGKEREFVSSISTD GTTGYADSVKGRFTISKD KAKDTVYLQMNSLKPEDT GMYSCKTKDGTIATMELC DFGYWGQGTQVTVSSGGS GGSGGSGQVQLQESGGGS VQAGGSLRLSCVASGYVS CDYFLPSWYRQAPGKERE FVSIIDGTGSTSYAASVK GRFTASQDRGKNIAYLQM NSLKPEDTAMYYCKASCV RGRTISEYWGQGTQVTVS S | 194 | F T S N S C G M D | 200 | SI ST DG TT GY AD SV KG | 206 | KD GT IA TM EL CD FG Y | 215 | YVS CDY FLP S | 222 | IID GTG STS YAA SVK G | 950 | SC VR GR TI SE Y |
| DR592-hIL27Ra-VHH14 | 833 | QVQLQESGGGSVQAGGSL RLSCTAPGFTSNSCGMDW YRQAPGKEREFVSSISTD GTTGYADSVKGRFTISKD KAKDTVYLQMNSLKPEDT GMYSCKTKDGTIATMELC DFGYWGQGTQVTVSSGGS GGSGGSGQVQLQESGGGS VQAGGSLRLSCVASGYVS CDYFLPSWYRQAPGKERE FVSIIDGTGSTSYAASVK GRFTASQDKGKNIAYLQM NSLKPEDTAMYYCKASCV RGRAISEYWGQGTQVTVS S | 194 | F T S N S C G M D | 200 | SI ST DG TT GY AD SV KG | 206 | KD GT IA TM EL CD FG Y | 215 | YVS CDY FLP S | 222 | IID GTG STS YAA SVK G | 229 | SC VR GR AI SE Y |

TABLE 1A-continued

| Name | SEQ ID NO: | Sequence of dual VHH dimer | SEQ ID NO: | CDR1 | SEQ ID NO: | CDR2 | SEQ ID NO: | CDR3 | SEQ ID NO: | CDR4 | SEQ ID NO: | CDR5 | SEQ ID NO: | CDR6 |
|---|---|---|---|---|---|---|---|---|---|---|---|---|---|---|
| DR592-hIL27Ra-VHH15 | 834 | QVQLQESGGGSVQAGGSLRLSCTAPGFTSNSCGMDWYRQAPGKEREFVSSISTDGTTGYADSVKGRFTISKDKAKDTVYLQMNSLKPEDTGMYSCKTKDGTIATMELCDFGYWGQGTQVTVSSGGSGGSGGSGQVQLQESGGGSVQAGGSLRLSCVASGYVSCDYFLPSWYRQAPGKEREFVSIIDGTGSTSYAASVKGRFTASQDKGKNIAYLQMNSLKPEDTAMYYCKASCVRGRAISEYWGQGTQVTVSS | 194 | FTSNSCGMD | 200 | SISTDGTTGYADSVKG | 206 | KDGTIATMELCDFGY | 215 | YVSCDYFLPS | 222 | IIDGTGSTSYAASVKG | 229 | SCVRGRAISEY |
| DR592-hIL27Ra-VHH16 | 835 | QVQLQESGGGSVQAGGSLRLSCTAPGFTSNSCGMDWYRQAPGKEREFVSSISTDGTTGYADSVKGRFTISKDKAKDTVYLQMNSLKPEDTGMYSCKTKDGTIATMELCDFGYWGQGTQVTVSSGGSGGSGGSGQVQLQESGGGSVQAGGSLRLSCRASGSTYSNYCLGWFRQITGKEREGVAVINWVGGMLYFADSVKGRFTVSQDQAKNTVYLQMNSLKPEDTAMYYCAAESASSFSCGGWLTRPDRVPYWGQGTQVTVSS | 194 | FTSNSCGMD | 200 | SISTDGTTGYADSVKG | 206 | KDGTIATMELCDFGY | 216 | STYSNYCLG | 223 | VINWVGGMLYFADSVKG | 951 | ESASSFSCGGWLTRPDRVPY |
| DR592-hIL27Ra-VHH17 | 836 | QVQLQESGGGSVQAGGSLRLSCTAPGFTSNSCGMDWYRQAPGKEREFVSSISTDGTTGYADSVKGRFTISKDKAKDTVYLQMNSLKPEDTGMYSCKTKDGTIATMELCDFGYWGQGTQVTVSSGGSGGSGGSGGLVQPGGSLRLSCAASGFTFSLSGMSWVRQAPGKGLEWVSAISSGGASTYYTDSVKGRFTISRDNAKNMLYLQLNSLKTEDTAMYYCAKGGSGYGDASRMTSPGSQGTQVTVSS | 194 | FTSNSCGMD | 200 | SISTDGTTGYADSVKG | 206 | KDGTIATMELCDFGY | 940 | FTFSLSGMS | 224 | AISSGGASTYYTDSVKG | 231 | GGSGYGDASRMTSP |
| DR592-hIL27Ra-VHH18 | 837 | QVQLQESGGGSVQAGGSLRLSCTAPGFTSNSCGMDWYRQAPGKEREFVSSISTDGTTGYADSVKGRFTISKDKAKDTVYLQMNSLKPEDTGMYSCKTKDGTIATMELCDFGYWGQGTQVTVSSGGSGGSGGSGQVQLQESGGGSVQAGGSLRLSCVASGYVSCDYFLPSWYRQAPGKEREFVSIIDGTGSTSYAASVKGRFTASQDKGKNIAYLQMNSLKPEDTAMYYCKASCVRGRGISEYWGQGTQVTVSS | 194 | FTSNSCGMD | 200 | SISTDGTTGYADSVKG | 206 | KDGTIATMELCDFGY | 215 | YVSCDYFLPS | 222 | IIDGTGSTSYAASVKG | 952 | SCVRGRGISEY |
| DR592-hIL27Ra-VHH19 | 838 | QVQLQESGGGSVQAGGSLRLSCTAPGFTSNSCGMDWYRQAPGKEREFVSSISTDGTTGYADSVKGRFTISKDKAKDTVYLQMNSLKPEDTGMYSCKTKDGTIATMELCDFGYWGQGTQVTVSSGGSGGSGGSGQVQLQESGGGSVQAGGSLRLSCRASGSTYSNYCLGWFRQITGKEREGVAVINWVGGMLYFADSVKGRFTVSQDQAKNTVYLQM | 194 | FTSNSCGMD | 200 | SISTDGTTGYADSVKG | 206 | KDGTIATMELCDFGY | 216 | STYSNYCLG | 223 | VINWVGGMLYFADSVKG | 230 | ESVSSFSCGGNITRPDRVPY |

| Name | SEQ ID NO: | Sequence of dual VHH dimer | SEQ ID NO: | CDR1 | SEQ ID NO: | CDR2 | SEQ ID NO: | CDR3 | SEQ ID NO: | CDR4 | SEQ ID NO: | CDR5 | SEQ ID NO: | CDR6 |
|---|---|---|---|---|---|---|---|---|---|---|---|---|---|---|
| | | NSLKPEDTAMYYCAAESV SSFSCGGWLTRPDRVPYW GQGTQVTVSS | | | | | | | | | | | | |
| DR592-hIL27Ra-VHH20 | 839 | QVQLQESGGGSVQAGGSL RLSCTAPGFTSNSCGMDW YRQAPGKEREFVSSISTD GTTGYADSVKGRFTISKD KAKDTVYLQMNSLKPEDT GMYSCKTKDGTIATMELC DFGYWGQGTQVTVSSGGS GGSGGSGQVQLQESGGGL VQPGGSLRLSCAASGFTF VSTISSGGDTTLYADSVK GRFTSSRDNAKNTLYLQL NSLKTEDTAMYYCAKRID SSYPMSWVRQAPGKGLEW CNSGYCYKRSYWGQGTQV TVSS | 194 | FTSNCGMDS | 200 | SISTDGTTGYADSVKG | 206 | KDGTIATMELCDFGY | 211 | FTFSSYPMS | 945 | TISSGGDTTLYADSVKG | 953 | RIDCNSGYCYKRSY |
| DR592-hIL27Ra-VHH21 | 840 | QVQLQESGGGSVQAGGSL RLSCTAPGFTSNSCGMDW YRQAPGKEREFVSSISTD GTTGYADSVKGRFTISKD KAKDTVYLQMNSLKPEDT GMYSCKTKDGTIATMELC DFGYWGQGTQVTVSSGGS GGSGGSGQVQLQESGGGL VQPGGSLRLSCAASGFTF SLSSMSWVRQAPGKGLEW VSAISSGGASTYYTDSVK GRFTISRDNAKNMLYLQL NSLKTEDTAMYYCAKGGS GYGDASRMTSPGSQGTQV TVSS | 194 | FTSNCGMDS | 200 | SISTDGTTGYADSVKG | 206 | KDGTIATMELCDFGY | 217 | FTFSLSSMS | 224 | AISSGGASTYYTDSVKG | 231 | GGSGYGDASRMTSP |
| DR592-hIL27Ra-VHH22 | 841 | QVQLQESGGGSVQAGGSL RLSCTAPGFTSNSCGMDW YRQAPGKEREFVSSISTD GTTGYADSVKGRFTISKD KAKDTVYLQMNSLKPEDT GMYSCKTKDGTIATMELC DFGYWGQGTQVTVSSGGS GGSGGSGQVQLQESGGGS VQAGGSLRLSCRASGSTY SNYCLGWFRQTTGKEREG VAVINWVGGMLYFADSVK GRFTVSQDQAKNTVYLQM NSLKPEDTAMYYCAAESV SSFSCGGWLTRPDRVPYW GQGTQVTVSS | 194 | FTSNCGMDS | 200 | SISTDGTTGYADSVKG | 206 | KDGTIATMELCDFGY | 216 | STYSNYCLG | 223 | VINWVGGMLYFADSVKG | 230 | ESVSSFSCGGWLTRPDRVPY |
| DR592-hIL27Ra-VHH23 | 842 | QVQLQESGGGSVQAGGSL RLSCTAPGFTSNSCGMDW YRQAPGKEREFVSSISTD GTTGYADSVKGRFTISKD KAKDTVYLQMNSLKPEDT GMYSCKTKDGTIATMELC DFGYWGQGTQVTVSSGGS GGSGGSGQVQLQESGGGS VQAGGSLRLSCRASRSPY GNYCLGWFRQSTGKEREG VAVINWVGGMLYFADSVK GRFTVSQDHAKNTVTLQM NSLKPEDTAMYYCAAESV SSFSCGGWLTRPDRVPYW GQGTQVTVSS | 194 | FTSNCGMDS | 200 | SISTDGTTGYADSVKG | 206 | KDGTIATMELCDFGY | 941 | SPYGNYCLG | 223 | VINWVGGMLYFADSVKG | 230 | ESVSSFSCGGWLTRPDRVPY |
| DR592-hIL27Ra-VHH24 | 843 | QVQLQESGGGSVQAGGSL RLSCTAPGFTSNSCGMDW YRQAPGKEREFVSSISTD GTTGYADSVKGRFTISKD KAKDTVYLQMNSLKPEDT GMYSCKTKDGTIATMELC DFGYWGQGTQVTVSSGGS GGSGGSGQVQLQESGGGL | 194 | FTSNCGMDS | 200 | SISTDGTTGYADSVKG | 206 | KDGTIATMELCDFGY | 942 | FTFSHSGMS | 946 | TINSGGASTYYTDSVKG | 231 | GGSGYGDASRMTSP |

TABLE 1A-continued

| Name | SEQ ID NO: | Sequence of dual VHH dimer | SEQ ID NO: | CDR1 | SEQ ID NO: | CDR2 | SEQ ID NO: | CDR3 | SEQ ID NO: | CDR4 | SEQ ID NO: | CDR5 | SEQ ID NO: | CDR6 |
|---|---|---|---|---|---|---|---|---|---|---|---|---|---|---|
| | | VQPGGSLRLSCAASGFTFSHSGMSWVRQAPGKLEWVSTINSGGASTYYTDSVKGRFTISRDNAKNMLYLQLNSLKTEDTAMYYCAKGGSGYGDASRMTSPGSQGTQVTVSS | | D | | | | | | | | | | |
| DR593-hIL27Ra-VHH1 | 844 | QVQLQESGGGSVQAGGSLRLSCAASGYPYSNGYMGWFRQAPGKEREGVATIYTGDGRTYYADSVKGRFTISRDNAKNTVDLQMSSLKPEDTAMYYCAARAAPLYSSGSPLTRARYNVWGQGTQVTVSSGGSGGSGGSGQVQLQESGGGLVQPGGSLRLSCAASGFTFSSYPMSWVRQAPGKGLEWISTISAGGDTTLYADSVKGRFTSSRDNAKNTLYLQLNSLKTEDAAIYYCAKRIDCNSGYCYRRNYWGQGTQVTVSS | 195 | YPYSNGYMG | 201 | TIYTGDGRTYYADSVKG | 207 | RAAPLYSSGSPLTRARYNV | 942 | FTFSHSGMS | 946 | TINSGGASTYYTDSVKG | 231 | GGSGYGDASRMTSP |
| DR593-hIL27Ra-VHH2 | 845 | QVQLQESGGGSVQAGGSLRLSCAASGYPYSNGYMGWFRQAPGKEREGVATIYTGDGRTYYADSVKGRFTISRDNAKNTVDLQMSSLKPEDTAMYYCAARAAPLYSSGSPLTRARYNVWGQGTQVTVSSGGSGGSGGSGQVQLQESGGGLVQPGGSLRLSCAASGFTFSLSGMSWVRQAPGKGLEWVSAISSGGASTYYTDSVKGRFTISRDNAKNILYLQLNSLKTEDTAMYYCAKGGSGYGDASRMTSPGSQGTQVTVSS | 195 | YPYSNGYMG | 201 | TIYTGIGRTYADSVKG | 207 | RAAPLYSSGSPLTRARYNV | 942 | FTFSHSGMS | 946 | TINSGGASTYYTDSVKG | 231 | GGSGYGDASRMTSP |
| DR593-hIL27Ra-VHH3 | 846 | QVQLQESGGGSVQAGGSLRLSCAASGYPYSNGYMGWFRQAPGKEREGVATIYTGDGRTYYADSVKGRFTISRDNAKNTVDLQMSSLKPEDTAMYYCAARAAPLYSSGSPLTRARYNVWGQGTQVTVSSGGSGGSGGSGQVQLQESGGGSVQAGGSLRLSCVASGYVSCDYFLPSWYRQAPGKEREFVSIIDGTGSTSYAASVKGRFTASEDKGKNIAYLQMNSLKPEDTAMYYCKASCVRGRAVSEYWGQGTQVTVSS | 195 | YPYSNGYMG | 201 | TIYTGIGRTYADSVKG | 207 | RAAPLYSSGSPLTRARYNV | 942 | FTFSHSGMS | 946 | TINSGGASTYYTDSVKG | 231 | GGSGYGDASRMTSP |
| DR593-hIL27Ra-VHH4 | 847 | QVQLQESGGGSVQAGGSLRLSCAASGYPYSNGYMGWFRQAPGKEREGVATIYTGDGRTYYADSVKGRFTISRDNAKNTVDLQMSSLKPEDTAMYYCAARAAPLYSSGSPLTRARYNVWGQGTQVTVSSGGSGGSGGSGQVQLQESGGGLVQPGESLRLSCTASGFTFSNYAMSWVRQAPGKGLEWVSGINVAYGITSYADSVKGRFTISRDNTKNTLYLQLNSLKTEDTAIYYCVKHSGTTIPRGFISYTKRGQGTQVTVSS | 195 | YPYSNGYMG | 201 | TIYTGDGRTYADSVKG | 207 | RAAPLYSSGSPLTRARYNV | 942 | FTFSHSGMS | 946 | TINSGGASTYYTDSVKG | 231 | GGSGYGDASRMTSP |
| DR593-hIL27Ra-VHH5 | 848 | QVQLQESGGGSVQAGGSLRLSCAASGYPYSNGYMGWFRQAPGKEREGVATIYTGDGRTYYADSVKGRFTISR | 195 | YPYSNGYMG | 201 | TIYTGDGRTYADSVKG | 207 | RAAPLYSSGS | 942 | FTFSHSGMS | 946 | TINSGGASTYYTDSVKG | 231 | GGSGYGDA |

TABLE 1A-continued

| Name | SEQ ID NO: | Sequence of dual VHH dimer | SEQ ID NO: | CDR1 | SEQ ID NO: | CDR2 | SEQ ID NO: | CDR3 | SEQ ID NO: | CDR4 | SEQ ID NO: | CDR5 | SEQ ID NO: | CDR6 |
|---|---|---|---|---|---|---|---|---|---|---|---|---|---|---|
| | | DNAKNTVDLQMSSLKPED TAMYYCAARAAPLYSSGS PLTRARYNVWGQGTQVTV SSGGSGGSGGSGQVQLQE SGGGSVQAGGSLRLSCTA SGYVSCDYFLPSWYRQAP GKEREFVSVIDTGSTSY AASVKGRFTASQDKGKNI AYLQMNSLKPEDTAMYYC KASCVRGRAISEYWGQGT QVTVSS | | N G Y M G | | TY YA DS VK G | | GS PL TR AR YN V | | | | DSV KG | | SR MT SP |
| DR593-hIL27Ra-VHH6 | 849 | QVQLQESGGGSVQAGGSL RLSCAASGYPYSNGYMGW FRQAPGKEREGVATIYTG DGRTYYADSVKGRFTISR DNAKNTVDLQMSSLKPED TAMYYCAARAAPLYSSGS PLTRARYNVWGQGTQVTV SSGGSGGSGGSGQVQLQE SGGGLVQPGGSLRLSCAA SGFSFSSYAMKWVRQAPG KGLEWVSTISSGGSSTNY ADSVKGRFTISRDNAKNT LYLQLNSLKIEDTAMYYC AKAIVPTGATMERGQGTQ VTVSS | 195 | Y P Y S N G Y M G | 201 | TI YT GD GR TY YA DS VK G | 207 | RA AP LY SS GS PL TR AR YN V | 942 | FTF SHS GMS | 946 | TIN SGG AST YYT DSV KG | 231 | GG SG YG DA SR MT SP |
| DR593-hIL27Ra-VHH7 | 850 | QVQLQESGGGSVQAGGSL RLSCAASGYPYSNGYMGW FRQAPGKEREGVATIYTG DGRTYYADSVKGRFTISR DNAKNTVDLQMSSLKPED TAMYYCAARAAPLYSSGS PLTRARYNVWGQGTQVTV SSGGSGGSGGSGQVQLQE SGGGLVQPGGSLRLSCAA SGFTFSSYPMSWVRQAPG KGLEWISTISAGGDTTLY ADSVKGRFTSSRDNAKNT LYLQLNSLKTEDTAIYYC AKRIDCNSGYCYRRNYWG QGTQVTVSS | 195 | Y P Y S N G Y M G | 201 | TI YT GD GR TY YA DS VK G | 207 | RA AP LY SS GS PL TR AR YN V | 942 | FTF SHS GMS | 946 | TIN SGG AST YYT DSV KG | 231 | GG SG YG DA SR MT SP |
| DR593-hIL27Ra-VHH8 | 851 | QVQLQESGGGSVQAGGSL RLSCAASGYPYSNGYMGW FRQAPGKEREGVATIYTG DGRTYYADSVKGRFTISR DNAKNTVDLQMSSLKPED TAMYYCAARAAPLYSSGS PLTRARYNVWGQGTQVTV SSGGSGGSGGSGQVQLQE SGGGSVQVGGSLRLSCAA SGFTFSSYPMSWVRQAPG KGLEWISTISAGGDTTLY ADSVKGRFTSSRDNAKNT LYLQLNSLKTEDTAIYYC AKRIDCNSGYCYRRNYWG QGTQVTVSS | 195 | Y P Y S N G Y M G | 201 | TI YT GD GR TY YA DS VK G | 207 | RA AP LY SS GS PL TR AR YN V | 942 | FTF SHS GMS | 946 | TIN SGG AST YYT DSV KG | 231 | GG SG YG DA SR MT SP |
| DR593-hIL27Ra-VHH9 | 852 | QVQLQESGGGSVQAGGSL RLSCAASGYPYSNGYMGW FRQAPGKEREGVATIYTG DGRTYYADSVKGRFTISR DNAKNTVDLQMSSLKPED TAMYYCAARAAPLYSSGS PLTRARYNVWGQGTQVTV SSGGSGGSGGSGQVQLQE SGGGSVQSGGSLRLSCAA SGFTYSTSNSWMAWFRQA PGKEREGVAAIYTVGGSI FYADSVRGRFTISQDATK NMFYLQMNTLKPEDTAMY YCAAASGRLRGKWFWPYE YNYWGQGTQVTVSS | 195 | Y P Y S N G Y M G | 201 | TI YT GD GR TY YA DS VK G | 207 | RA AP LY SS GS PL TR AR YN V | 942 | FTF SHS GMS | 946 | TIN SGG AST YYT DSV KG | 231 | GG SG YG DA SR MT SP |

TABLE 1A-continued

| Name | SEQ ID NO: | Sequence of dual VHH dimer | SEQ ID NO: | CDR1 | SEQ ID NO: | CDR2 | SEQ ID NO: | CDR3 | SEQ ID NO: | CDR4 | SEQ ID NO: | CDR5 | SEQ ID NO: | CDR6 |
|---|---|---|---|---|---|---|---|---|---|---|---|---|---|---|
| DR593-hIL27Ra-VHH10 | 853 | QVQLQESGGGSVQAGGSLRLSCAASGYPYSNGYMGWFRQAPGKEREGVATIYTGDGRTYYADSVKGRFTISRDNAKNTVDLQMSSLKPEDTAMYYCAARAAPLYSSGSPLTRARYNVWGQGTQVTVSSGGSGGSGGSGQVQLQESGGGSVQAGGSLRLSCRASGSTYSNYCLGWFRQITGKEREGVAVINWVGGMLYFADSVKGRFTVSQDQAKNTLYLQMNSLKPEDTAMYYCAAESVSSFSCGGWLTRPDRVPYWGQGTQVTVSS | 195 | YPYSNGYMG | 201 | TIYTGDGRTYYADSVKG | 207 | RAAPLYSSGSPLTRARYNV | 942 | FTFSHSGMS | 946 | TINSGGASTYYTDSVKG | 231 | GGSGYGDASRMTSP |
| DR593-hIL27Ra-VHH11 | 854 | QVQLQESGGGSVQAGGSLRLSCAASGYPYSNGYMGWFRQAPGKEREGVATIYTGDGRTYYADSVKGRFTISRDNAKNTVDLQMSSLKPEDTAMYYCAARAAPLYSSGSPLTRARYNVWGQGTQVTVSSGGSGGSGGSGQVQLQESGGGSVQAGGSLRLSCRASGSTYSNYCLGWFRQSTGKEREGVAVINWVGGMLYFADSVKGRFTVSQDHAKNTVTLQMNSLKPEDTAMYYCAAESVSSFSCGGWLTRPGRVPYWGQGTQVTVSS | 195 | YPYSNGYMG | 201 | TIYTGDGRTYYADSVKG | 207 | RAAPLYSSGSPLTRARYNV | 942 | FTFSHSGMS | 946 | TINSGGASTYYTDSVKG | 231 | GGSGYGDASRMTSP |
| DR593-hIL27Ra-VHH12 | 855 | QVQLQESGGGSVQAGGSLRLSCAASGYPYSNGYMGWFRQAPGKEREGVATIYTGDGRTYYADSVKGRFTISRDNAKNTVDLQMSSLKPEDTAMYYCAARAAPLYSSGSPLTRARYNVWGQGTQVTVSSGGSGGSGGSGQVQLQESGGGSVQAGESLRLSCRASGSTYSNYCLGWFRQITGKEREGVAVINWVGGMLYFADSVKGRFTVSQDQAKNTVYLEMNSLKPEDTAMYYCATESVSSFSCGGWLTRPDRVPYWGQGTQVTVSS | 195 | YPYSNGYMG | 201 | TIYTGEGRTYYADSVKG | 207 | RAAPLYSSGSPLTRARYNV | 942 | FTFSHSGMS | 946 | TINSGGASTYYTDSVKG | 231 | GGSGYGDASRMTSP |
| DR593-hIL27Ra-VHH13 | 856 | QVQLQESGGGSVQAGGSLRLSCAASGYPYSNGYMGWFRQAPGKEREGVATIYTGDGRTYYADSVKGRFTISRDNAKNTVDLQMSSLKPEDTAMYYCAARAAPLYSSGSPLTRARYNVWGQGTQVTVSSGGSGGSGGSGQVQLQESGGGSVQAGGSLRLSCVASGYVSCDYFLPSWYRQAPGKEREFVSIIDGTGSTSYAASVKGRFTASQDRGKNIAYLQMNSLKPEDTAMYYCKASCVRGRTISEYWGQGTQVTVSS | 195 | YPYSNGYMG | 201 | TIYTGIGRTYYADSVKG | 207 | RAAPLYSSGSPLTRARYNV | 942 | FTFSHSGMS | 946 | TINSGGASTYYTDSVKG | 231 | GGSGYGDASRMTSP |
| DR593-hIL27Ra-VHH14 | 857 | QVQLQESGGGSVQAGGSLRLSCAASGYPYSNGYMGWFRQAPGKEREGVATIYTGDGRTYYADSVKGRFTISRDNAKNTVDLQMSSLKPEDTAMYYCAARAAPLYSSGSPLTRARYNVWGQGTQVTVSSGGSGGSGGSGQVQLQESGGGSVQAGGSLRLSCVASGYVSCDYFLPSWYRQAPGKEREFVSIIDGTGSTSYAASVKGRFTASQDKGKNI | 195 | YPYSNGYMG | 201 | TIYTGDGRTYYADSVKG | 207 | RAAPLYSSGSPLTRARYNV | 942 | FTFSHSGMS | 946 | TINSGGASTYYTDSVKG | 231 | GGSGYGDASRMTSP |

TABLE 1A-continued

| Name | SEQ ID NO: | Sequence of dual VHH dimer | SEQ ID NO: CDR1 | | SEQ ID NO: CDR2 | | SEQ ID NO: CDR3 | | SEQ ID NO: CDR4 | | SEQ ID NO: CDR5 | | SEQ ID NO: CDR6 | |
|---|---|---|---|---|---|---|---|---|---|---|---|---|---|---|
| | | AYLQMNSLKPEDTAMYYC KASCVRGRAISEYWGQGT QVTVSS | | | | | | | | | | | | |
| DR593-hIL27Ra-VHH15 | 858 | QVQLQESGGGSVQAGGSL RLSCAASGYPYSNGYMGW FRQAPGKEREGVATIYTG DGRTYYADSVKGRFTISR DNAKNTVDLQMSSLKPED TAMYYCAARAAPLYSSGS PLTRARYNVWGQGTQVTV SSGGSGGSGGSGQVQLQE SGGGSVQAGGSLRLSCVA SGYVSCDYFLPSWYRQAP GKEREFVSIIDGTGSTSY AASVKGRFTASQDKGKNI AYLQMNTLKPEDTAMYYC KASCVRGRAISEYWGQGT QVTVSS | 195 | Y P Y S N G Y M G | 201 | TI YT GD GR TY YA DS VK G | 207 | RA AP LY SS GS PL TR AR YN V | 942 | FTF | 946 | TIN SHS GMS SGG AST YYT DSV KG | 231 | GG SG YG DA SR MT SP |
| DR593-hIL27Ra-VHH16 | 859 | QVQLQESGGGSVQAGGSL RLSCAASGYPYSNGYMGW FRQAPGKEREGVATIYTG DGRTYYADSVKGRFTISR DNAKNTVDLQMSSLKPED TAMYYCAARAAPLYSSGS PLTRARYNVWGQGTQVTV SSGGSGGSGGSGQVQLQE SGGGSVQAGGSLRLSCRA SGSTYSNYCLGWFRQITG KEREGVAVINWVGGMLYF ADSVKGRFTVSQDAKNT VYLQMNSLKPEDTAMYYC AAESASSFSCGGWLTRPD RVPYWGQGTQVTVSS | 195 | Y P Y S N G Y M G | 201 | TI YT GD GR TY YA DS VK G | 207 | RA AP LY SS GS PL TR AR YN V | 942 | FTF | 946 | TIN SHS GMS SGG AST YYT DSV KG | 231 | GG SG YG DA SR MT SP |
| DR593-hIL27Ra-VHH17 | 860 | QVQLQESGGGSVQAGGSL RLSCAASGYPYSNGYMGW FRQAPGKEREGVATIYTG DGRTYYADSVKGRFTISR DNAKNTVDLQMSSLKPED TAMYYCAARAAPLYSSGS PLTRARYNVWGQGTQVTV SSGGSGGSGGSGQVQLQE SGGGLVQPGGSLRLSCAA KGLEWVSAISSGGASTYY TDSVKGRFTISRDNAKNM LYLQLNSLKTEDTAMYYC SGFTFSLSGMSWVRQAPG AKGGSGYGDASRMTSPGS QGTQVTVSS | 195 | Y P Y S N G Y M G | 201 | TI YT GD GR TY YA DS VK G | 207 | RA AP LY SS GS PL TR AR YN V | 942 | FTF | 946 | TIN SHS GMS SGG AST YYT DSV KG | 231 | GG SG YG DA SR MT SP |
| DR593-hIL27Ra-VHH18 | 861 | QVQLQESGGGSVQAGGSL RLSCAASGYPYSNGYMGW FRQAPGKEREGVATIYTG DGRTYYADSVKGRFTISR DNAKNTVDLQMSSLKPED TAMYYCAARAAPLYSSGS PLTRARYNVWGQGTQVTV SSGGSGGSGGSGQVQLQE SGGGSVQAGGSLRLSCVA SGYVSCDYFLPSWYRQAP GKEREFVSIIDGTGSTSY AASVKGRFTASQDKGKNI AYLQMNSLKPEDTAMYYC KASCVRGRGISEYWGQGT QVTVSS | 195 | Y P Y S N G Y M G | 201 | TI YT GD GR TY YA DS VK G | 207 | RA AP LY SS GS PL TR AR YN V | 942 | FTF | 946 | TIN SHS GMS SGG AST YYT DSV KG | 231 | GG SG YG DA SR MT SP |
| DR593-hIL27Ra-VHH19 | 862 | QVQLQESGGGSVQAGGSL RLSCAASGYPYSNGYMGW FRQAPGKEREGVATIYTG DGRTYYADSVKGRFTISR DNAKNTVDLQMSSLKPED TAMYYCAARAAPLYSSGS PLTRARYNVWGQGTQVTV SSGGSGGSGGSGQVQLQE | 195 | Y P Y S N G Y M G | 201 | TI YT GD GR TY YA DS VK | 207 | RA AP LY SS GS PL TR AR | 942 | FTF | 946 | TIN SHS GMS SGG AST YYT DSV KG | 231 | GG SG YG DA SR MT SP |

TABLE 1A-continued

| Name | SEQ ID NO: | Sequence of dual VHH dimer | SEQ ID NO: | CDR1 | SEQ ID NO: | CDR2 | SEQ ID NO: | CDR3 | SEQ ID NO: | CDR4 | SEQ ID NO: | CDR5 | SEQ ID NO: | CDR6 |
|---|---|---|---|---|---|---|---|---|---|---|---|---|---|---|
| | | SGGGSVQAGGSLRLSCRA SGSTYSNYCLGWFRQITG KEREGVAVINWVGGMLYF ADSVKGRFTVSQDQAKNT VYLQMNSLKPEDTAMYYC AAESVSSFSCGGWLTRPD RVPYWGQGTQVTVSS | | G | | G | | YN V | | | | | | |
| DR593-hIL27Ra-VHH20 | 863 | QVQLQESGGGSVQAGGSL RLSCAASGYPYSNGYMGW FRQAPGKEREGVATIYTG DGRTYYADSVKGRFTISR DNAKNTVDLQMSSLKPED TAMYYCAARAAPLYSSGS PLTRARYNVWGQGTQVTV SSGGSGGSGGSGQVQLQE SGGGLVQPGGSLRLSCAA SGFTFSSYPMSWVRQAPG KGLEWVSTISSGGDTTLY ADSVKGRFTSSRDNAKNT LYLQLNSLKTEDTAMYYC AKRIDCNSGYCYKRSYWG QGTQVTVSS | 195 | Y P Y S N G Y M G | 201 | TI YT GD GR TY YA DS VK G | 207 | RA AP LY SS GS PL TR AR YN V | 942 | FTF SHS GMS | 946 | TIN SGG AST YYT DSV KG | 231 | GG SG YG DA SR MT SP |
| DR593-hIL27Ra-VHH21 | 864 | QVQLQESGGGSVQAGGSL RLSCAASGYPYSNGYMGW FRQAPGKEREGVATIYTG DGRTYYADSVKGRFTISR DNAKNTVDLQMSSLKPED TAMYYCAARAAPLYSSGS PLTRARYNVWGQGTQVTV SSGGSGGSGGSGQVQLQE SGGGLVQPGGSLRLSCAA SGFTFSLSSMSWVRQAPG KGLEWVSAISSGGASTYY TDSVKGRFTISRDNAKNM LYLQLNSLKTEDTAMYYC AKGGSGYGDASRMTSPGS QGTQVTVSS | 195 | Y P Y S N G Y M G | 201 | TI YT GD GR TY ZA DS VK G | 207 | RA AP LY SS GS PL TR AR YN V | 942 | FTF SHS GMS | 946 | TIN SGG AST YYT DSV KG | 231 | GG SG YG DA SR MT SP |
| DR593-hIL27Ra-VHH22 | 865 | QVQLQESGGGSVQAGGSL RLSCAASGYPYSNGYMGW FRQAPGKEREGVATIYTG DGRTYYADSVKGRFTISR DNAKNTVDLQMSSLKPED TAMYYCAARAAPLYSSGS PLTRARYNVWGQGTQVTV SSGGSGGSGGSGQVQLQE SGGGSVQAGGSLRLSCRA SGSTYSNYCLGWFRQTTG KEREGVAVINWVGGMLYF ADSVKGRFTVSQDQAKNT VYLQMNSLKPEDTAMYYC AAESVSSFSCGGWLTRPD RVPYWGQGTQVTVSS | 195 | Y P Y S N G Y M G | 201 | TI YT GD GR TY YA DS VK G | 207 | RA AP LY SS GS PL TR AR YN V | 942 | FTF SHS GMS | 946 | TIN SGG AST YYT DSV KG | 231 | GG SG YG DA SR MT SP |
| DR593-hIL27Ra-VHH23 | 866 | QVQLQESGGGSVQAGGSL RLSCAASGYPYSNGYMGW FRQAPGKEREGVATIYTG DGRTYYADSVKGRFTISR DNAKNTVDLQMSSLKPED TAMYYCAARAAPLYSSGS PLTRARYNVWGQGTQVTV SSGGSGGSGGSGQVQLQE SGGGSVQAGGSLRLSCRA SRSPYGNYCLGWFRQSTG KEREGVAVINWVGGMLYF ADSVKGRFTVSQDHAKNT VTLQMNSLKPEDTAMYYC AAESVSSFSCGGWLTRPD RVPYWGQGTQVTVSS | 195 | Y P Y S N G Y M G | 201 | TI YT GD GR TY YA DS VK G | 207 | RA AP LY SS GS PL TR AR YN V | 942 | FTF SHS GMS | 946 | TIN SGG AST YYT DSV KG | 231 | GG SG YG DA SR MT SP |
| DR593-hIL27Ra-VHH24 | 867 | QVQLQESGGGSVQAGGSL RLSCAASGYPYSNGYMGW FRQAPGKEREGVATIYTG DGRTYYADSVKGRFTISR | 195 | Y P Y S | 201 | TI YT GI GR | 207 | RA AP LY SS | 942 | FTF SHS GMS | 946 | TIN SGG AST YYT | 231 | GG SG YG DA |

TABLE 1A-continued

| Name | SEQ ID NO: | Sequence of dual VHH dimer | SEQ ID NO: CDR1 | CDR1 | SEQ ID NO: CDR2 | CDR2 | SEQ ID NO: CDR3 | CDR3 | SEQ ID NO: CDR4 | CDR4 | SEQ ID NO: CDR5 | CDR5 | SEQ ID NO: CDR6 | CDR6 |
|---|---|---|---|---|---|---|---|---|---|---|---|---|---|---|
| | | DNAKNTVDLQMSSLKPED TAMYYCAARAAPLYSSGS PLTRARYNVWGQGTQVTV SSGGSGGSGGSGQVQLQE SGGGLVQPGGSLRLSCAA SGFTFSHSGMSWVRQAPG KGLEWVSTINSGGASTYY TDSVKGRFTISRDNAKNM LYLQLNSLKTEDTAMYYC AKGGSGYGDASRMTSPGS QGTQVTVSS | | N G Y M G | | TY YA DS VK G | | GS PL TR AR YN V | | | | DSV KG | | SR MT SP |
| DR594-hIL27Ra-VHH1 | 868 | QVQLQESGGGSVQAGGSL RLSCVASASTYCTYDMHW YRQAPGKGREFVSAIDSD GTTRYADSVKGRFTISQG TAKNTVYLQMNSLQPEDT AMYYCKTVCVVGSRWSDY WGQGTQVTVSSGGSGGSG GSGQVQLQESGGGLVQPG GSLRLSCAASGFTFSSYP MSWVRQAPGKGLEWISTI SAGGDTTLYADSVKGRFT SSRDNAKNTLYLQLNSLK TEDAAIYYCAKRIDCNSG YCYRRNYWGQGTQVTVSS | 196 | S T Y C T Y D M H | 202 | AI DS DG TT RY AD SV KG | 954 | VC VV GS RW SD Y | 942 | FTF SHS GMS | 946 | TIN SGG AST YYT DSV KG | 231 | GG SG YG DA SR MT SP |
| DR594-hIL27Ra-VHH2 | 869 | QVQLQESGGGSVQAGGSL RLSCVASASTYCTYDMHW YRQAPGKGREFVSAIDSD GTTRYADSVKGRFTISQG TAKNTVYLQMNSLQPEDT AMYYCKTVCVVGSRWSDY WGQGTQVTVSSGGSGGSG GSGQVQLQESGGGLVQPG GSLRLSCAASGFTFSLSG MSWVRQAPGKGLEWVSAI SSGGASTYYTDSVKGRFT ISRDNAKNILYLQLNSLK TEDTAMYYCAKGGSGYGD ASRMTSPGSQGTQVTVSS | 196 | S T Y C T Y D M H | 202 | AI DS DG TT RY AD SV KG | 954 | VC VV GS RW SD Y | 942 | FTF SHS GMS | 946 | TIN SGG AST YYT DSV KG | 231 | GG SG YG DA SR MT SP |
| DR594-hIL27Ra-VHH3 | 870 | QVQLQESGGGSVQAGGSL RLSCVASASTYCTYDMHW YRQAPGKGREFVSAIDSD GTTRYADSVKGRFTISQG TAKNTVYLQMNSLQPEDT AMYYCKTVCVVGSRWSDY WGQGTQVTVSSGGSGGSG GSGQVQLQESGGGSVQAG GSLRLSCVASGYVSCDYF LPSWYRQAPGKEREFVSI IDGTGSTSYAASVKGRFT ASEDKGKNIAYLQMNSLK PEDTAMYYCKASCVRGRA VSEYWGQGTQVTVSS | 196 | S T Y C T Y D M H | 202 | AI DS DG TT RY AD SV KG | 954 | VC VV GS RW SD Y | 942 | FTF SHS GMS | 946 | TIN SGG AST YYT DSV KG | 231 | GG SG YG DA SR MT SP |
| DR594-hIL27Ra-VHH4 | 871 | QVQLQESGGGSVQAGGSL RLSCVASASTYCTYDMHW YRQAPGKGREFVSAIDSD GTTRYADSVKGRFTISQG TAKNTVYLQMNSLQPEDT AMYYCKTVCVVGSRWSDY WGQGTQVTVSSGGSGGSG GSGQVQLQESGGGLVQPG ESLRLSCTASGFTFSNYA MSWVRQAPGKGLEWVSGI NVAYGITSYADSVKGRFT ISRDNTKNTLYLQLNSLK TEDTAIYYCVKHSGTTIP RGFISYTKRGQGTQVTVS S | 196 | S T Y C T Y D M H | 202 | AI DS DG TT RY AD SV KG | 954 | VC VV GS RW SD Y | 942 | FTF SHS GMS | 946 | TIN SGG AST YYT DSV KG | 231 | GG SG YG DA SR MT SP |
| DR594-hIL27Ra-VHH5 | 872 | QVQLQESGGGSVQAGGSL RLSCVASASTYCTYDMHW YRQAPGKGREFVSAIDSD | 196 | S T Y | 202 | AI DS DG | 954 | VC VV GS | 942 | FTF SHS GMS | 946 | TIN SGG AST | 231 | GG SG YG |

TABLE 1A-continued

| Name | SEQ ID NO: | Sequence of dual VHH dimer | SEQ ID NO: CDR1 | SEQ ID NO: CDR2 | SEQ ID NO: CDR3 | SEQ ID NO: CDR4 | SEQ ID NO: CDR5 | SEQ ID NO: CDR6 |
|---|---|---|---|---|---|---|---|---|
| | | GTTRYADSVKGRFTISQG TAKNTVYLQMNSLQPEDT AMYYCKTVCVVGSRWSDY WGQGTQVTVSSGGSGGSG GSGQVQLQESGGGSVQAG GSLRLSCTASGYVSCDYF LPSWYRQAPGKEREFVSV IDGTGSTSYAASVKGRFT ASQDKGKNIAYLQMNSLK PEDTAMYYCKASCVRGRA ISEYWGQGTQVTVSS | C T Y D M H | TT RY AD SV KG | RW SD Y | | YYT DSV KG | DA SR MT SP |
| DR594-hIL27Ra-VHH6 | 873 | QVQLQESGGGSVQAGGSL RLSCVASASTYCTYDMHW YRQAPGKGREFVSAIDSD GTTRYADSVKGRFTISQG TAKNTVYLQMNSLQPEDT AMYYCKTVCVVGSRWSDY WGQGTQVTVSSGGSGGSG GSGQVQLQESGGGLVQPG GSLRLSCAASGFSFSSYA MKWVRQAPGKGLEWVSTI SSGGSSTNYADSVKGRFT ISRDNAKNTLYLQLNSLK IEDTAMYYCAKAIVPTGA TMERGQGTQVTVSS | 196 S T Y C T Y D M H | 202 AI DS DG TT RY AD SV KG | 954 VC VV GS RW SD Y | 942 FTF SHS GMS | 946 TIN SGG AST YYT DSV KG | 231 GG SG YG DA SR MT SP |
| DR594-hIL27Ra-VHH7 | 874 | QVQLQESGGGSVQAGGSL RLSCVASASTYCTYDMHW YRQAPGKGREFVSAIDSD GTTRYADSVKGRFTISQG TAKNTVYLQMNSLQPEDT AMYYCKTVCVVGSRWSDY WGQGTQVTVSSGGSGGSG GSGQVQLQESGGGLVQPG GSLRLSCAASGFTFSSYP MSWVRQAPGKGLEWISTI SAGGDTTLYADSVKGRFT SSRDNAKNTLYLQLNSLK TEDTAIYYCAKRIDCNSG YCYRRNYWGQGTQVTVSS | 196 S T Y C T Y D M H | 202 AI DS DG TT RY AD SV KG | 954 VC VV GS RI SD Y | 942 FTF SHS GMS | 946 TIN SGG AST YYT DSV KG | 231 GG SG YG DA SR MT SP |
| DR594-hIL27Ra-VHH8 | 875 | QVQLQESGGGSVQAGGSL RLSCVASASTYCTYDMHW YRQAPGKGREFVSAIDSD GTTRYADSVKGRFTISQG TAKNTVYLQMNSLQPEDT AMYYCKTVCVVGSRWSDY WGQGTQVTVSSGGSGGSG GSGQVQLQESGGGSVQVG GSLRLSCAASGFTFSSYP MSWVRQAPGKGLEWISTI SAGGDTTLYADSVKGRFT SSRDNAKNTLYLQLNSLK TEDTAIYYCAKRIDCNSG YCYRRNYWGQGTQVTVSS | 196 S T Y C T Y D M H | 202 AI DS DG TT RY AD SV KG | 954 VC VV GS RW SD Y | 942 FTF SHS GMS | 946 TIN SGG AST YYT DSV KG | 231 GG SG YG DA SR MT SP |
| DR594-hIL27Ra-VHH9 | 876 | QVQLQESGGGSVQAGGSL RLSCVASASTYCTYDMHW YRQAPGKGREFVSAIDSD GTTRYADSVKGRFTISQG TAKNTVYLQMNSLQPEDT AMYYCKTVCVVGSRWSDY WGQGTQVTVSSGGSGGSG GSGQVQLQESGGGSVQSG GSLRLSCAASGFTYSTSN SWMAWFRQAPGKEREGVA AIYTVGGSIFYADSVRGR FTISQDATKNMFYLQMNT LKPEDTAMYYCAASGRL RGKWFWPYEYNYWGQGTQ VTVSS | 196 S T Y C T Y D M H | 202 AI DS DG TT RY AD SV KG | 954 VC VV GS RW SD Y | 942 FTF SHS GMS | 946 TIN SGG AST YYT DSV KG | 231 GG SG YG DA SR MT SP |
| DR594-hIL27Ra-VHH10 | 877 | QVQLQESGGGSVQAGGSL RLSCVASASTYCTYDMHW YRQAPGKGREFVSAIDSD | 196 S T Y | 202 AI DS DG | 954 VC VV GS | 942 FTF SHS GMS | 946 TIN SGG AST | 231 GG SG YG |

TABLE 1A-continued

| Name | SEQ ID NO: | Sequence of dual VHH dimer | SEQ ID NO: | CDR1 | SEQ ID NO: | CDR2 | SEQ ID NO: | CDR3 | SEQ ID NO: | CDR4 | SEQ ID NO: | CDR5 | SEQ ID NO: | CDR6 |
|---|---|---|---|---|---|---|---|---|---|---|---|---|---|---|
| | | GTTRYADSVKGRFTISQG TAKNTVYLQMNSLQPEDT AMYYCKTVCVVGSRWSDY WGQGTQVTVSSGGSGGSG GSGQVQLQESGGGSVQAG GSLRLSCRASGSTYSNYC LGWFRQITGKEREGVAVI NWVGGMLYFADSVKGRFT VSQDQAKNTLYLQMNSLK PEDTAMYYCAAESVSSFS CGGWLTRPDRVPYWGQGT QVTVSS | | C T Y D M H | | TT RY AD SV KG | | RW SD Y | | | | YYT DSV KG | | DA SR MT SP |
| DR594-hIL27Ra-VHH11 | 878 | QVQLQESGGGSVQAGGSL RLSCVASASTYCTYDMHW YRQAPGKGREFVSAIDSD GTTRYADSVKGRFTISQG TAKNTVYLQMNSLQPEDT AMYYCKTVCVVGSRWSDY WGQGTQVTVSSGGSGGSG GSGQVQLQESGGGSVQAG GSLRLSCRASGSTYSNYC LGWFRQSTGKEREGVAVI NWVGGMLYFADSVKGRFT VSQDHAKNTVTLQMNSLK PEDTAMYYCAAESVSSFS CGGWLTRPGRVPYWGQGT QVTVSS | 196 | S T Y C T Y D M H | 202 | AI DS DG TT RY AD SV KG | 954 | VC VV GS RW SD Y | 942 | FTF SHS GMS | 946 | TIN SGG AST YYT DSV KG | 231 | GG SG YG DA SR MT SP |
| DR594-hIL27Ra-VHH12 | 879 | QVQLQESGGGSVQAGGSL RLSCVASASTYCTYDMHW YRQAPGKGREFVSAIDSD GTTRYADSVKGRFTISQG TAKNTVYLQMNSLQPEDT AMYYCKTVCVVGSRWSDY WGQGTQVTVSSGGSGGSG GSGQVQLQESGGGSVQAG ESLRLSCRASGSTYSNYC LGWFRQITGKEREGVAVI NWVGGMLYFADSVKGRFT VSQDQAKNTVYLEMNSLK PEDTAMYYCATESVSSFS CGGWLTRPDRVPYWGQGT QVTVSS | 196 | S T Y C T Y D M H | 202 | AI DS DG TT RY AI SV KG | 954 | VC VV GS RW SD Y | 942 | FTF SHS GMS | 946 | TIN SGG AST YYT DSV KG | 231 | GG SG YG DA SR MT SP |
| DR594-hIL27Ra-VHH13 | 880 | QVQLQESGGGSVQAGGSL RLSCVASASTYCTYDMHW YRQAPGKGREFVSAIDSD GTTRYADSVKGRFTISQG TAKNTVYLQMNSLQPEDT AMYYCKTVCVVGSRWSDY WGQGTQVTVSSGGSGGSG GSGQVQLQESGGGSVQAG GSLRLSCVASGYVSCDYF LPSWYRQAPGKEREFVSI IDGTGSTSYAASVKGRFT ASQDRGKNIAYLQMNSLK PEDTAMYYCKASCVRGRT ISEYWGQGTQVTVSS | 196 | S T Y C T Y D M H | 202 | AI DS DG TT RY AD SV KG | 954 | VC VV GS RW SD Y | 942 | FTF SHS GMS | 946 | TIN SGG AST YYT DSV KG | 231 | GG SG YG DA SR MT SP |
| DR594-hIL27Ra-VHH14 | 881 | QVQLQESGGGSVQAGGSL RLSCVASASTYCTYDMHW YRQAPGKGREFVSAIDSD GTTRYADSVKGRFTISQG TAKNTVYLQMNSLQPEDT AMYYCKTVCVVGSRWSDY WGQGTQVTVSSGGSGGSG GSGQVQLQESGGGSVQAG GSLRLSCVASGYVSCDYF LPSWYRQAPGKEREFVSI IDGTGSTSYAASVKGRFT ASQDKGKNIAYLQMNSLK PEDTAMYYCKASCVRGRA ISEYWGQGTQVTVSS | 196 | S T Y C T Y D M H | 202 | AI DS DG TT RY AD SV KG | 954 | VC VV GS RW SD Y | 942 | FTF SHS GMS | 946 | TIN SGG AST YYT DSV KG | 231 | GG SG YG DA SR MT SP |

TABLE 1A-continued

| Name | SEQ ID NO: | Sequence of dual VHH dimer | SEQ ID NO: | CDR1 | SEQ ID NO: | CDR2 | SEQ ID NO: | CDR3 | SEQ ID NO: | CDR4 | SEQ ID NO: | CDR5 | SEQ ID NO: | CDR6 |
|---|---|---|---|---|---|---|---|---|---|---|---|---|---|---|
| DR594-hIL27Ra-VHH15 | 882 | QVQLQESGGGSVQAGGSLRLSCVASASTYCTYDMHWYRQAPGKGREFVSAIDSDGTTRYADSVKGRFTISQGTAKNTVYLQMNSLQPEDTAMYYCKTVCVVGSRWSDYWGQGTQVTVSSGGSGGSGGSGQVQLQESGGGSVQAGGSLRLSCVASGYVSCDYFLPSWYRQAPGKEREFVSIIDGTGSTSYAASVKGRFTASQDKGKNIAYLQMNTLKPEDTAMYYCKASCVRGRAISEYWGQGTQVTVSS | 196 | STYCTYDMH | 202 | AIDSDGTTRYADSVKG | 954 | VCVVGSRWSDY | 942 | FTFSHSGMS | 946 | TINSGGASTYYTDSVKG | 231 | GGSGYGDASRMTSP |
| DR594-hIL27Ra-VHH16 | 883 | QVQLQESGGGSVQAGGSLRLSCVASASTYCTYDMHWYRQAPGKGREFVSAIDSDGTTRYADSVKGRFTISQGTAKNTVYLQMNSLQPEDTAMYYCKTVCVVGSRWSDYWGQGTQVTVSSGGSGGSGGSGQVQLQESGGGSVQAGGSLRLSCRASGSTYSNYCLGWFRQITGKEREGVAVINWVGGMLYFADSVKGRFTVSQDQAKNTVYLQMNSLKPEDTAMYYCAAESASSFSCGGWLTRPDRVPYWGQGTQVTVSS | 196 | STYCTYDMH | 202 | AIDSDGTTRYADSVKG | 954 | VCVVGSRWSDY | 942 | FTFSHSGMS | 946 | TINSGGASTYYTDSVKG | 231 | GGSGYGDASRMTSP |
| DR594-hIL27Ra-VHH17 | 884 | QVQLQESGGGSVQAGGSLRLSCVASASTYCTYDMHWYRQAPGKGREFVSAIDSDGTTRYADSVKGRFTISQGTAKNTVYLQMNSLQPEDTAMYYCKTVCVVGSRWSDYWGQGTQVTVSSGGSGGSGGSGQVQLQESGGGLVQPGGSLRLSCAASGFTFSLSGMSWVRQAPGKGLEWVSAISSGGASTYYTDSVKGRFTISRDNAKNMLYLQLNSLKTEDTAMYYCAKGGSGYGDASRMTSPGSQGTQVTVSS | 196 | STYCTYDMH | 202 | AIDSDGTTRYADSVKG | 954 | VCVVGSRWSDY | 942 | FTFSHSGMS | 946 | TINSGGASTYYTDSVKG | 231 | GGSGYGDASRMTSP |
| DR594-hIL27Ra-VHH18 | 885 | QVQLQESGGGSVQAGGSLRLSCVASASTYCTYDMHWYRQAPGKGREFVSAIDSDGTTRYADSVKGRFTISQGTAKNTVYLQMNSLQPEDTAMYYCKTVCVVGSRWSDYWGQGTQVTVSSGGSGGSGGSGQVQLQESGGGSVQAGGSLRLSCVASGYVSCDYFLPSWYRQAPGKEREFVSIIDGTGSTSYAASVKGRFTASQDKGKNIAYLQMNSLKPEDTAMYYCKASCVRGRGISEYWGQGTQVTVSS | 196 | STYCTYDMH | 202 | AIDSDGTTRYADSVKG | 954 | VCVVGSRISDY | 942 | FTFSHSGMS | 946 | TINSGGASTYYTDSVKG | 231 | GGSGYGDASRMTSP |
| DR594-hIL27Ra-VHH19 | 886 | QVQLQESGGGSVQAGGSLRLSCVASASTYCTYDMHWYRQAPGKGREFVSAIDSDGTTRYADSVKGRFTISQGTAKNTVYLQMNSLQPEDTAMYYCKTVCVVGSRWSDYWGQGTQVTVSSGGSGGSGGSGQVQLQESGGGSVQAGGSLRLSCRASGSTYSNYCLGWFRQITGKEREGVAVINWVGGMLYFADSVKGRFTVSQDQAKNTVYLQMNSLKPEDTAMYYCAAESVSSFSCGGWLTRPDRVPYWGQGTQVTVSS | 196 | STYCTYDMH | 202 | AIDSDGTTRYADSVKG | 954 | VCVVGSRWSDY | 942 | FTFSHSGMS | 946 | TINSGGASTYYTDSVKG | 231 | GGSGYGDASRMTSP |

TABLE 1A-continued

| Name | SEQ ID NO: | Sequence of dual VHH dimer | SEQ ID NO: | CDR1 | SEQ ID NO: | CDR2 | SEQ ID NO: | CDR3 | SEQ ID NO: | CDR4 | SEQ ID NO: | CDR5 | SEQ ID NO: | CDR6 |
|---|---|---|---|---|---|---|---|---|---|---|---|---|---|---|
| DR594-hIL27Ra-VHH20 | 887 | QVQLQESGGGSVQAGGSL RLSCVASASTYCTYDMHW YRQAPGKGREFVSAIDSD GTTRYADSVKGRFTISQG TAKNTVYLQMNSLQPEDT AMYYCKTVCVVGSRWSDY WGQGTQVTVSSGGSGGSG GSGQVQLQESGGGLVQPG GSLRLSCAASGFTFSSYP MSWVRQAPGKGLEWVSTI SSGGDTTLYADSVKGRFT SSRDNAKNTLYLQLNSLK TEDTAMYYCAKRIDCNSG YCYKRSYWGQGTQVTVSS | 196 | STYCTYDMH | 202 | AIDSDGTTRYADSVKG | 954 | VCVVGSRWSDY | 942 | FTFSHSGMS | 946 | TINSGGASTYYTDSVKG | 231 | GGSGYGDASRMTSP |
| DR594-hIL27Ra-VHH21 | 888 | QVQLQESGGGSVQAGGSL RLSCVASASTYCTYDMHW YRQAPGKGREFVSAIDSD GTTRYADSVKGRFTISQG TAKNTVYLQMNSLQPEDT AMYYCKTVCVVGSRWSDY WGQGTQVTVSSGGSGGSG GSGQVQLQESGGGLVQPG GSLRLSCAASGFTFSLSS MSWVRQAPGKGLEWVSAI SSGGASTYYTDSVKGRFT ISRDNAKNMLYLQLNSLK TEDTAMYYCAKGGSGYGD ASRMTSPGSQGTQVTVSS | 196 | STYCTYDMH | 202 | AIDSDGTTRYADSVKG | 954 | VCVVGSRWSDY | 942 | FTFSHSGMS | 946 | TINSGGASTYYTDSVKG | 231 | GGSGYGDASRMTSP |
| DR594-hIL27Ra-VHH22 | 889 | QVQLQESGGGSVQAGGSL RLSCVASASTYCTYDMHW YRQAPGKGREFVSAIDSD GTTRYADSVKGRFTISQG TAKNTVYLQMNSLQPEDT AMYYCKTVCVVGSRWSDY WGQGTQVTVSSGGSGGSG GSGQVQLQESGGGSVQAG GSLRLSCRASGSTYSNYC LGWFRQTTGKEREGVAVI NWVGGMLYFADSVKGRFT VSQDQAKNTVYLQMNSLK PEDTAMYYCAAESVSSFS CGGWLTRPDRVPYWGQGT QVTVSS | 196 | STYCTYDMH | 202 | AIDSDGTTRYADSVKG | 954 | VCVVGSRWSDY | 942 | FTFSHSGMS | 946 | TINSGGASTYYTDSVKG | 231 | GGSGYGDASRMTSP |
| DR594-hIL27Ra-VHH23 | 890 | QVQLQESGGGSVQAGGSL RLSCVASASTYCTYDMHW YRQAPGKGREFVSAIDSD GTTRYADSVKGRFTISQG TAKNTVYLQMNSLQPEDT AMYYCKTVCVVGSRWSDY WGQGTQVTVSSGGSGGSG GSGQVQLQESGGGSVQAG GSLRLSCRASRSPYGNYC LGWFRQSTGKEREGVAVI NWVGGMLYFADSVKGRFT VSQDHAKNTVTLQMNSLK PEDTAMYYCAAESVSSFS CGGWLTRPDRVPYWGQGT QVTVSS | 196 | STYCTYDMH | 202 | AIDSDGTTRYADSVKG | 954 | VCVVGSRWSDY | 942 | FTFSHSGMS | 946 | TINSGGASTYYTDSVKG | 231 | GGSGYGDASRMTSP |
| DR594-hIL27Ra-VHH24 | 891 | QVQLQESGGGSVQAGGSL RLSCVASASTYCTYDMHW YRQAPGKGREFVSAIDSD GTTRYADSVKGRFTISQG TAKNTVYLQMNSLQPEDT AMYYCKTVCVVGSRWSDY WGQGTQVTVSSGGSGGSG GSGQVQLQESGGGLVQPG GSLRLSCAASGFTFSHSG MSWVRQAPGKGLEWVSTI NSGGASTYYTDSVKGRFT ISRDNAKNMLYLQLNSLK TEDTAMYYCAKGGSGYGD ASRMTSPGSQGTQVTVSS | 196 | STYCTYDMH | 202 | AIDSDGTTRYADSVKG | 954 | VCVVGSRWSDY | 942 | FTFSHSGMS | 946 | TINSGGASTYYTDSVKG | 231 | GGSGYGDASRMTSP |

TABLE 1A-continued

| Name | SEQ ID NO: | Sequence of dual VHH dimer | SEQ ID NO: | CDR1 | SEQ ID NO: | CDR2 | SEQ ID NO: | CDR3 | SEQ ID NO: | CDR4 | SEQ ID NO: | CDR5 | SEQ ID NO: | CDR6 |
|---|---|---|---|---|---|---|---|---|---|---|---|---|---|---|
| DR595-hIL27Ra-VHH1 | 892 | QVQLQESGGGSVQAGGSL TLSCAASEYAYSTCNMGW YRQAPGKERELVSAFISD GSTYYADSVKGRFTITRD NAKNTVYLQMNSLKPEDT AIYYCSANCYRRLNYWG QGTQVTVSSGGSGGSGGS GQVQLQESGGGLVQPGGS LRLSCAASGFTFSSYPMS WVRQAPGKGLEWISTISA GGDTTLYADSVKGRFTSS RDNAKNTLYLQLNSLKTE DAAIYYCAKRIDCNSGYC YRRNYWGQGTQVTVSS | 197 | YAYSTCNMG | 203 | AFISDGSTYYADSV KG | 209 | NCYRRLRNY | 942 | FTFSHSGMS | 946 | TINSGGASTYYTDSVKG | 231 | GGSGYGDASRMTSP |
| DR595-hIL27Ra-VHH2 | 893 | QVQLQESGGGSVQAGGSL TLSCAASEYAYSTCNMGW YRQAPGKERELVSAFISD GSTYYADSVKGRFTITRD NAKNTVYLQMNSLKPEDT AIYYCSANCYRRLNYWG QGTQVTVSSGGSGGSGGS GQVQLQESGGGLVQPGGS LRLSCAASGFTFSLSGMS WVRQAPGKGLEWVSAISS GGASTYYTDSVKGRFTIS RDNAKNILYLQLNSLKTE DTAMYYCAKGGSYGDAS RMTSPGSQGTQVTVSS | 197 | YAYSTCNMG | 203 | AFISDGSTYYADSV KG | 209 | NCYRRLRNY | 942 | FTFSHSGMS | 946 | TINSGGASTYYTDSVKG | 231 | GGSGYGDASRMTSP |
| DR595-hIL27Ra-VHH3 | 894 | QVQLQESGGGSVQAGGSL TLSCAASEYAYSTCNMGW YRQAPGKERELVSAFISD GSTYYADSVKGRFTITRD NAKNTVYLQMNSLKPEDT AIYYCSANCYRRLNYWG QGTQVTVSSGGSGGSGGS GQVQLQESGGGSVQAGGS LRLSCVASGYVSCDYFLP SWYRQAPGKEREFVSIID GTGSTSYAASVKGRFTAS EDKGKNIAYLQMNSLKPE DTAMYYCKASCVRGRAVS EYWGQGTQVTVSS | 197 | YAYSTCNMG | 203 | AFISDGSTYYADSV KG | 209 | NCYRRLRNY | 942 | FTFSHSGMS | 946 | TINSGGASTYYTDSVKG | 231 | GGSGYGDASRMTSP |
| DR595-hIL27Ra-VHH4 | 895 | QVQLQESGGGSVQAGGSL TLSCAASEYAYSTCNMGW YRQAPGKERELVSAFISD GSTYYADSVKGRFTITRD NAKNTVYLQMNSLKPEDT AIYYCSANCYRRLNYWG QGTQVTVSSGGSGGSGGS GQVQLQESGGGLVQPGES LRLSCTASGFTFSNYAMS WVRQAPGKGLEWVSGINV AYGITSYADSVKGRFTIS RDNTKNTLYLQLNSLKTE DTAIYYCVKHSGTTIPRG FISYTKRGQGTQVTVSS | 197 | YAYSTCNMG | 203 | AFISDGSTYYADSV KG | 209 | NCYRRLRNY | 942 | FTFSHSGMS | 946 | TINSGGASTYYTDSVKG | 231 | GGSGYGDASRMTSP |
| DR595-hIL27Ra-VHH5 | 896 | QVQLQESGGGSVQAGGSL TLSCAASEYAYSTCNMGW YRQAPGKERELVSAFISD GSTYYADSVKGRFTITRD NAKNTVYLQMNSLKPEDT AIYYCSANCYRRLNYWG QGTQVTVSSGGSGGSGGS GQVQLQESGGGSVQAGGS LRLSCTASGYVSCDYFLP SWYRQAPGKEREFVSID GTGSTSYAASVKGRFTAS QDKGKNIAYLQMNSLKPE DTAMYYCKASCVRGRAIS EYWGQGTQVTVSS | 197 | YAYSTCNMG | 203 | AFISDGSTYYADSV KG | 209 | NCYRRLRAY | 942 | FTFSHSGMS | 946 | TINSGGASTYYTDSVKG | 231 | GGSGYGDASRMTSP |

TABLE 1A-continued

| Name | SEQ ID NO: | Sequence of dual VHH dimer | SEQ ID NO: | CDR1 | SEQ ID NO: | CDR2 | SEQ ID NO: | CDR3 | SEQ ID NO: | CDR4 | SEQ ID NO: | CDR5 | SEQ ID NO: | CDR6 |
|---|---|---|---|---|---|---|---|---|---|---|---|---|---|---|
| DR595-hIL27Ra-VHH6 | 897 | QVQLQESGGGSVQAGGSLTLSCAASEYAYSTCNMGWYRQAPGKERELVSAFISDGSTYYADSVKGRFTITRDNAKNTVYLQMNSLKPEDTAIYYCSANCYRRLRNYWGQGTQVTVSSGGSGGSGGSGGVQLQESGGGLVQPGGSLRLSCAASGFSFSSYAMKWVRQAPGKGLEWVSTISSGGSSTNYADSVKGRFTISRDNAKNTLYLQLNSLKIEDTAMYYCAKAIVPTGATMERGQGTQVTVSS | 197 | YAYSTCNMG | 203 | AFISDGSTYYADSVKG | 209 | NCYRLRNYY | 942 | FTFSHSGMS | 946 | TINSGGASTYYTDSVKG | 231 | GGSGYGDASRMTSP |
| DR595-hIL27Ra-VHH7 | 898 | QVQLQESGGGSVQAGGSLTLSCAASEYAYSTCNMGWYRQAPGKERELVSAFISDGSTYYADSVKGRFTITRDNAKNTVYLQMNSLKPEDTAIYYCSANCYRRLRNYWGQGTQVTVSSGGSGGSGGSGGVQLQESGGGLVQPGGSLRLSCAASGFTFSSYPMSWVRQAPGKGLEWISTISAGGDTTLYADSVKGRFTSSRDNAKNTLYLQLNSLKTEDTAIYYCAKRIDCNSGYCYRRNYWGQGTQVTVSS | 197 | YAYSTCNMG | 203 | AFISDGSTYYADSVKG | 209 | NCYRLRNYY | 942 | FTFSHSGMS | 946 | TINSGGASTYYTDSVKG | 231 | GGSGYGDASRMTSP |
| DR595-hIL27Ra-VHH8 | 899 | QVQLQESGGGSVQAGGSLTLSCAASEYAYSTCNMGWYRQAPGKERELVSAFISDGSTYYADSVKGRFTITRDNAKNTVYLQMNSLKPEDTAIYYCSANCYRRLRNYWGQGTQVTVSSGGSGGSGGSGGVQLQESGGGSVQVGGSLRLSCAASGFTFSSYPMSWVRQAPGKGLEWISTISAGGDTTLYADSVKGRFTSSRDNAKNTLYLQLNSLKTEDTAIYYCAKRIDCNSGYCYRRNYWGQGTQVTVSS | 197 | YAYSTCNMG | 203 | AFISDGSTYYADSVKG | 209 | NCYRLRNYY | 942 | FTFSHSGMS | 946 | TINSGGASTYYTDSVKG | 231 | GGSGYGDASRMTSP |
| DR595-hIL27Ra-VHH9 | 900 | QVQLQESGGGSVQAGGSLTLSCAASEYAYSTCNMGWYRQAPGKERELVSAFISDGSTYYADSVKGRFTITRDNAKNTVYLQMNSLKPEDTAIYYCSANCYRRLRNYWGQGTQVTVSSGGSGGSGGSGGVQLQESGGGSVQSGGSLRLSCAASGFTYSTSNSWMAWFRQAPGKEREGVAAIYTVGGSIFYADSVRGRFTISQDATKNMFYLQMNTLKPEDTAMYYCAAASGRLRGKWFWPYEYNYWGQGTQVTVSS | 197 | YAYSTCNMG | 203 | AFISDGSTYYADSVKG | 209 | NCYRLRNYY | 942 | FTFSHSGMS | 946 | TINSGGASTYYTDSVKG | 231 | GGSGYGDASRMTSP |
| DR595-hIL27Ra-VHH10 | 901 | QVQLQESGGGSVQAGGSLTLSCAASEYAYSTCNMGWYRQAPGKERELVSAFISDGSTYYADSVKGRFTITRDNAKNTVYLQMNSLKPEDTAIYYCSANCYRRLRNYWGQGTQVTVSSGGSGGSGGSGGVQLQESGGGSVQAGGSLRLSCRASGSTYSNYCLGWERQITGKEREGVAVINWVGGMLYFADSVKGRFTVSQDQAKNTLYLQMNSLKPEDTAMYYCAAESVSSFSCGGWLTRPDRVPYWGQGTQVTVSS | 197 | YAYSTCNMG | 203 | AFISDGSTYYADSVKG | 209 | NCYRLRNYY | 942 | FTFSHSGMS | 946 | TINSGGASTYYTDSVKG | 231 | GGSGYGDASRMTSP |

TABLE 1A-continued

| Name | SEQ ID NO: | Sequence of dual VHH dimer | SEQ ID NO: | CDR1 | SEQ ID NO: | CDR2 | SEQ ID NO: | CDR3 | SEQ ID NO: | CDR4 | SEQ ID NO: | CDR5 | SEQ ID NO: | CDR6 |
|---|---|---|---|---|---|---|---|---|---|---|---|---|---|---|
| DR595-hIL27Ra-VHH11 | 902 | QVQLQESGGGSVQAGGSLTLSCAASEYAYSTCNMGWYRQAPGKERELVSAFISDGSTYYADSVKGRFTITRDNAKNTVYLQMNSLKPEDTAIYYCSANCYRRLNYWGQGTQVTVSSGGSGGSGGSGGQVQLQESGGGSVQAGGSLRLSCRASGSTYSNYCLGWFRQSTGKEREGVAVINWVGGMLYFADSVKGRFTVSQDHAKNTVTLQMNSLKPEDTAMYYCAAESVSSFSCGGWLTRPGRVPYWGQGTQVTVSS | 197 | YAYSTCNMG | 203 | AFIDGSTYYADSVKG | 209 | NCYRLRNY | 942 | FTFSHSGMS | 946 | TINSGGASTYYTDSVKG | 231 | GGSGYGDASRMTSP |
| DR595-hIL27Ra-VHH12 | 903 | QVQLQESGGGSVQAGGSLTLSCAASEYAYSTCNMGWYRQAPGKERELVSAFISDGSTYYADSVKGRFTITRDNAKNTVYLQMNSLKPEDTAIYYCSANCYRRLNYWGQGTQVTVSSGGSGGSGGSGGQVQLQESGGGSVQAGESLRLSCRASGSTYSNYCLGWERQITGKEREGVAVINWVGGMLYFADSVKGRFTVSQDQAKNTVYLEMNSLKPEDTAMYYCATESVSSFSCGGWLTRPDRVPYWGQGTQVTVSS | 197 | YAYSTCNMG | 203 | AFIDGSTYYADSVKG | 209 | NCYRLRNY | 942 | FTFSHSGMS | 946 | TINSGGASTYYTDSVKG | 231 | GGSGYGDASRMTSP |
| DR595-hIL27Ra-VHH13 | 904 | QVQLQESGGGSVQAGGSLTLSCAASEYAYSTCNMGWYRQAPGKERELVSAFISDGSTYYADSVKGRFTITRDNAKNTVYLQMNSLKPEDTAIYYCSANCYRRLNYWGQGTQVTVSSGGSGGSGGSGGQVQLQESGGGSVQAGGSLRLSCVASGYVSCDYFLPSWYRQAPGKEREFVSIIDGTGSTSYAASVKGRFTASQDRGKNIAYLQMNSLKPEDTAMYYCKASCVRGRTISEYWGQGTQVTVSS | 197 | YAYSTCNMG | 203 | AFIDGSTYYADSVKG | 209 | NCYRLRNY | 942 | FTFSHSGMS | 946 | TINSGGASTYYTDSVKG | 231 | GGSGYGDASRMTSP |
| DR595-hIL27Ra-VHH14 | 905 | QVQLQESGGGSVQAGGSLTLSCAASEYAYSTCNMGWYRQAPGKERELVSAFISDGSTYYADSVKGRFTITRDNAKNTVYLQMNSLKPEDTAIYYCSANCYRRLNYWGQGTQVTVSSGGSGGSGGSGGQVQLQESGGGSVQAGGSLRLSCVASGYVSCDYFLPSWYRQAPGKEREFVSIIDGTGSTSYAASVKGRFTASQDKGKNIAYLQMNSLKPEDTAMYYCKASCVRGRAISEYWGQGTQVTVSS | 197 | YAYSTCNMG | 203 | AFIDGSTYYADSVKG | 209 | NCYRLRNY | 942 | FTFSHSGMS | 946 | TINSGGASTYYTDSVKG | 231 | GGSGYGDASRMTSP |
| DR595-hIL27Ra-VHH15 | 906 | QVQLQESGGGSVQAGGSLTLSCAASEYAYSTCNMGWYRQAPGKERELVSAFISDGSTYYADSVKGRFTITRDNAKNTVYLQMNSLKPEDTAIYYCSANCYRRLNYWGQGTQVTVSSGGSGGSGGSGGQVQLQESGGGSVQAGGSLRLSCVASGYVSCDYFLPSWYRQAPGKEREFVSIIDGTGSTSYAASVKGRFTASQDKGKNIAYLQMNTLKPEDTAMYYCKASCVRGRAISEYWGQGTQVTVSS | 197 | YAYSTCNMG | 203 | AFIDGSTYYADSVKG | 209 | NCYRLRNY | 942 | FTFSHSGMS | 946 | TINSGGASTYYTDSVKG | 231 | GGSGYGDASRMTSP |

TABLE 1A-continued

| Name | SEQ ID NO: | Sequence of dual VHH dimer | SEQ ID NO: | CDR1 | SEQ ID NO: | CDR2 | SEQ ID NO: | CDR3 | SEQ ID NO: | CDR4 | SEQ ID NO: | CDR5 | SEQ ID NO: | CDR6 |
|---|---|---|---|---|---|---|---|---|---|---|---|---|---|---|
| DR595-hIL27Ra-VHH16 | 907 | QVQLQESGGGSVQAGGSLTLSCAASEYAYSTCNMGWYRQAPGKERELVSAFISDGSTYYADSVKGRFTITRDNAKNTVYLQMNSLKPEDTAIYYCSANCYRRLRNYWGQGTQVTVSSGGSGGSGGSGGVQLQESGGGSVQAGGSLRLSCRASGSTYSNYCLGWERQITGKEREGVAVINWVGGMLYADSVKGRFTVSQDQAKNTVYLQMNSLKPEDTAMYYCAAESASSFSCGGWLTRPDRVPYWGQGTQVTVSS | 197 | YAYSTCNMG | 203 | AFISDGSTYYADSVKG | 209 | NCYRLRNY | 942 | FTFSHSGMS | 946 | TINSGGASTYYTDSVKG | 231 | GGSGYGDASRMTSP |
| DR595-hI27Ra-VHH17 | 908 | QVQLQESGGGSVQAGGSLTLSCAASEYAYSTCNMGWYRQAPGKERELVSAFISDGSTYYADSVKGRFTITRDNAKNTVYLQMNSLKPEDTAIYYCSANCYRRLRNYWGQGTQVTVSSGGSGGSGGSGGVQLQESGGGLVQPGGSLRLSCAASGFTFSLSGMSWVRQAPGKGLEWVSAISSGGASTYYTDSVKGRFTISRDNAKNMLYLQLNSLKTEDTAMYYCAKGGSGYGDASRMTSPGSQGTQVTVSS | 719 | YAYSTCNMG | 203 | AFISDGSTYYADSVKG | 209 | NCYRLRNY | 942 | FTFSHSGMS | 946 | TINSGGASTYYTDSVKG | 231 | GGSGYGDASRMTSP |
| DR595-hIL27Ra-VHH18 | 909 | QVQLQESGGGSVQAGGSLTLSCAASEYAYSTCNMGWYRQAPGKERELVSAFISDGSTYYADSVKGRFTITRDNAKNTVYLQMNSLKPEDTAIYYCSANCYRRLRNYWGQGTQVTVSSGGSGGSGGSGGVQLQESGGGSVQAGGSLRLSCVASGYVSCDYFLPSWYRQAPGKEREFVSIIDGTGSTSYAASVKGRFTASQDKGKNIAYLQMNSLKPEDTAMYYCKASCVRGRGISEYWGQGTQVTVSS | 197 | YAYSTCNMG | 203 | AFISDGSTYYADSVKG | 209 | NCYRIRNY | 942 | FTFSHSGMS | 946 | TINSGGASTYYTDSVKG | 231 | GGSGYGDASRMTSP |
| DR595-hIL27Ra-VHH19 | 910 | QVQLQESGGGSVQAGGSLTLSCAASEYAYSTCNMGWYRQAPGKERELVSAFISDGSTYYADSVKGRFTITRDNAKNTVYLQMNSLKPEDTAIYYCSANCYRRLRNYWGQGTQVTVSSGGSGGSGGSGGVQLQESGGGSVQAGGSLRLSCRASGSTYSNYCLGWFRQITGKEREGVAVINWVGGMLYADSVKGRFTVSQDQAKNTVYLQMNSLKPEDTAMYYCAAESVSSFSCGGWLTRPDRVPYWGQGTQVTVSS | 197 | YAYSTCNMG | 203 | AFISDGSTYYADSVKG | 209 | NCYRLRNY | 942 | FTFSHSGMS | 946 | TINSGGASTYYTDSVKG | 231 | GGSGYGDASRMTSP |
| DR595-hIL27Ra-VHH20 | 911 | QVQLQESGGGSVQAGGSLTLSCAASEYAYSTCNMGWYRQAPGKERELVSAFISDGSTYYADSVKGRFTITRDNAKNTVYLQMNSLKPEDTAIYYCSANCYRRLRNYWGQGTQVTVSSGGSGGSGGSGGVQLQESGGGLVQPGGSLRLSCAASGFTFSSYPMSWVRQAPGKGLEWVSTISSGGDTTLYADSVKGRFTSSRDNAKNTLYLQLNSLKTEDTAMYYCAKRIDCNSGYCYKRSYWGQGTQVTVSS | 197 | YAYSTCNMG | 203 | AFISDGSTYYADSVKG | 209 | NCYRLRNY | 942 | FTFSHSGMS | 946 | TINSGGASTYYTDSVKG | 231 | GGSGYGDASRMTSP |

TABLE 1A-continued

| Name | SEQ ID NO: | Sequence of dual VHH dimer | SEQ ID NO: | CDR1 | SEQ ID NO: | CDR2 | SEQ ID NO: | CDR3 | SEQ ID NO: | CDR4 | SEQ ID NO: | CDR5 | SEQ ID NO: | CDR6 |
|---|---|---|---|---|---|---|---|---|---|---|---|---|---|---|
| DR595-hIL27Ra-VHH21 | 912 | QVQLQESGGGSVQAGGSLTLSCAASEYAYSTCNMGWYRQAPGKERELVSAFISDGSTYYADSVKGRFTITRDNAKNTVYLQMNSLKPEDTAIYYCSANCYRRLNYWGQGTQVTVSSGGSGGSGGSGGVQLQESGGGLVQPGGSLRLSCAASGFTFSLSSMSWVRQAPGKGLEWVSAISSGGASTYYTDSVKGRFTISRDNAKNMLYLQLNSLKTEDTAMYYCAKGGSGYGDASRMTSPGSQGTQVTVSS | 197 | YAYSTCNMG | 203 | AFISDGSTYYADSVKG | 209 | NCYRRLRNY | 942 | FTFSHSGMS | 946 | TINSGGASTYYTDSVKG | 231 | GGSGYGDASRMTSP |
| DR5L95-hIL27Ra-VHH22 | 913 | QVQLQESGGGSVQAGGSLTLSCAASEYAYSTCNMGWYRQAPGKERELVSAFISDGSTYYADSVKGRFTITRDNAKNTVYLQMNSLKPEDTAIYYCSANCYRRLNYWGQGTQVTVSSGGSGGSGGSGGVQLQESGGGSVQAGGSLRLSCRASGSTYSNYCLGWFRQTTGKEREGVAVINWVGGMLYFADSVKGRFTVSQDQAKNTVYLQMNSLKPEDTAMYYCAAESVSSFSCGWLTRPDRVPYWGQGTQVTVSS | 197 | YAYSTCNMG | 203 | AFISDGSTYYADSVKG | 209 | NCYRRLRNY | 942 | FTFSHSGMS | 946 | TINSGGASTYYTDSVKG | 231 | GGSGYGDASRMTSP |
| DR595-hIL27Ra-VHH23 | 914 | QVQLQESGGGSVQAGGSLTLSCAASEYAYSTCNMGWYRQAPGKERELVSAFISDGSTYYADSVKGRFTITRDNAKNTVYLQMNSLKPEDTAIYYCSANCYRRLNYWGQGTQVTVSSGGSGGSGGSGGVQLQESGGGSVQAGGSLRLSCRASRSPYGNYCLGWFRQSTGKEREGVAVINWVGGMLYFADSVKGRFTVSQDHAKNTVTLQMNSLKPEDTAMYYCAAESVSSFSCGWLTRPDRVPYWGQGTQVTVSS | 197 | YAYSTCNMG | 203 | AFISDGSTYYADSVKG | 209 | NCYRRLRNY | 942 | FTFSHSGMS | 946 | TINSGGASTYYTDSVKG | 231 | GGSGYGDASRMTSP |
| DR595-hIL27Ra-VHH24 | 915 | QVQLQESGGGSVQAGGSLTLSCAASEYAYSTCNMGWYRQAPGKERELVSAFISDGSTYYADSVKGRFTITRDNAKNTVYLQMNSLKPEDTAIYYCSANCYRRLNYWGQGTQVTVSSGGSGGSGGSGGVQLQESGGGLVQPGGSLRLSCAASGFTFSHSGMSWVRQAPGKGLEWVSTINSGGASTYYTDSVKGRFTISRDNAKNMLYLQLNSLKTEDTAMYYCAKGGSGYGDASRMTSPGSQGTQVTVSS | 197 | YAYSTCNMG | 203 | AFISDGSTYYADSVKG | 209 | NCYRRLRNY | 942 | FTFSHSGMS | 964 | TINSGGASTYYTDSVKG | 231 | GGSGYGDASRMTSP |
| DR596-hIL27Ra-VHH1 | 916 | QVQLQESGGGLVQPGGSLRLSCTASGLTFDDSMGWFRQAPGKGREAVSCISSSGANAFYADSVKGRFTISRDNAKNTLYLQMNSLKPEDTATYYCKRGHACAGYYPIPYDDYWGQGTQVTVSSGGSGGSGGSGGVQLQESGGGLVQPGGSLRLSCAASGFTFSSYPMSWVRQAPGKGLEWISTISAGGDTTLYADSVKGRFTSSRDNAKNTLYLQLNSLKTEDAAIYYCAKRI | 198 | LTFDDSMG | 204 | CISSSGANAFYADSV | 210 | GHACAGYYPIPYDDY | 942 | FTFSHSGMS | 946 | TINSGGASTYYTDSVKG | 231 | GGSGYGDASRMTSP |

TABLE 1A-continued

| Name | SEQ ID NO: | Sequence of dual VHH dimer | SEQ ID NO: CDR1 | CDR1 | SEQ ID NO: CDR2 | CDR2 | SEQ ID NO: CDR3 | CDR3 | SEQ ID NO: CDR4 | CDR4 | SEQ ID NO: CDR5 | CDR5 | SEQ ID NO: CDR6 | CDR6 |
|---|---|---|---|---|---|---|---|---|---|---|---|---|---|---|
| | | DCNSGYCYRRNYWGQGTQVTVSS | | | | | | | | | | | | |
| DR596-hIL27Ra-VHH2 | 917 | QVQLQESGGGLVQPGGSLRLSCTASGLTFDDSVMGWFRQAPGKGREAVSCISSSGANAFYADSVKGRFTISRDNAKNTLYLQMNSLKPEDTATYYCKRGHACAGYYPIPYDDYWGQGTQVTVSSGGSGGSGGSGQVQLQESGGGLVQPGGSLRLSCAASGFTFSLSGMSWVRQAPGKGLEWVSAISSGGASTYYTDSVKGRFTISRDNAKNILYLQLNSLKTEDTAMYYCAKGGSGYGDASRMTSPGSQGTQVTVSS | 198 | LTFDDSVMG | 204 | CISSSGANAFYADSV | 210 | GHACAGYYPIPYDDY | 942 | FTFSHSGMS | 946 | TINSGGASTYYTDSVKG | 231 | GGSGYGDASRMTSPSP |
| DR596-hIL27Ra-VHH3 | 918 | QVQLQESGGGLVQPGGSLRLSCTASGLTFDDSVMGWFRQAPGKGREAVSCISSSGANAFYADSVKGRFTISRDNAKNTLYLQMNSLKPEDTATYYCKRGHACAGYYPIPYDDYWGQGTQVTVSSGGSGGSGGSGQVQLQESGGGSVQAGGSLRLSCVASGYVSCDYFLPSWYRQAPGKEREFVSIIDGTGSTSYAASVKGRFTASEDKGKNIAYLQMNSLKPEDTAMYYCKASCVRGRAVSEYWGQGTQVTVSS | 198 | LTFDDSVMG | 204 | CISSSGANAFYADSV | 210 | GHACAGYYPIPYDDY | 942 | FTFSHSGMS | 946 | TINSGGASTYYTDSVKG | 231 | GGSGYGDASRMTSPSP |
| DR596-hIL27Ra-VHH4 | 919 | QVQLQESGGGLVQPGGSLRLSCTASGLTFDDSVMGWFRQAPGKGREAVSCISSSGANAFYADSVKGRFTISRDNAKNTLYLQMNSLKPEDTATYYCKRGHACAGYYPIPYDDYWGQGTQVTVSSGGSGGSGGSGQVQLQESGGGLVQPGESLRLSCTASGFTFSNYAMSWVRQAPGKGLEWVSGINVAYGITSYADSVKGRFTISRDNTKNTLYLQLNSLKTEDTAIYYCVKHSGTTIPRGFISYTKRGQGTQVTVSS | 198 | LTFDDSVMG | 204 | CISSSGANAFYADSV | 210 | GHACAGYYPIPYDDY | 942 | FTFSHSGMS | 946 | TINSGGASTYYTDSVKG | 231 | GGSGYGDASRMTSPSP |
| DR596-hIL27Ra-VHH5 | 920 | QVQLQESGGGLVQPGGSLRLSCTASGLTFDDSVMGWFRQAPGKGREAVSCISSSGANAFYADSVKGRFTISRDNAKNTLYLQMNSLKPEDTATYYCKRGHACAGYYPIPYDDYWGQGTQVTVSSGGSGGSGGSGQVQLQESGGGSVQAGGSLRLSCTASGYVSCDYFLPSWYRQAPGKEREFVSVIDGTGSTSYAASVKGRFTASQDKGKNIAYLQMNSLKPEDTAMYYCKASCVRGRAISEYWGQGTQVTVSS | 198 | LTFDDSVMG | 204 | CISSSGANAFYADSV | 210 | GHACAGYYPIPYDDY | 942 | FTFSHSGMS | 946 | TINSGGASTYYTDSVKG | 231 | GGSGYGDASRMTSPSP |
| DR596-hIL27Ra-VHH6 | 921 | QVQLQESGGGLVQPGGSLRLSCTASGLTFDDSVMGWFRQAPGKGREAVSCISSSGANAFYADSVKGRFTISRDNAKNTLYLQMNSLKPEDTATYYCKRGHACAGYYPIPYDDYWGQGTQVTVSSGGSGGSGGSGQVQLQESGGGLVQPGGSLRLSCAASGFS | 198 | LTFDDSVMG | 204 | CISSSGANAFYADSV | 210 | GHACAGYYPIPYDDY | 942 | FTFSHSGMS | 946 | TINSGGASTYYTDSVKG | 231 | GGSGYGDASRMTSPSP |

TABLE 1A-continued

| Name | SEQ ID NO: | Sequence of dual VHH dimer | SEQ ID NO: | CDR1 | SEQ ID NO: | CDR2 | SEQ ID NO: | CDR3 | SEQ ID NO: | CDR4 | SEQ ID NO: | CDR5 | SEQ ID NO: | CDR6 |
|---|---|---|---|---|---|---|---|---|---|---|---|---|---|---|
| | | FSSYAMKWVRQAPGKGLE WVSTISSGGSSTNYADSV KGRFTISRDNAKNTLYLQ LNSLKIEDTAMYYCAKAI VPTGATMERGQGTQVTVS S | | | | | | | | | | | | |
| DR596-hIL27Ra-VHH7 | 922 | QVQLQESGGGLVQPGGSL RLSCTASGLTFDDSVMGW FRQAPGKGREAVSCISSS GANAFYADSVKGRFTISR DNAKNTLYLQMNSLKPED TATYYCKRGHACAGYYPI PYDDYWGQGTQVTVSSGG SGGSGGSGQVQLQESGGG LVQPGGSLRLSCAASGFT FSSYPMSWVRQAPGKGLE WISTISAGGDTTLYADSV KGRFTSSRDNAKNTLYLQ LNSLKTEDTAIYYCAKRI DCNSGYCYRRNYWGQGTQ VTVSS | 198 | LTFDDSVMG | 204 | CISSSGANAFYADSVKG | 210 | GHACAGYYPIPYDDY | 942 | FTFSSYPMS | 946 | TISAGGDTTLYADSVKG | 231 | GGSGYGDASRMTSP |
| DR596-hIL27Ra-VHH8 | 923 | QVQLQESGGGLVQPGGSL RLSCTASGLTFDDSVMGW FRQAPGKGREAVSCISSS GANAFYADSVKGRFTISR DNAKNTLYLQMNSLKPED TATYYCKRGHACAGYYPI PYDDYWGQGTQVTVSSGG SGGSGGSGQVQLQESGGG SVQVGGSLRLSCAASGFT FSSYPMSWVRQAPGKGLE WISTISAGGDTTLYADSV KGRFTSSRDNAKNTLYLQ LNSLKTEDTAIYYCAKRI DCNSGYCYRRNYWGQGTQ VTVSS | 198 | LTFDDSVMG | 204 | CISSSGANAFYADSVKG | 210 | GHACAGYYPIPYDDY | 942 | FTFSSYPMS | 946 | TISAGGDTTLYADSVKG | 231 | GGSGYGDASRMTSP |
| DR596-hIL27Ra-VHH9 | 924 | QVQLQESGGGLVQPGGSL RLSCTASGLTFDDSVMGW FRQAPGKGREAVSCISSS GANAFYADSVKGRFTISR DNAKNTLYLQMNSLKPED TATYYCKRGHACAGYYPI PYDDYWGQGTQVTVSSGG SGGSGGSGQVQLQESGGG SVQSGGSLRLSCAASGFT YSTSNSWMAWFRQAPGKE REGVAAIYTVGGSIFYAD SVRGRFTISQDATKNMFY LQMNTLKPEDTAMYYCAA ASGRLRGKWFWPYEYNYW GQGTQVTVSS | 198 | LTFDDSVMG | 204 | CISSSGANAFYADSVKG | 210 | GHACAGYYPIPYDDY | 942 | FTFSSYPMS | 946 | TISAGGDTTLYADSVKG | 231 | GGSGYGDASRMTSP |
| DR596-hIL27Ra-VHH10 | 925 | QVQLQESGGGLVQPGGSL RLSCTASGLTFDDSVMGW FRQAPGKGREAVSCISSS GANAFYADSVKGRFTISR DNAKNTLYLQMNSLKPED TATYYCKRGHACAGYYPI PYDDYWGQGTQVTVSSGG SGGSGGSGQVQLQESGGG SVQAGGSLRLSCRASGST YSNYCLGWFRQITGKERE GVAVINWVGGMLYFADSV KGRFTVSQDQAKNTLYLQ MNSLKPEDTAMYYCAAES VSSFSCGGWLTRPDRVPY WGQGTQVTVSS | 198 | LTFDDSVMG | 204 | CISSSGANAFYADSVKG | 210 | GHACAGYYPIPYDDY | 942 | FTFSSYPMS | 946 | TISAGGDTTLYADSVKG | 231 | GGSGYGDASRMTSP |
| DR596-hIL27Ra-VHH11 | 926 | QVQLQESGGGLVQPGGSL RLSCTASGLTFDDSVMGW FRQAPGKGREAVSCISSS GANAFYADSVKGRFTISR DNAKNTLYLQMNSLKPED | 198 | LTFDDSVMG | 204 | CISSSGANAFYADSVKG | 210 | GHACAGYYPI | 942 | FTFSSYPMS | 946 | TISAGGDTTLYADSVKG | 231 | GGSGYGDASR |

TABLE 1A-continued

| Name | SEQ ID NO: | Sequence of dual VHH dimer | SEQ ID NO: | CDR1 | SEQ ID NO: | CDR2 | SEQ ID NO: | CDR3 | SEQ ID NO: | CDR4 | SEQ ID NO: | CDR5 | SEQ ID NO: | CDR6 |
|---|---|---|---|---|---|---|---|---|---|---|---|---|---|---|
| | | TATYYCKRGHACAGYYPI PYDDYWGQGTQVTSSGG SGGSGGSGQVQLQESGGG SVQAGGSLRLSCRASGST YSNYCLGWFRQSTGKERE GVAVINWVGGMLYFADSV KGRFTVSQDHAKNTVTLQ MNSLKPEDTAMYYCAAES VSSFSCGGWLTRPGRVPY WGQGTQVTVSS | | S V M G | | YA DS VK G | | PY DD Y | | | | KG | | MT SP |
| DR596-hIL27Ra-VHH12 | 927 | QVQLQESGGGLVQPGGSL RLSCTASGLTFDDSVMGW FRQAPGKGREAVSCISSS GANAFYADSVKGRFTISR DNAKNTLYLQMNSLKPED TATYYCKRGHACAGYYPI PYDDYWGQGTQVTVSSGG SGGSGGSGQVQLQESGGG SVQAGESLRLSCRASGST YSNYCLGWFRQITGKERE GVAVINWVGGMLYFADSV KGRFTVSQDQAKNTVYLE MNSLKPEDTAMYYCATES VSSFSCGGWLTRPDRVPY WGQGTQVTVSS | 198 | L T F D D S V M G | 204 | CI SS SG AN AF YA DS VI G | 210 | GH AC AG YY PI PY DD Y | 942 | FTF SHS GMS | 946 | TIN SGG AST YYT DSV KG | 231 | GG SG YG DA SR MT SP |
| DR596-hIL27Ra-VHH13 | 928 | QVQLQESGGGLVQPGGSL RLSCTASGLTFDDSVMGW FRQAPGKGREAVSCISSS GANAFYADSVKGRFTISR DNAKNTLYLQMNSLKPED TATYYCKRGHACAGYYPI PYDDYWGQGTQVTVSSGG SGGSGGSGQVQLQESGGG SVQAGGSLRLSCVASGYV SCDYFLPSWYRQAPGKER EFVSIIDGTGSTSYAASV KGRFTASQDRGKNIAYLQ MNSLKPEDTAMYYCKASC VRGRTISEYWGQGTQVTV SS | 198 | L T F D D S V M G | 204 | CI SS SG AN AF YA DS VK G | 210 | GH AC AG YY PI PY DD Y | 942 | FTF SHS GMS | 946 | TIN SGG AST YYT DSV KG | 231 | GG SG YG DA SR MT SP |
| DR596-hIL27Ra-VHH14 | 929 | QVQLQESGGGLVQPGGSL RLSCTASGLTFDDSVMGW FRQAPGKGREAVSCISSS GANAFYADSVKGRFTISR DNAKNTLYLQMNSLKPED TATYYCKRGHACAGYYPI PYDDYWGQGTQVTVSSGG SGGSGGSGQVQLQESGGG SVQAGGSLRLSCVASGYV SCDYFLPSWYRQAPGKER EFVSIIDGTGSTSYAASV KGRFTASQDKGKNIAYLQ MNSLKPEDTAMYYCKASC VRGRAISEYWGQGTQVTV SS | 198 | L T F D D S V M G | 204 | CI SS SG AN AF YA DS VK G | 210 | GH AC AG YY PI PY DD Y | 942 | FTF SHS GMS | 946 | TIN SGG AST YYT DSV KG | 231 | GG SG YG DA SR MT SP |
| DR596-hIL27Ra-VHH15 | 930 | QVQLQESGGGLVQPGGSL RLSCTASGLTFDDSVMGW FRQAPGKGREAVSCISSS GANAFYADSVKGRFTISR DNAKNTLYLQMNSLKPED TATYYCKRGHACAGYYPI PYDDYWGQGTQVTVSSGG SGGSGGSGQVQLQESGGG SVQAGGSLRLSCVASGYV SCDYFLPSWYRQAPGKER EFVSIIDGTGSTSYAASV KGRFTASQDKGKNIAYLQ MNTLKPEDTAMYYCKASC VRGRAISEYWGQGTQVTV SS | 198 | L T F D D S V M G | 204 | CI SS SG AN AF YA DS VK G | 210 | GH AC AG YY PI PY DD Y | 942 | FTF SHS GMS | 946 | TIN SGG AST YYT DSV KG | 231 | GG SG YG DA SR MT SP |

TABLE 1A-continued

| Name | SEQ ID NO: | Sequence of dual VHH dimer | SEQ ID NO: | CDR1 | SEQ ID NO: | CDR2 | SEQ ID NO: | CDR3 | SEQ ID NO: | CDR4 | SEQ ID NO: | CDR5 | SEQ ID NO: | CDR6 |
|---|---|---|---|---|---|---|---|---|---|---|---|---|---|---|
| DR596-hIL27Ra-VHH16 | 931 | QVQLQESGGGLVQPGGSL RLSCTASGLTFDDSVMGW FRQAPGKGREAVSCISSS GANAFYADSVKGRFTISR DNAKNTLYLQMNSLKPED TATYYCKRGHACAGYYPI PYDDYWGQGTQVTVSSGG SGGSGGSGQVQLQESGGG SVQAGGSLRLSCRASGST YSNYCLGWFRQITGKERE GVAVINWVGGMLYFADSV KGRFTVSQDQAKNTVYLQ MNSLKPEDTAMYYCAAES ASSFSCGGWLTRPDRVPY WGQGTQVTVSS | 198 | LTFDDSVMG | 204 | CISSSGANAFYADSVKG | 210 | GHACAGYYPIPYDDY | 942 | FTFSHSGMS | 946 | TINSGGASTYYTDSVKG | 231 | GGSGYGDASRMTSP |
| DR596-hIL27Ra-VHH17 | 932 | QVQLQESGGGLVQPGGSL RLSCTASGLTFDDSVMGW FRQAPGKGREAVSCISSS GANAFYADSVKGRFTISR DNAKNTLYLQMNSLKPED TATYYCKRGHACAGYYPI PYDDYWGQGTQVTVSSGG SGGSGGSGQVQLQESGGG LVQPGGSLRLSCAASGFT FSLSGMSWVRQAPGKGLE WVSAISSGGASTYYTDSV KGRFTISRDNAKNMLYLQ LNSLKTEDTAMYYCAKGG SGYGDASRMTSPGSQGTQ VTVSS | 198 | LTFDDSVMG | 204 | CISSSGANAFYADSVKG | 210 | GHACAGYYPIPYDDY | 942 | FTFSHSGMS | 946 | TINSGGASTYYTDSVKG | 231 | GGSGYGDASRMTSP |
| DR596-hIL27Ra-VHH18 | 933 | QVQLQESGGGLVQPGGSL RLSCTASGLTFDDSVMGW FRQAPGKGREAVSCISSS GANAFYADSVKGRFTISR DNAKNTLYLQMNSLKPED TATYYCKRGHACAGYYPI PYDDYWGQGTQVTVSSGG SGGSGGSGQVQLQESGGG SVQAGGSLRLSCVASGYV SCDYFLPSWYRQAPGKER EFVSIIDGTGSTSYAASV KGRFTASQDKGKNIAYLQ MNSLKPEDTAMYYCKASC VRGRGISEYWGQGTQVTV SS | 198 | LTFDDSVMG | 204 | CISSSGANAFYADSVKG | 210 | GHACAGYYPIPYDDY | 942 | FTFSHSGMS | 946 | TINSGGASTYYTDSVKG | 231 | GGSGYGDASRMTSP |
| DR596-hIL27Ra-VHH19 | 934 | QVQLQESGGGLVQPGGSL RLSCTASGLTFDDSVMGW FRQAPGKGREAVSCISSS GANAFYADSVKGRFTISR DNAKNTLYLQMNSLKPED TATYYCKRGHACAGYYPI PYDDYWGQGTQVTVSSGG SGGSGGSGQVQLQESGGG SVQAGGSLRLSCRASGST YSNYCLGWFRQITGKERE GVAVINWVGGMLYFADSV KGRFTVSQDQAKNTVYLQ MNSLKPEDTAMYYCAAES VSSFSCGGWLTRPDRVPY WGQGTQVTVSS | 198 | LTFDDSVMG | 204 | CISSSGANAFYADSVKG | 210 | GHACAGYYPIPYDDY | 942 | FTFSHSGMS | 946 | TINSGGASTYYTDSVKG | 231 | GGSGYGDASRMTSP |
| DR596-hIL27Ra-VHH20 | 935 | QVQLQESGGGLVQPGGSL RLSCTASGLTFDDSVMGW FRQAPGKGREAVSCISSS GANAFYADSVKGRFTISR DNAKNTLYLQMNSLKPED TATYYCKRGHACAGYYPI PYDDYWGQGTQVTVSSGG SGGSGGSGQVQLQESGGG LVQPGGSLRLSCAASGFT FSSYPMSWVRQAPGKGLE WVSTISSGGDTTLYADSV KGRFTSSRDNAKNTLYLQ | 198 | LTFDDSVMG | 204 | CISSSGANAFYADSVKG | 210 | GHACAGYYPIPYDDY | 942 | FTFSHSGMS | 946 | TINSGGASTYYTDSVKG | 231 | GGSGYGDASRMTSP |

TABLE 1A-continued

| Name | SEQ ID NO: | Sequence of dual VHH dimer | SEQ ID NO: CDR1 | SEQ ID NO: CDR2 | SEQ ID NO: CDR3 | SEQ ID NO: CDR4 | SEQ ID NO: CDR5 | SEQ ID NO: CDR6 |
|---|---|---|---|---|---|---|---|---|
| | | LNSLKTEDTAMYYCAKRI DCNSGYCYKRSYWGQGTQ VTVSS | | | | | | |
| DR596-hIL27Ra-VHH21 | 936 | QVQLQESGGGLVQPGGSL RLSCTASGLTFDDSVMGW FRQAPGKGREAVSCISSS GANAFYADSVKGRFTISR DNAKNTLYLQMNSLKPED TATYYCKRGHACAGYYPI PYDDYWGQGTQVTVSSGG SGGSGGSGQVQLQESGGG LVQPGGSLRLSCAASGFT FSLSSMSWVRQAPGKGLE WVSAISSGGASTYYTDSV KGRFTISRDNAKNMLYLQ LNSLKTEDTAMYYCAKGG SGYGDASRMTSPGSQGTQ VTVSS | 198 L T F D D S V M G | 204 CI SS SG AN AF YA DS VK G | 210 GH AC AG YY PI PY DD Y | 942 FTF SHS GMS | 946 TIN SGG AST YYT DSV KG | 231 GG SG YG DA SR MT SP |
| DR596-hIL27Ra-VHH22 | 937 | QVQLQESGGGLVQPGGSL RLSCTASGLTFDDSVMGW FRQAPGKGREAVSCISSS GANAFYADSVKGRFTISR DNAKNTLYLQMNSLKPED TATYYCKRGHACAGYYPI PYDDYWGQGTQVTVSSGG SGGSGGSGQVQLQESGGG SVQAGGSLRLSCRASGST YSNYCLGWFRQTTGKERE GVAVINWVGGMLYFADSV KGRFTVSQDQAKNTVYLQ MNSLKPEDTAMYYCAAES VSSFSCGGWLTRPDRVPY WGQGTQVTVSS | 198 L T F D D S V M G | 204 CI SS SG AN AF YA DS VK G | 210 GH AC AG YY PI PY DD Y | 942 FTF SHS GMS | 946 TIN SGG AST YYT DSV KG | 231 GG SG YG DA SR MT SP |
| DR596-hIL27Ra-VHH23 | 938 | QVQLQESGGGLVQPGGSL RLSCTASGLTFDDSVMGW FRQAPGKGREAVSCISSS GANAFYADSVKGRFTISR DNAKNTLYLQMNSLKPED TATYYCKRGHACAGYYPI PYDDYWGQGTQVTVSSGG SGGSGGSGQVQLQESGGG SVQAGGSLRLSCRASRSP YGNYCLGWFRQSTGKERE GVAVINWVGGMLYFADSV KGRFTVSQDHAKNTVTLQ MNSLKPEDTAMYYCAAES VSSFSCGGWLTRPDRVPY WGQGTQVTVSS | 198 L T F D D S V M G | 204 CI SS SG AN AF YA DS VK G | 210 GH AC AG YY PI PY DD Y | 942 FTF SHS GMS | 946 TIN SGG AST YYT DSV KG | 231 GG SG YG DA SR MT SP |
| DR596-hIL27Ra-VHH24 | 939 | QVQLQESGGGLVQPGGSL RLSCTASGLTFDDSVMGW FRQAPGKGREAVSCISSS GANAFYADSVKGRFTISR DNAKNTLYLQMNSLKPED TATYYCKRGHACAGYYPI PYDDYWGQGTQVTVSSGG SGGSGGSGQVQLQESGGG LVQPGGSLRLSCAASGFT FSHSGMSWVRQAPGKGLE WVSTINSGGASTYYTDSV KGRFTISRDNAKNMLYLQ LNSLKTEDTAMYYCAKGG SGYGDASRMTSPGSQGTQ VTVSS | 198 L T F D D S V M G | 204 CI SS SG AN AF YA DS VK G | 210 GH AC AG YY PI PY DD Y | 942 FTF SHS GMS | 946 TIN SGG AST YYT DSV KG | 231 GG SG YG DA SR MT SP |

In some embodiments, an IL27R binding protein described herein (e.g., in Table TA) is encoded by an isolated nucleic acid that is substantially identical to a sequence of any one of Table TB below. In some embodiments, an IL27R binding protein described herein (e.g., an IL27R binding protein comprising a sequence of Table TA) is encoded by an isolated nucleic acid comprising a sequence having at least 90% (e.g., 91%, 92%, 93%, 94%, 95%, 96%, 97%, 98%, 99%, or 100%) sequence identity to a sequence of Table TB below.

TABLE 1B

| Name | SEQ ID NO: | Sequence |
|---|---|---|
| DR591-hIL27Ra_VH H1 | 955 | CAGGTTCAGCTCCAGGAGAGCGGCGGGGGCTCCGTGCAGGCTGGCGGATCACTG CGTCTGTCCTGTACTGCGAGCGGCGCTATCGCGAGCGGGTACATTGATAGCAGA TGGTGTATGGCTTGGTTCCGTCAGGCACCAGGCAAGGAGCGTGAGGGCGTGGCA GCTATCTGGCCTGGAGGGGGTCTCACCGTGTACGCCGACTCCGTGAAGGGCCGT TTCACAATTAGTAGAGACCATGCCAAGAATACGCTCTATCTTCAGATGAATAAC CTGAAACCCGAGGATACGGCTATGTACTATTGTGCTGCGGGATCACCCCGGATG TGCCCGTCTCTGGAGTTTGGATTCGACTATTGGGGACAGGGGACCCAGGTCACC GTCAGTTCCGGTGGGGGCTCCCAAGTCCAGCTCCAGGAGTCCGGCGGGGCTTG GTCCAGCCCGGAGGCTCCCTCCGCCTGAGTTGTGCTGCCAGCGGATTCACTTTT TCCAGTTACCCTATGTCTGGGTGAGACAGGCCCCTGGGAAGGGCCTGGAGTGG ATCTCTACCATCAGCGCGGGCGGGGATACCACTCTGTATGCCGACTCAGTGAAG GGCAGGTTCACGTCTTCCCGCGATAACGCTAAGAATACTCTCTATCTGCAACTC AATTCCCTGAAGACAGAGGACGCAGCTATCTACTATTGTGCTAAGCGTATTGAT TGCAACAGCGGATACTGCTACCGTAGGAACTATTGGGGCCAGGGCACCCAGGTG ACTGTGTCCTCC |
| DR591-hIL27Ra_VH H1 | 956 | CAGGTACAGCTCCAGGAGTCTGGTGGAGGCTCTGTGCAAGCAGGGGTAGCCTG AGGCTGTCATGCACAGCCTCCGGTGCCATCGCCAGCGGTTACATTGACAGCAGG TGGTGTATGGCTTGGTTCAGGCAGGCCCCCGGCAAAGAACGTGAAGGCGTGGCC GCTATCTGGCCCGGCGGTGGACTGACTGTCTATGCCGATAGTGTGAAAGGCAGA TTCACCATCTCTCGGGATCACGCGAAGAATACACTGTACCTTCAGATGAATAAC CTGAAGCCTGAGGACACCGCCATGTACTATTGCGCTGCGGGCTCTCCGAGGATG TGCCCCAGCCTGGAGTTCGGGTTCGATTATTGGGGTCAGGGCACCCAAGTGACT GTGAGCAGTGGGGGATCTGGCGGGTCCGGTGGCTCTGGTCAGGTGCAGCTGCAA GAGTCTGGAGGGGGCCTCGTACAACCTGGAGGTAGTCTGCGCCTCAGTTGTGCT GCATCTGGCTTCACCTTCAGCTCCTATCCCATGTCTTGGGTTCGGCAGGCTCCC GGCAAGGGGCTGGAGTGGATCTCCACCATCAGCGCGGGCGGGGACACAACTCTG TACGCCGATTCTGTGAAGGGGCGTTTCACAAGCTCAAGAGATAACGCAAAAAAC ACGCTCTACCTCCAGCTTAATTCATTGAAGACCGAAGACGCAGCTATTTATTAC TGCGCTAAGCGCATCGACTGTAACTCCGGCTACTGCTATAGAAGGAATTACTGG GGCCAGGGAACACAGGTTACCGTGAGTTCA |
| DR591-hIL27Ra_VH H2 | 957 | CAGGTGCAGCTCCAGGAGTCCGGTGGCGGAAGCGTCCAGGCTGGCGGAAGTCTG AGGCTCTCATGCACCGCCTCTGGTGCCATCGCCAGCGGATACATCGACTCCAGA TGGTGTATGGCTTGGTTTAGGCAAGCCCCTGGCAAGGAAAGGGAGGGGGTTGCT GCCATCTGGCCCGGCGGAGGCCTGACGGTGTATGCAGACAGCGTCAAAGGGAGA TTCACCATTTCTCGCGACCACGCTAAGAACACCCTTTACTTGCAGATGAATAAC CTCAAGCCCGAGGACACCGCCATGTATTACTGCGCCGCTGGTTCACCGAGGATG TGCCCGAGCCTGGAGTTCGGCTTCGACTACTGGGGCCAAGGTACACAAGTGACT GTGTCCAGCGGCGGGGGTAGCCAGGTTCAGCTGCAAGAGAGCGGCGGTGGATTG GTGCAGCCAGGCGGTAGCCTGCGCCTGTCTTGCGCGGCCAGCGGATTCACATTC TCCCTGAGCGGCATGTCTTGGGTGCGCCAAGCTCCGGGCAAAGGCCTGGAGTGG GTCAGCGCCATCTCTAGCGGAGGTGCCTCTACGTATTACACAGATTCCGTTAAG GGCCGCTTCACTATCAGCCGCGATAACGCCAAGAACATCCTGTATCTCCAGTTG AACAGCCTGAAAACGGAGGACACAGCCATGTACTATTGCGCTAAAGGGGGTTCA GGCTATGGTGACGCTTCTCGCATGACCTCACCCGGCTCACAGGGAACCCAGGTG ACAGTGTCAAGT |
| DR591-hIL27Ra_VH H2 | 958 | CAGGTGCAGCTGCAAGAGTCCGGCGGAGGTAGCGTTCAAGCCGGAGGCTCACTG AGACTGTCTTGCACCGCCTCTGGTGCAATCGCCTCTGGCTATATTGATTCTCGC TGGTGTATGGCGTGGTTTAGGCAAGCGCCTGGGAAAGAGCGTGAAGGAGTTGCA GCCATCTGGCCGGAGGCGGACTGACCGTGTACGCTGACTCTGTGAAGGGCAGA TTCACCATCAGTCGTGACCACGCCAAGAACACTCTGTACCTTCAGATGAATAAC CTCAAACCAGAGGACACAGCTATGTACTATTGTGCGGCTGGATCTCCGCGCATG TGCCCTAGTCTGGAGTTCGGTTTTGATTACTGGGGCCAGGGAACTCAAGTGACC GTGTCTAGCGGCGGTTCTGGAGGCAGTGGTGGGTCAGGTCAGGTTCAGCTCCAA GAGTCAGGTGGGGGACTCGTGCAACCAGGGGGCTCCCTGCGCCTGTCTTGCGCT GCCTCCGGCTTCACTTTCAGCCTGAGCGGTATGTCCTGGGTTCGCCAGGCTCCT GGTAAAGGGCTGGAGTGGGTTAGTGCTATCAGCTCCGGCGGAGCTTCTACCTAT TACACCGACTCTGTTAAGGGTCGCTTCACTATCAGCCGCGACAACGCCAAAAAT ATTTTGTATCTGCAACTCAACTCCTTGAAGACAGAGGACACCGCGATGTATTAC TGCGCCAAGGGAGGTAGCGGCTACGGCGATGCTAGTCGTATGACGAGCCCCGGC TCTCAGGGTACACAAGTCACCGTAAGCTCC |
| DR591-hIL27Ra_VH H3 | 959 | CAGGTTCAGTTGCAGGAGTCTGGCGGAGGGAGCGTTCAGGCTGGCGGTTCCCTG AGGCTCTCTTGCACAGCCTCTGGCGCTATCGCCTCAGGATATATTGATTCCGT TGGTGTATGGCATGGTTCCGTCAGGCCCCTGGCAAGGAACGCGAGGGAGTCGCT GCCATCTGGCCCGGCGGGGCCTGACAGTCTACGCTGATTCAGTTAAGGGCCGC TTCACTATCAGCCGCGACCACGCTAAAAACACGCTGTACCTGCAAATGAATAAC CTCAAACCAGAGGACACTGCAATGTATTACTGCGCCGCAGGCTCTCCCAGAATG |

TABLE 1B-continued

| Name | SEQ ID NO: | Sequence |
|---|---|---|
| | | TGCCCGAGCCTGGAGTTTGGTTTCGATTACTGGGGTCAGGGCACGCAGGTAACC<br>GTGAGTTCTGGTGGAGGCTCCCAGGTGCAGCTCCAAGAGTCCGGGGGAGGCTCT<br>GTGCAAGCAGGCGGAAGCCTGAGATTGTCCTGCGTGGCCAGCGGTTATGTGTCC<br>TGTGATTACTTCCTGCCTTCTTGGTATCGGCAGGCCCCAGGCAAGGAGCGCGAG<br>TTCGTCTCCATCATTGATGGCACCGGATCAACAAGCTACGCTGCGTCCGTGAAG<br>GGTCGGTTTACAGCAAGCGAGGATAAGGGAAAGAACATCGCGTACCTCCAGATG<br>AACAGCCTGAAGCCTGAAGACACTGCTATGTATTACTGTAAGGCTAGTTGTGTG<br>CGGGGCCGCGCAGTTTCTGAATATTGGGGTCAGGGAACACAAGTAACCGTGTCT<br>TCA |
| DR591-<br>hIL27Ra_<br>VH<br>H3 | 960 | CAGGTCCAGCTCCAGGAATCAGGAGGTGGCTCCGTACAGGCCGGAGGGAGTCTC<br>CGCCTCTCCTGTACTGCCAGTGGTGCCATCGCAAGCGGCTATATCGACAGCCGT<br>TGGTGCATGGCCTGGTTCAGGCAGGCACCCGGCAAAGAGAGAGAAGGAGTCGCT<br>GCGATCTGGCCGGGTGGAGGTTTGACCGTCTACGCCGACAGCGTCAAGGGCAGA<br>TTTACTATCAGCCGTGACCACGCGAAGAACACCCTCTATCTTCAGATGAATAAC<br>CTCAAACCTGAGGATACCGCCATGTATTACTGCGCAGCCGGGACCCCTCGGATG<br>TGCCCTAGCCTGGAGTTCGGCTTCGACTACTGGGGCCAAGGGACACAGGTAACA<br>GTTAGTAGCGGTGGCTCCGGTGGCTCCGGGGGTTCTGGTCAGGTCCAGCTCCAG<br>GAGTCTGGAGGCGGTTCAGTGCAGGCTGGCGGTTCACTGCGCCTCAGCTGCGTG<br>GCCTCCGGCTACGTATCATGCGACTATTTCCTGCCCTCCTGGTATCGCCAGGCC<br>CCCGGAAAAGAGAGGGAGTTTGTGTCTATTATCGACGGGACCGGAAGCACCAGC<br>TACGCTGCCTCAGTGAAGGGTCGCTTCACCGCCTCCGAGGATAAGGGCAAGAAC<br>ATTGCCTACTTGCAGATGAACTCATTGAAACCGGAAGACACTGCGATGTATTAC<br>TGTAAGGCTTCTTGCGTTCGCGGACGTGCTGTGAGCGAGTACTGGGGCCAAGGG<br>ACCCAAGTGACGGTCTCTTCT |
| DR591-<br>hIL27Ra_<br>VH<br>H4 | 961 | CAGGTGCAACTTCAGGAGTCTGGCGGTGGCAGCGTGCAGGCCGGGGGCTCCCTG<br>CGGCTGTCATGTACGGCCTCCGGCGCTATTGCCAGCGGTTACATTGACTCCAGG<br>TGGTGCATGGCCTGGTTCCGTCAGGCTCCGGGCAAGGAGAGGGAAGGCGTGGCA<br>GCCATCTGGCCCGGCGGGGGCCTCACCGTTTATGCCGATTCCGTGAAGGGACGT<br>TTTACAATCAGCCGTGACCATGCTAAGAACACCCTGTATTTGCAGATGAATAAC<br>CTGAAACCCGAGGACACCGCCATGTATTACTGCGCCGCAGGCAGCCCCCGTATG<br>TGCCCGTCCCTGGAGTTTGGCTTCGATTACTGGGGCCAGGGGACCCAGGTGACA<br>GTCAGCTCCGGGGTGGCTCTCAGGTGCAACTTCAGGAATCCGGTGGAGGTCTG<br>GTGCAGCCGGGAGAGTCTCTGCGTCTGTCATGCACTGCCTCAGGCTTCACGTTT<br>AGTAACTATGCTATGTCCTGGGTGAGGCAAGCTCCTGGAAAGGGCCTCGAATGG<br>GTGTCAGGAATCAACGTGGCCTACGGCATTACTTCTTATGCCGATTCTGTTAAG<br>GGTCGCTTCACTATCTCAAGAGACAACACTAAAAACACTCTTTACTTGCAGCTG<br>AACAGCCTGAAAACAGAGGACACAGCCATTTATTACTGCGTGAAGCACTCTGGC<br>ACAACCATCCCACGCGGTTTCATTTCATACACGAAGCGCGGCCAGGGGACCCAG<br>GTGACTGTGAGCAGC |
| DR591-<br>hIL27Ra_<br>VH<br>H4 | 962 | CAGGTCCAACTTCAGGAATCTGGAGGTGGCTCAGTACAGGCTGGAGGCTCCCTG<br>AGACTGAGCTGCACCGCCTCAGGAGCAATCGCATCCGGCTATATCGACTCCCGT<br>TGGTGTATGGCCTGGTTTCGCCAGGCCCCCGGCAAGGAGCGTGAGGGCGTGGCC<br>GCTATCTGGCCAGGCGGGGGCCTGACCGTGTACGCTGACAGTGTTAAAGGAAGG<br>TTCACAATTTCCCGCGATCACGCTAAGAATACATTGTATCTTCAGATGAATAAC<br>CTCAAGCCAGAGGACACCGCCATGTATTACTGCGCAGCCGGTTCACCCCGCATG<br>TGCCCCAGCCTGGAGTTCGGCTTCGACTACTGGGGACAGGGCACCCAGGTTACC<br>GTGTCTTCCGGCGGTTCTGGCGGATCTGGTGGCTCCGGGCAGGTGCAGCTCCAG<br>GAATCTGGTGGGGGCCTGGTTCAGCGGGTGAAAGCCTGAGGCTGTCTTGCACC<br>GCCTCTGGTTTCACCTTCAGCAACTATGCGATGTCTTGGGTGCGGCAAGCACCG<br>GGTAAGGGCCTGGAGTGGGTGAGCGGCATCAACGTGGCCTACGGTATTACAAGC<br>TACGCCGATTCCGTTAAAGGTCGTTTCACCATCTCTAGGGACAACACAAAGAAC<br>ACACTGTACTTGCAGCTGAACTCTCTGAAGACCGAAGATACCGCCATCTATTAC<br>TGTGTGAAGCATTCCGGCACAACCATCCCTCGCGGCTTCATCTCCTATACCAAG<br>CGCGGCCAGGGCACCCAGGTCACGGTTTCCTCC |
| DR591-<br>hIL27Ra_<br>VH<br>H5 | 963 | CAGGTGCAGCTGCAAGAGTCCGGTGGCGGGTCCGTCCAGGCCGGGGGCTCTCTG<br>CGTCTTAGCTGCACCGCTTCTGGGGCCATTGCTTCTGGCTACATTGATTCCAGA<br>TGGTGTATGGCCTGGTTCCGCCAAGCGCCCGGCAAGGAGCGCGAGGGCGTGGCC<br>GCTATCTGGCCCGGTGGAGGCCTTACCGTCTATGCTGACAGCGTGAAAGGACGC<br>TTCACCATCTCCCGCGACCACGCCAAAAACACCCTGTACTTGCAGATGAACAAT<br>TTGAAGCCCGAGGACACGGCCATGTATTACTGCGCCGCTGGTAGCCCCCGCATG<br>TGTCCGTCCCTGGAGTTCGGTTTCGACTACTGGGGCAGGGCACCCAGGTGACA<br>GTCAGCTCTGGAGGGGGCTCCCAGGTGCAGCTCCAGGAGAGCGGCGGAGGCAGC<br>GTGCAGGCCGGGGGAAGCCTCAGGCTGAGCTGCACCGCGAGCGGCTACGTTTCC<br>TGTGATTATTTTCTCCCCATCATGGTATCGCCAAGCGCCAGGAAAGGAGCGTGAG<br>TTCGTATCCGTGATTGACGGTACAGGTTCAACATCCTATGCGGCCTCTGTGAAG<br>GGGCGCTTCACCGCGAGCCAAGATAAGGGGAAGAACATCGCCTATTTGCAGATG<br>AACTCACTGAAGCCTGAGGACACCGCTATGTATTACTGCAAGGCTTCCTGTGTG<br>CGTGGCCGCGCCATCTCTGAGTACTGGGGCAGGGCACCCAGGTGACCGTGTCC<br>TCC |

TABLE 1B-continued

| Name | SEQ ID NO: | Sequence |
|---|---|---|
| DR591-hIL27Ra_VH H5 | 964 | CAGGTGCAGCTGCAAGAATCTGGAGGCGGTAGCGTACAGGCAGGTGGCAGCCTG<br>AGGCTGTCTTGTACTGCGTCCGGCGCTATCGCATCAGGATACATTGACTCACGT<br>TGGTGCATGGCCTGGTTTCGTCAGGCTCCAGGAAAGGAGCGTGAAGGCGTCGCT<br>GCCATTTGGCCTGGTGGAGGCCTGACCGTGTATGCCGATAGCGTCAAGGGACGT<br>TTCACCATCAGCCGTGACCACGCTAAGAATACCCTGTACTTGCAAATGAACAAT<br>TTGAAGCCAGAGGACACTGCGATGTACTATTGCGCGGCAGGCTCCCCCAGGATG<br>TGTCCCAGCCTGGAGTTTGGTTTCGATTACTGGGGCAGGGCACCCAGGTCACC<br>GTTAGCTCCGGGGGTTCTGGAGGTTCCGGCGGTTCAGGACAGGTGCAGCTTCAG<br>GAGTCTGGGGGAGGGGTCCGTACAAGCCGGGGGCTCCTTGCGCCTGTCTTGCACA<br>GCTTCCGGCTATGTTAGTTGTGACTACTTCCTGCCTAGCTGGTATCGCCAAGCC<br>CCTGGCAAGGAGAGGGAGTTCGTTTCCGTGATTGATGGCACTGGGTCTACTTCC<br>TACGCTGCCAGTGTGAAGGGGCGCTTCACCGCTTCTCAAGACAAGGGCAAGAAC<br>ATCGCGTACCTCCAGATGAACAGCCTGAAGCCAGAAGATACCGCAATGTACTAT<br>TGTAAGGCCTCCTGCGTTCGCGGGCGGGCCATCTCAGAATACTGGGGCCAGGGG<br>ACTCAGGTCACCGTGTCCAGT |
| DR591-hIL27Ra_VH H6 | 965 | CAGGTGCAGTTGCAGGAATCTGGCGGAGGCTCCGTCCAGGCTGGTGGCAGTTTG<br>CGTCTGTCCTGCACAGCTTCAGGCGCGATTGCCTCTGGCTACATTGATAGTAGA<br>TGGTGCATGGCCTTGGTTCAGACAGGCTCCTGGAAAGGAGAGAGGGGGTGGCC<br>GCGATCTGGCCCGGAGGCGGGCTGACTGTCTACGCCGATAGCGTTAAGGGTCGC<br>TTCACGATTTCTCGGGATCACGCCAAGAACACCCTGTACTTGCAAATGAATAAC<br>CTGAAACCCGAAGACACCGCAATGTATTACTGCGCCGCTGGTTCACCAAGGATG<br>TGCCCTTCCCTGGAGTTCGGTTTCGACTACTGGGGACAGGGCACCCAGGTAACC<br>GTGAGTAGCGGCGGGGGTAGTCAGGTGCAGCTTCAGGAGTCAGGCGGGGGCTTG<br>GTCCAACCTGGAGGGAGCCTCAGGCTCTCCTGTGCCGCTTCCGGCTTCAGTTTC<br>AGCTCCTATGCCATGAAGTGGGTAAGACAGGCCCCTGGCAAGGGCCTGGAGTGG<br>GTTTCCACCATTAGTAGCGGAGGCAGCTCAACCAACTACGCCGATTCCGTTAAG<br>GGCCGCTTTACGATCAGCCGTGACAATGCAAAGAACACCTTGTACCTCCAGCTG<br>AACTCCCTGAAAATTGAAGACACCGCAATGTATTACTGCGCCAAGGCAATCGTC<br>CCTACAGGGGCCACAATGGAGCGCGGTCAGGGAACTCAGGTGACCGTGTCCAGC |
| DR591-hIL27Ra_VH H6 | 966 | CAGGTTCAGCTCCAGGAATCTGGAGGGGGAAGTGTGCAGGCTGGAGGTTCCCTC<br>CGCCTCAGCTGCACTGCCAGCGGAGCTATCGCTTCCGGTTACATTGACAGCCGC<br>TGGTGTATGGCTTGGTTCGCCAAGCGCCCGGCAAGGAACGCGAAGGGGTGGCG<br>GCCATCTGGCCTGGGGGAGGCCTGACAGTGTACGCCGACAGCGTCAAGGGTAGG<br>TTTACTATCAGCAGAGACCACGCAAAGAACACCCTGTATCTGCAAATGAACAAT<br>CTGAAGCCGGAAGACACTGCAATGTATTACTGTGCTGCGGGCTCCCCCAGGATG<br>TGTCCCAGCCTGGAGTTCGGGTTTGACTACTGGGGTCAGGGGACGCAGGTGACC<br>GTCAGCTCCGGCGGTTCCGGGGGCAGCGGAGGCAGCGGACAGGTCCAGCTTCAG<br>GAGTCCGGTGGGGGCCTGGTCCAGCCTGGGGGCTCTCTGCGGCTGAGCTGTGCG<br>GCCAGCGGGTTTAGTTTCTCCAGTTACGCTATGAAATGGGTGCGTCAGGCACCG<br>GGTAAGGGACTCGAATGGGTCAGCACAATCAGTAGCGGAGGCAGCTCCACGAAC<br>TATGCTGATAGCGTGAAGGGAAGATTCACCATTAGCCGCGACAACGCCAAGAAT<br>ACATTGTATCTTCAGCTGAACAGCCTGAAGATCGAAGACACCGCGATGTATTAC<br>TGTGCTAAGGCCATCGTGCCCACTGGGGCCACAATGGAGAGGGGCCAGGGCACC<br>CAGGTCACGGTATCCAGC |
| DR591-hIL27Ra_VH H7 | 967 | CAGGTCCAGTTGCAGGAAAGCGGAGGCGGATCTGTGCAGGCAGGTGGCTCCCTT<br>CGCCTGAGCTGCACCGCAAGCGGGGCCATTGCGTCTGGATACATCGACTCCAGA<br>TGGTGCATGGCCTGGTTCCGCCAAGCGCCAGGCAAAGAGCGCGAAGGAGTGGCA<br>GCCATCTGGCCTGGAGGGGGCCTCACAGTTTACGCTGACTCCGTTAAGGGCAGA<br>TTCACCATCTCCCGCGACCACGCCAAGAACACACTCTACCTCCAGATGAATAAC<br>CTGAAGCCCGAGGATACCGCCATGTATTACTGCGCAGCTGGAAGCCCACGTATG<br>TGCCCGTCCTTGGAGTTCGGCTTCGACTACTGGGGCAAGGAACCCAGGTGACC<br>GTTTCCAGCGGGGCGGATCTCAGGTCCAGTTGCAAGAGTCCGGGGGCGGGCTG<br>GTGCAGCCTGGGGGCTCTCTGCGCCTGTCCTGCGCAGCGAGCGGCTTCACCTTC<br>TCATCCTATCCTATGTCTTGGGTGCGTCAGGCCCCAGGTAAGGGACTGGAGTGG<br>ATTTCCACGATCAGTGCCGGTGGCGATACTACCCTCTACGCCGACTCTGTGAAA<br>GGACGGTTCACCAGTAGCCGTGACAACGCGAAGAACACATTGTATTTGCAGCTG<br>AACAGCCTCAAGACCGAAGATACCGCCATCTATTACTGCGCCAAGAGAATTGAT<br>TGTAACTCTGGATACTGCTACCGTCGCAACTACTGGGGACAGGGCACCCAGGTC<br>ACCGTCAGTTCC |
| DR591-hIL27Ra_VH H7 | 968 | CAGGTGCAGTTGCAGGAATCCGGGGGAGGCAGTGTTCAGGCTGGCGGAAGCCTG<br>CGCCTTTCCTGCACAGCCAGCGGGGCTATTGCCTCCGGCTACATTGATAGTCGT<br>TGGTGCATGGCCTGGTTCCGCCAAGCACCGGGTAAGGAGAGGGAAGGCGTCGCC<br>GCAATCTGGCCGGGAGGGGTCTGACCGTGTATGCTGACAGCGTGAAGGGCAGA<br>TTCACCATCTCTAGGGACCACGCCAAGAACACCCTCTATTTGCAGATGAACAAT<br>CTCAAACCCGAGGATACCGCGATGTATTACTGCGCTGCGGGTAGCCCACGTATG<br>TGTCCATCTCTGGAGTTCGGCTTCGATTATTGGGGTCAGGGCACTCAGGTGACC<br>GTCAGCTCCGGGGGCTCCGGCGGTTCTGGTGGGTCAGGCCAGGTGCAGCTCCAG<br>GAGTCCGGCGGTGGCCTGGTGCAGCCCGGTGGGTCCCTTCGTCTGAGCTGTGCA<br>GCCAGCGGATTTACATTTAGCTCCTACCCCATGTCCTGGGTAAGACAGGCCCCC<br>GGAAAGGGCCTGGAATGGATTTCCACCATCTCTGCCGGTGGAGACACCACACTG<br>TATGCTGACTCTGTGAAGGGAAGATTCACTTCCTCTCGGGACAACGCCAAGAAC<br>ACCCTGTACTTGCAGTTGAACAGCCTGAAGACAGAGGATACCGCCATTTATTAC |

TABLE 1B-continued

| Name | SEQ ID NO: | Sequence |
|---|---|---|
| | | TGTGCCAAGAGGATTGATTGTAACAGCGGATACTGTTATCGCAGGAACTATTGG<br>GGACAGGGAACTCAGGTGACCGTCTCTTCA |
| DR591-<br>hIL27Ra_<br>VH<br>H8 | 969 | CAGGTCCAGCTTCAGGAGTCCGGCGGAGGCTCTGTGCAGGCAGGCGGTTCACTG<br>CGCCTGTCATGCACGGCGAGCGGAGCCATCGCCAGCGGTTACATTGATTCCCGT<br>TGGTGCATGGCGTGGTTCCGTCAGGCACCCGGCAAGGAACGCGAGGGCGTGGCT<br>GCCATCTGGCCTGGGGGCGGGCTTACAGTGTACGCCGATTCCGTGAAAGGTCGC<br>TTCACCATCTCCCGCGACCACGCCAAGAATACTCTTTACCTGCAAATGAATAAC<br>TTGAAGCCGGAGGACACCGCTATGTATTACTGTGCCGCTGGCAGCCCTCGCATG<br>TGTCCCTCTCTGGAGTTCGGCTTTGATTACTGGGGCCAGGGCACCCAGGTGACC<br>GTATCTAGCGGTGGAGGCTCCCAAGTGCAGCTGCAAGAATCTGGAGGCGGGAGC<br>GTCCAGGTGGGAGGCTCCCTGCGCCTGAGCTGCGCCGCTTCCGGCTTTACCTTT<br>AGTAGCTACCCCATGTCCTGGGTCCGCCAGGCACCCGGCAAAGGCCTTGAGTGG<br>ATCTCCACGATCAGCGCAGGGGGTGACACCACTCTGTACGCCGACAGCGTTAAA<br>GGCAGGTTCACCAGCTCCCGCGACAACGCGAAAAACACCCTGTACTTGCAGCTC<br>AACTCACTCAAGACGGAGGACACTGCTATCTATTACTGCGCCAAGCGCATTGAT<br>TGTAACAGCGGTTACTGTTACCGGCGTAACTACTGGGGTCAGGGCACTCAGGTC<br>ACCGTCTCCTCT |
| DR591-<br>hIL27Ra_<br>VH<br>H8 | 970 | CAAGTGCAGCTCCAGGAATCCGGTGGAGGCAGCGTGCAGGCCGGAGGTTCCCTG<br>CGCCTGTCTTGCACTGCCTCAGGAGCCATTGCCTCCGGTTACATTGATTCCCGT<br>TGGTGCATGGCCTGGTTTCGCCAGGCCCCAGGAAAAGAGCGCGAGGGGGTGGCC<br>GCTATCTGGCCCGGCGGTGGCCTGACTGTGTACGCTGATTCCGTAAAGGGCCGG<br>TTTTACCATCTCCAGGGATCATGCAAAAAACACACTCTACCTCCAGATGAATAAC<br>CTGAAGCCTGAGGACACCGCCATGTATTACTGCGCCGCTGGCTCACCTCGTATG<br>TGTCCCAGCCTCGAATTTGGCTTTGACTATTGGGGCCAGGGCACCCAGGTTACC<br>GTCTCTTCCGGTGGCTCAGGAGGTTCCGGGGGCTCTGGTCAGGTGCAGTTGCAG<br>GAAAGTGGAGGTGGCAGTGTGCAGGTAGGGGGCAGCCTGCGTCTGAGCTGTGCT<br>GCCAGCGGCTTTACATTCAGCTCCTATCCTATGAGCTGGGTGAGACAGGCCCCT<br>GGGAAAGGCCTGGAGTGGATCAGCACTATCAGCGCCGGTGGCGATACGACTCTC<br>TATGCCGATAGCGTCAAGGGCCGCTTCACGTCCTCAAGGGACAATGCTAAAAAC<br>ACCTTGTATCTCCAGTTGAACAGTCTCAAGACGGAGGACACCGCTATCTACTAT<br>TGTGCCAAGAGAATTGATTGCAACAGCGGCTACTGTTACAGACGTAATTATTGG<br>GGGCAGGGCACCCAGGTAACTGTGTCCTCA |
| DR591-<br>hIL27Ra_<br>VH<br>H9 | 971 | CAGGTGCAGTTGCAGGAGTCAGGCGGTGGCTCCGTGCAGGCAGGCGGAAGCCTG<br>CGCCTGTCTTGCACTGCCTCTGGGGCTATTGCATCAGGGTACATTGATAGCCGC<br>TGGTGTATGGCGTGGTTTAGGCAGGCTCCAGGAAAGGAAAGAGAGGGAGTGGCC<br>GCGATCTGGCCCGGTGGAGGTCTGACGGTGTATGCTGATTCAGTGAAGGGCCGG<br>TTCACTATTTCTCGCGACCATGCCAAGAACACCCTCTACCTTCAGATGAATAAC<br>CTGAAACCCGAGGACACCGCTATGTATTACTGCGCTGCGGGTTCTCCCCGCATG<br>TGTCCTAGTCTTGAGTTCGGATTTGACTATTGGGGCCAGGGCACCCAAGTGACG<br>GTCAGCTCCGGCGGGGGTAGTCAGGTCCAACTGCAAGAATCCGGGGGCGGTAGC<br>GTGCAGTCCGGTGGCTCCCTGAGACTCAGCTGCGCCGCTTCCGGGTTTACCTAC<br>TCCACTTCCAACTCTTGGATGGCGTGGTTCCGTCAGGCCCCAGGAAAGGAGAGG<br>GAGGGCGTGGCCGCTATCTATACGGTGGGTGGCTCCATCTTCTACGCCGATTCT<br>GTACGCGGAAGATTCACAATCTCTCAGGACGCAACAAAAAATATGTTTTACTTG<br>CAGATGAACACTCTGAAGCCTGAAGACACTGCGATGTACTATTGTGCGGCTGCG<br>AGCGGCAGACTGCGCGGTAAGTGGTTCTGGCCCTACGAGTACAACTACTGGGGG<br>CAGGGCACTCAGGTCACAGTCTCTAGC |
| DR591-<br>hIL27Ra_<br>VH<br>H9 | 972 | CAGGTGCAGTTGCAGGAATCTGGCGGTGGCAGTGTCCAGGCCGGTGGCTCCCTC<br>AGGCTGTCCTGCACTGCCAGCGGAGCCATCGCTTCAGGCTACATTGACTCTAGG<br>TGGTGCATGGCTTGGTTTCGCCAGGCTCCGGGCAAGAGCGCGAGGGCGTCGCA<br>GCCATCTGGCCAGGTGGGGGTTTGACGGTCTATGCTGATTCCGTGAAGGGGCGG<br>TTCACTATCTCCCGTGACCACGCCAAGAACACCCTGTACCTCCAGATGAATAAC<br>CTGAAGCCTGAGGATACAGCGATGTACTATTGCGCTGCCGGTAGCCCGCGCATG<br>TGCCCCAGTCTTGAGTTCGGCTTTGACTATTGGGGCCAGGGCACGCAAGTGACC<br>GTGTCCTCTGGGGGCAGTGGCGGTTCTGGTGGCTCAGGTCAGGTCCAGCTCCAG<br>GAAAGCGGGGGTGGGTCCGTCCAATCTGGTGGCTCCTTGCGTCTGAGCTGCGCT<br>GCCTCTGGCTTCACTTATTCAACGTCCAACTCTTGGATGGCCTGGTTTCGCCAA<br>GCGCCAGGCAAGGAGCGTGAAGGCGTCGCTGCCATCTATACCGTTGGTGGCAGC<br>ATTTTCTACGCTGACTCAGTGAGGGGCAGATTTACCATTTCTCAGGATGCAACC<br>AAGAATATGTTTTACTTGCAGATGAACACACTGAAGCCCGAGGACACAGCTATG<br>TACTATTGTGCAGCCGCTTCTGGCCGTCTTCGCGGCAAGTGGTTCTGGCCCTAC<br>GAGTACAATTATTGGGGCCAGGGTACGCAGGTGACCGTGTCCAGT |
| DR591<br>hIL27Ra_<br>VH<br>H10 | 973 | CAAGTTCAGTTGCAGGAGTCCGGTGGCGGTAGTGTGCAGGCGGGCGGAAGCCTG<br>CGCCTGTCTTGTACCGCCTCTGGGGCCATTGCCTCTGGCTACATTGATTCTCGC<br>TGGTGTATGGCCTGGTTTAGGCAGGCACCAGGCAAGGAACGCGAAGGCGTGGCC<br>GCTATCTGGCCTGGGGGCGGACTGACCGTGTACGCTGACTCAGTCAAAGGCCGC<br>TTCACTATCTCACGCGACCACGCCAAGAATACTCTGTACCTCCAGATGAATAAC<br>CTGAAGCCTGAGGACACCGCGATGTATTACTGCGCTGCCGGTTCCCCAAGAATG<br>TGCCCTTCACTTGAGTTTGGCTTTGACTATTGGGGCCAAGGAACTCAGGTGACC<br>GTAAGCTCTGGAGGGGGCAGCCAGGTCCAGCTCCAGGAGTCTGGAGGGGGCTCC<br>GTGCAGGCCGAGGGTCTCTCCGCCTCAGCTGTCGTGCCTCAGGCTCCACGTAC<br>TCTAACTACTGCCTGGGGTGGTTCCGCCAGATCACAGGTAAAGAGCGCGAAGGC |

TABLE 1B-continued

| Name | SEQ ID NO: | Sequence |
|---|---|---|
| | | GTAGCTGTCATCAACTGGGTCGGGGGAATGCTGTACTTCGCCGACTCCGTTAAG<br>GGTCGGTTCACCGTCTCTCAGGATCAGGCCAAAAATACCCTGTATCTCCAGATG<br>AACAGCCTGAAGCCGGAGGACACCGCTATGTATTACTGTGCCGCAGAGAGCGTG<br>TCCTCTTTCTCCTGCGGCGGTTGGCTGACCCGCCCGGACAGAGTACCCTACTGG<br>GGTCAGGGGACTCAGGTGACAGTGAGCAGC |
| DR591-<br>hIL27Ra_<br>VH<br>H10 | 974 | CAGGTGCAACTGCAAGAGTCCGGCGGAGGCTCTGTGCAAGCCGGAGGCTCTCTG<br>CGCCTGTCCTGTACCGCTAGTGGAGCCATCGCCAGCGGTTACATTGACAGCAGA<br>TGGTGTATGGCCTGGTTCCGCCAGGCCCCCGGCAAAGAGCGCGAGGGCGTCGCT<br>GCAATCTGGCCTGGCGGGGGCCTTACCGTATATGCCGATTCAGTCAAAGGCCGC<br>TTCACAATCTCACGCGACCACGCCAAGAACACCCTGTACTTGCAGATGAATAAC<br>CTGAAGCCGGAGGACACCGCAATGTATTACTGCGCAGCCGGGTCTCCGCGCATG<br>TGTCCCAGCTTGGAGTTCGGATTCGACTACTGGGGCCAAGGGACCCAGGTGACG<br>GTTAGCTCTGGCGGTTCCGGCGGGAGTGGGGGCTCTGGCCAGGTGCAGCTGCAA<br>GAGTCTGGGGGAGGTTCTGTCCAGGCGGGAGGCTCCCTGAGGCTGAGTTGTCGT<br>GCAAGCGGTTCTACCTACTCCAACTATTGCCTGGGTTGGTTTCGTCAGATTACG<br>GGGAAGGAACGCGAGGGGGTCGCCGTCATAAATTGGGTTGGCGGTATGCTTTAT<br>TTTGCCGACTCTGTCAAAGGTCGGTTCACCGTGTCTCAAGACCAGGCTAAGAAC<br>ACTCTGTACCTCCAGATGAACTCCCTGAAACCAGAGGACACCGCAATGTATTAC<br>TGCGCTGCCGAAAGCGTGTCCAGCTTCAGCTGTGGCGGTTGGCTCACCCGCCCT<br>GACCGTGTGCCCTATTGGGGTCAGGGGACACAGGTGACCGTCAGCAGC |
| DR591-<br>hIL27Ra_<br>VH<br>H11 | 975 | CAGGTGCAGTTGCAGGAAAGCGGAGGGGGCTCCGTGCAAGCCGGAGGGTCTCTG<br>CGTCTTTCTTGCACTGCCTCTGGGGCCATCGCTTCCGGCTACATTGATAGCCGT<br>TGGTGCATGGCCTGGTTCCGTCAAGCGCCTGGAAAGGAGCGCGAGGGCGTGGCC<br>GCTATTTGGCCTGGTGGAGGCCTCACTGTGTATGCTGATAGTGTGAAGGGACGT<br>TTCACAATCTCCCGTGACCACGCGAAGAACACGCTGTACCTCCAGATGAACAAT<br>CTCAAACCCGAGGATACAGCTATGTATTACTGTGCCGCTGGTAGTCCACGCATG<br>TGTCCCAGTCTGGAGTTCGGGTTTGATTATTGGGGACAAGGCACGCAGGTTACA<br>GTGTCTTCCGGGGGTGGCTCCCAAGTTCAGCTTCAAGAGAGCGGCGGAGGCTCC<br>GTGCAGGCGGGTGGCTCACTGAGACTGTCCTGCCGTGCCTCCGGGTCCACTTAT<br>AGTAACTATTGTCTGGGTTGGTTCCGTCAAAGTACTGGTAAAGAGCGCGAGGGC<br>GTGGCAGTAATCAACTGGGTCGGCGGAATGCTGTACTTCGCGGATTCTGTGAAG<br>GGAAGATTCACTGTGTCACAGGACCACGCCAAAAATACCGTGACCCTTCAGATG<br>AATAGCCTGAAGCCTGAGGACACGGCAATGTATTACTGTGCGCTGAATCCGTG<br>TCTAGCTTTAGCTGCGGAGGTTGGCTGACACGTCCTGGTAGAGTGCCATATTGG<br>GGCCAAGGCACTCAAGTGACTGTATCTTCC |
| DR591-<br>hIL27Ra_<br>VH<br>H11 | 976 | CAGGTTCAGCTTCAGGAATCCGGTGGAGGCAGTGTGCAGGCCGGTGGAAGCCTC<br>CGCCTCTCTTGCACAGCCTCCGGGGCCATCGCATCTGGCTATATTGACAGCCGC<br>TGGTGTATGGCTTGGTTCCGCCAAGCGCCCGGTAAGGAGCGCGAAGGGGTCGCT<br>GCCATTTGGCCTGGTGGGGGATTGACTGTGTATGCAGATAGCGTGAAAGGTCGT<br>TTCACTATCAGCCGTGACCACGCCAAGAACACCCTGTATCTGCAAATGAACAAT<br>CTGAAGCCTGAGGACACCGCCATGTATTACTGTGCGGCAGGCAGCCCTCGCATG<br>TGCCCGTCCCTGGAGTTCGGTTTCGACTACTGGGGCCAGGGCACACAGGTGACT<br>GTTAGCTCCGGCGGTTCTGGAGGTTCTGGGGGCTCTGGCCAGGTACAGCTCCAG<br>GAGAGCGGAGGGGGCTCCGTTCAAGCAGGTGGCTCTTTGCGTTTGAGCTGCCGT<br>GCCAGCGGGTCTACCTACTCCAATTACTGTCTGGGATGGTTCCGCCAATCCACC<br>GGCAAAGAACGTGAGGGTGTGGCCGTTATCAACTGGGTTGGGGGAATGCTTTAC<br>TTTGCGGACAGTGTGAAAGGGCGCTTCACCGTGTCCCAGGATCATGCTAAGAAC<br>ACTGTGACCCTCCAGATGAACAGCCTGAAGCCCGAGGATACGGCAATGTATTAC<br>TGCGCCCGCTGAATCAGTAAGCTCCTTCTCATGTGGCGGATGGCTGACCCGCCCT<br>GGCCGCGTGCCCTATTGGGGACAGGGCACCCAGGTGACAGTCAGCAGC |
| DR591-<br>hIL27Ra_<br>VH<br>H12 | 977 | CAGGTGCAGTTGCAGGAATCCGGTGGCGGAAGTGTGCAGGCCGGGGGCTCCCTC<br>CGTCTGTCCTGCACCGCGTCAGGCGCTATCGCCTCCGGGTACATCGACTCCCGC<br>TGGTGCATGGCCTGGTTTCGTCAAGCGCCCGGCAAGGAGAGAAGGTGTGGCC<br>GCGATTTGGCCGGGCGGAGGCCTGACCGTGTACGCTGACTCCGTTAAGGGGCGT<br>TTTACTATCTCCCGTGACCACGCCAAGAATACATTGTATCTGCAAATGAATAAC<br>CTCAAGCCCGAGGACACTGCTATGTACTATTGTGCTGCCGGTTCCCCGCGCATG<br>TGTCCGAGCCTGGAGTTTGGCTTCGACTATTGGGGTCAAGGCACTCAGGTCACC<br>GTCTCCTCAGGCGGAGGGAGCCAAGTGCAGCTCCAGGAAAGCGGAGGTGGCTCC<br>GTGCAGGCTGGAGAGAGCCTGAGGCTGTCATGCCGCGCCAGCGGGTCTACCTAC<br>TCTAACTACTGTCTGGGCTGGTTTAGGCAGATTACCGGCAAAGAGAGAGGGG<br>GTCGCTGTTATCAACTGGGTGGGAGGGATGTTGTACTTCGCCGACAGCGTCAAG<br>GGTAGATTTACCGTCTCTCAGGACCAGGCTAAGAACACAGTATATCTGGAGATG<br>AACTCTCTTAAACCCGAGGACACTGCTATGTACTATTGTGCCACCGAGTCCGTG<br>TCTTCCTTCTCCTGCGGGGCTGGCTGACTAGACCTGATCGGGTGCCCTACTGG<br>GGTCAGGGTACACAGGTGACAGTCTCTAGC |
| DR591-<br>hIL27Ra_<br>VH<br>H12 | 978 | CAAGTTCAGCTTCAGGAAAGTGGCGGTGGCTCCGTACAGGCCGGGGGCAGTCTG<br>CGCCTGAGCTGCACCGCCAGCGGTGCCATCGCCAGCGGTCTACATCGACTCCAGG<br>TGGTGTATGGCTTGGTTCCGCCAAGCACCGGGCAAGGAGCGCGAAGGAGTTGCC<br>GCTATCTGGCCCGGCGGGGCCTGACCGTCTACGCCGACAGCGTGAAAGGTCGC<br>TTCACTATCTCTCGCGACCACGCCAAGAACACCTTGTACCTCCAAATGAATAAC<br>CTGAAGCCAGAGGACACTGCTATGTATTACTGCGCTGCCGGAAGTCCCCGTATG<br>TGTCCCTCTCTGGAGTTTGGGTTTGATTATTGGGGCAGGGCACACAGGTCACT |

TABLE 1B-continued

| Name | SEQ ID NO: | Sequence |
|---|---|---|
| | | GTGTCAAGCGGGGGTAGTGGCGGTTCCGGCGGTAGCGGCCAGGTGCAGCTTCAA<br>GAGAGCGGGGGCGGAAGCGTGCAGGCGGGCGAATCTCTCCGGTTGTCATGTAGA<br>GCGTCTGGCTCCACCTACTCTAACTACTGCCTGGGGTGGTTCAGACAGATTACG<br>GGGAAAGAGAGGGAAGGCGTGGCCGTTATAAATTGGGTAGGCGGAATGCTCTAC<br>TTCGCTGACTCTGTCAAGGGCCGGTTCACAGTGTCTCAGGACCAGGCCAAAAAT<br>ACTGTGTATCTGGAGATGAACTCTCTGAAACCCGAGGACACTGCCATGTATTAC<br>TGCGCCACGGAGAGCGTCTCCAGCTTCTCATGTGGAGGGTGGCTGACCCGCCCG<br>GACCGTGTACCCTACTGGGGTCAGGGAACACAGGTGACAGTGAGCAGC |
| DR591-<br>hIL27Ra_<br>VH<br>H13 | 979 | CAGGTGCAGTTGCAGGAGAGCGGAGGCGGGAGCGTCCAGGCCGGAGGCTCCCTT<br>CGCCTCAGCTGTACCGCGTCTGGAGCAATCGCCAGCGGCTACATTGACTCCCGT<br>TGGTGCATGGCATGGTTCCGCCAAGCGCCAGGCAAAGAGAGAAGGCGTGGCC<br>GCTATTTGGCCTGGGGGTGGACTCACAGTTTATGCAGACTCTGTGAAGGGCCGC<br>TTTACCATCAGTAGAGACCACGCCAAGAACACCCTGTATCTGCAAATGAACAAT<br>CTGAAGCCAGAGGACACCGCGATGTACTATTGCGCTGCCGGTTCTCCCAGGATG<br>TGTCCCTCATTGGAGTTCGGCTTTGATTACTGGGGCCAGGGAACCCAGGTCACC<br>GTATCTTCCGGTGGCGGATCACAGGTTCAGCTCCAGGAATCAGGAGGTGGCTCT<br>GTGCAGGCCGGGGGCTCCCTGCGGCTGTCTTGCGTGGCCTCCGGCTACGTCTCT<br>TGCGACTACTTTCTGCCTTCTTGGTATCGGCAGGCCCCTGGGAAAGAGCGGGAG<br>TTCGTCTCTATCATTGACGGCACCGGCTCCACATCCTACGCTGCGAGCGTGAAG<br>GGCCGCTTCACAGCATCCCAGGACAGGGAAAGAACATCGCTTATTTGCAGATG<br>AACAGCCTGAAGCCTGAGGACACAGCTATGTATTACTGTAAGGCCTCTTGTGTG<br>CGCGGAGAACCATCAGCGAGTACTGGGGACAAGGGACCCAGGTGACCGTATCT<br>TCA |
| DR591-<br>hIL27Ra_<br>VH<br>H13 | 980 | CAGGTGCAGTTGCAGGAGTCCGGCGGGGGCTCTGTCCAAGCTGGAGGCTCCTTG<br>CGTTTGAGCTGTACCGCTAGTGGAGCCATCGCGAGTGGCTACATCGACAGCAGA<br>TGGTGCATGGCCTGGTTCCGCCAAGCTCCCGGCAAGGAGAGGGAAGGCGTTGCT<br>GCAATCTGGCCCGGCGGTGGCCTGACCGTGTACGCGGATTCTGTCAAGGGGCGC<br>TTTACTATCAGCCGCGATCATGCTAAAAACACGCTTTATCTGCAAATGAATAAC<br>CTCAAACCAGAAGATACCGCGATGTACTATTGCGCAGCTGGTTCTCCCCGGATG<br>TGTCCCAGTTTGGAGTTTGGTTTCGATTACTGGGGTCAGGGCACTCAGGTGACC<br>GTGAGTTCCGGCGGATCTGGAGGCTCAGGAGGCTCCGGCCAGGTGCAGCTCCAG<br>GAGTCCGGCGGTGGCAGCGTACAAGCTGGCGGGTCCCTCCGTCTGAGCTGTGTG<br>GCAAGCGGTTATGTTAGCTGTGACTACTTTCTGCCAAGCTGGTATCGCCAAGCG<br>CCAGGCAAGGAGCGCGAGTTCGTGAGTATCATTGATGGCACCGGCAGCACCTCC<br>TACGCAGCCAGCGTGAAGGGACGGTTTACCGCCTCCCAGGATAGAGGAAAGAAC<br>ATCGCATACCTCCAGATGAACAGCCTGAAGCCGGAGGACACAGCCATGTATTAC<br>TGCAAGGCCTCTTGCGTGAGGGGCCGCACCATCAGCGAGTACTGGGGGCAGGGC<br>ACTCAGGTAACTGTCAGCTCA |
| DR591-<br>hIL27Ra_<br>VH<br>H14 | 981 | CAGGTGCAGCTTCAGGAGAGCGGTGGAGGCTCTGTCCAAGCTGGCGGTTCCCTG<br>AGACTTTCCTGCACCGCCTCCGGGGCCATCGCTTCCGGCTACATTGATAGCAGA<br>TGGTGTATGGCATGGTTCAGGCAGGCCCCTGGTAAAGAGCGCGAGGGCGTTGCC<br>GCAATCTGGCCTGGCGGAGGCCTGACCGTGTACGCCGACTCCGTGAAGGGCCGT<br>TTCACCATCTCTCGTGACCACGCCAAGAATACTCTGTATCTTCAGATGAATAAC<br>TTGAAACCTGAAGCACACAGCTATGTATTACTGCGCAGCCGGAAGCCCCACGCATG<br>TGCCCATCCCTGGAGTTTGGCTTCGATTATTGGGGCCAAGGCACCCAAGTGACA<br>GTCAGCAGTGGAGGCGGTTCCCAGGTTCAGTTGCAAGAGTCCGGTGGCGGAAGC<br>GTGCAGGCAGGCGGTAGCTTGCGCTTGTCCTGTGTGGCCTCCGGCTATGTGAGT<br>TGCGACTATTTCCTGCCTTCCTGGTATAGACAGGCCCCCGGCAAGGAACGCGAG<br>TTCGTGTCTATTATCGACGGCACCGGGAGCACATCCTACGCTGCGAGCGTCAAG<br>GGCCGCTTCACTGCGTCACAGGACAAGGGCAAGAACATCGCTTATCTCCAGATG<br>AACTCTCTGAAACCTGAGGATACAGCAATGTATTACTGTAAGGCTTCCTGCGTG<br>AGAGGCCGCGCCATTAGCGAGTACTGGGGGCAGGGCACTCAGGTAACCGTAAGC<br>AGC |
| DR591-<br>hIL27Ra_<br>VH<br>H14 | 982 | CAGGTTCAGCTTCAGGAGTCTGGGGGAGGCAGCGTGCAGGCAGGTGGCTCCCTT<br>CGCCTCAGCTGTACGGCTTCAGGTGCCATTGCTTCCGGTTACATTGATAGCAGG<br>TGGTGTATGGCCTGGTTCCGGCAAGCGCCCGGCAAAGAAAGAGAGGGTGTGGCA<br>GCCATCTGGCCAGGCGGTGGGCTTACCGTGTATGCCGATTCTGTTAAGGGCAGG<br>TTCACGATCTCCAGGGACCACGCCAAGAATACCCTGTATCTCCAAATGAATAAC<br>CTGAAGCCCGAGGACACTGCCATGTATTACTGTGCTGCGGGCTCCCCTCGTATG<br>TGTCCCTCTCTGGAGTTCGGGTTTGACTACTGGGGACAAGGAACACAGGTGACC<br>GTCTCCAGCGGGGGCAGCGGAGGTAGCGGCGGAAGCGGACAGGTACAGTTGCAG<br>GAGTCTGGCGGTGCTCCGTGCAGGCTGGCGGTTCACTGACTGTCCTGTGTG<br>GCCAGCGGATACGTGAGCTGCGATTATTTCTTGCCTTCCTGGTATCGCCAGGCC<br>CCTGGGAAGGAACGCGAGTTCGTGTCTATCATTGACGGAACCGGCTCCACGTCC<br>TATGCCGCTTCTGTCAAGGGTCGCTTTACAGCTTCCCAGGACAAGGGTAAAAAC<br>ATCGCTTACCTTCAGATGAACCCCTGAAGCCTGAAGATACCGCCATGTACTAT<br>TGTAAGGCCAGCTGCGTGCGGGCAGGGCTATCTCAGAGTATTGGGGTCAGGGC<br>ACGCAGGTGACAGTGTCCTCT |
| DR591-<br>hIL27Ra_<br>VH<br>H15 | 983 | CAGGTGCAGCTCCAGGAAAGCGGGGGAGGCTCCGTGCAGGCGGGCGGTAGCCTC<br>CGTCTGTCCTGCACTGCCTCAGGAGCCATTGCCTCTGGCTACATTGACTCCCGC<br>TGGTGTATGGCCTGGTTCCGCCAAGCGCCCGGAAAGGAAAGGGAGGCGTGGCT<br>GCAATTTGGCCAGGAGGTGGCCTGACCGTGTATGCGGATTCTGTGAAGGGACGC |

TABLE 1B-continued

| Name | SEQ ID NO: | Sequence |
|---|---|---|
| | | TTCACCATCAGCAGGGACCACGCTAAGAACACCCTGTACCTGCAAATGAATAAC<br>CTGAAACCCGAGGACACCGCCATGTACTATTGTGCCGCAGGCTCCCCCAGAATG<br>TGCCCTTCTCTGGAGTTCGGGTTCGACTATTGGGGTCAGGGGACCCAGGTGACC<br>GTCTCCTCTGGTGGGGGTAGCCAGGTGCAACTCCAGGAATCCGGCGGGGGCTCC<br>GTGCAGGCTGGCGGGTCTCTGCGCCTGAGCTGTGTGGCTTCCGGGTATGTGTCC<br>TGCGACTACTTCCTGCCTTCTTGGTATCGCCAAGCGCCGGGGAAGGAACGCGAG<br>TTCGTAAGCATCATTGATGGCACTGGATCAACAAGCTACGCGGCCTCTGTGAAA<br>GGCCGCTTCACAGCGAGCCAGGATAAGGGTAAGAACATCGCGTATTTGCAGATG<br>AACACTCTCAAGCCAGAAGACACCGCGATGTATTACTGCAAGGCCAGTTGTGTG<br>CGTGGCCGGGCCATCTCCGAGTATTGGGGGCAGGGCACCCAGGTCACCGTGTCC<br>TCC |
| DR591-<br>hIL27Ra_<br>VH<br>H15 | 984 | CAGGTCCAACTTCAGGAGTCTGGAGGCGGTTCCGTGCAGGCGGGCGGTAGCTTG<br>CGCCTGAGCTGTACCGCTTCAGGTGCCATCGCGAGCGGATACATCGACTCTCGC<br>TGGGTGTATGGCCTGGTTCCGCCAGGCCCCTGGCAAGGAACGTGAGGGTGTGGCT<br>GCCATTTGGCCCGGCGGGGGACTTACTGTGTACGCCGACTCCGTGAAGGGCCGT<br>TTCACCATCTCCCGTGACCACGCGAAGAACACCCTGTACTTGCAGATGAATAAC<br>CTCAAACCCGAGGATACCGCGATGTATTACTGTGCCGCTGGCAGCCCACGCATG<br>TGTCCCAGTCTGGAGTTCGGTTTTGACTATTGGGGGCAGGGTACACAAGTCACA<br>GTGTCCTAGCGGAGGCTCTGGTGGCTCCGGGGGTAGCGGACAGGTGCAGTTGCAG<br>GAATCTGGCGGTGGCAGTGTGCAGGCGGGTGGCAGCCTGCGCCTGTCCTGCGTT<br>GCTAGTGGGTATGTGAGCTGTGATTATTTCCTGCCATCTTGGTATCGCCAGGCC<br>CCCGGCAAAGAAAGAGAGTTCGTGTCCATCATTGATGGCACCGGCTCCACCAGT<br>TATGCAGCGTCTGTCAAAGGCAGTTCACTGCCAGCCAGGACAAGGGTAAGAAC<br>ATTGCTTATTTGCAGATGAACACCCTGAAGCCCGAGGACACGGCTATGTATTAC<br>TGTAAGGCCTCATGTGTGCGTGGCCGGGCGATTTCCGAGTACTGGGGACAAGGC<br>ACACAAGTGACCGTGTCCAGC |
| DR591-<br>hIL27Ra_<br>VH<br>H16 | 985 | CAAGTGCAACTCCAGGAGTCCGGGGGCGGGTCTGTGCAAGCTGGAGGCTCCCTG<br>CGCCTGAGTTGTACCGCGTCCGGTGCCATCGCTTCTGGTTATATTGATAGCAGA<br>TGGGTGTATGGCCTTGGTTCCGTCAAGCGCCAGGGAAAGAGAGGGGAGGGCGTGGCA<br>GCTATTTGGCCAGGAGGCGGACTGACCGTCTACGCAGACTCCGTCAAAGGCCGG<br>TTTTACAATCTCCAGAGACCACGCGAAAAACACTCTGTATCTCCAGATGAATAAC<br>CTGAAGCCAGAGGATACAGCAATGTACTATTGCGCGCTGGCTCACCCGTATG<br>TGCCCCAGTCTGGAGTTCGGGTTTGACTACTGGGGCCAGGGCACCCAAGTCACT<br>GTAAGCTCCGGCGGTGGCTCCCAGGTGCAGTTGCAGGAAAGTGGCGGAGGCAGC<br>GTGCAGGCCGGGGGCAGCCTGCGCCTCTCTTGTCGCGCATCCGGCAGTACCTAT<br>TCTAACTACTGTTTGGGTTGGTTTAGGCAGATTACCGGCAAGGAGAGGGAGGGG<br>GTGGCCGTTATCAACTGGGTCGGGGGCATGTTGTACTTTGCCGACTCTGTGAAG<br>GGTAGGTTCACTGTTTCTCAGGATCAGGCTAAGAACACTGTTTATCTTCAGATG<br>AACTCTCTGAAGCCAGAGGACACCGCTATGTATTACTGTGCCGCAGAGTCAGCC<br>AGCTCCTTTAGTTGTGGGGGCTGGCTGACCCGTCCCGACCGCGTCCCATACTGG<br>GGCCAGGGTACACAAGTGACTGTCTCCAGC |
| DR591-<br>hIL27Ra_<br>VH<br>H16 | 986 | CAGGTGCAACTTCAGGAGAGTGGGGGAGGCTCTGTTCAGGCAGGCGGGTCCCTG<br>CGCCTGAGCTGCACCGCCTCAGGTGCCATCGCCTCTGGCTATATTGATAGCCGT<br>TGGTGTATGGCCTGGTTCCGGCAGGCACCCGGCAAAGAACGCGAAGGGGTGGCC<br>GCTATCTGGCCTGGAGGTGGCCTGACCGTTTACGCTGACAGCGTGAAAGGAAGG<br>TTCACCATCTCCAGGGACCACGCTAAGAACACTGTACTTGCAGATGAATAAC<br>CTGAAACCTGAAGATACCGCCATGTATTACTGCGCCGCTGGCTCTCCACGCATG<br>TGTCCATCCCTGGAGTTCGGATTCGATTATTGGGGACAGGGCACCCAGGTCACC<br>GTGTCCTCTGGCGGATCTGGTGGCTCAGGGGGGCTCTGGCCAGGTCCAGTTGCAG<br>GAATCCGGTGGAGGCAGTGTTCAGGCCGGGGGCTCCCTGCGCCTGTCATGTCGG<br>GCCTCCGGCAGCACCTACTCCAATTACTGCCTCGGATGGTTCCGCCAGATCACC<br>GGCAAAGAGCGTGAAGGCGTGGCCGTCATCAACTGGGTGGGCGGGATGCTTTAC<br>TTTGCAGATTCCGTGAAGGGCAGATTTACGGTGTCTCAGGACCAGGCGAAGAAC<br>ACAGTGTATCTCCAGATGAACAGCCTCAAGCCTGAAGATACCGCTATGTATTAC<br>TGCGCCGCAGAGAGCGCTTCTTCCTTTAGCTGCGGCGGTTGGCTGACCAGGCCC<br>GACCGTGTTCCGTACTGGGGTCAGGGCACCCAGGTGACCGTATCCAGT |
| DR591-<br>hIL27Ra_<br>VH<br>H17 | 987 | CAAGTCCAGCTCCAGGAATCCGGCGAGGTAGCGTGCAGGCGGGTGGCAGCCTG<br>CGCCTGTCCTGTACTGCAAGCGGAGCCATCGCCTCTGGCTACATCGACTCACGC<br>TGGGTGTATGGCCTGGTTTCGCCAAGCGCCGGGTAAGGAGCGCGAAGGGGTGGCC<br>GCGATTTGGCCGGGCGGGGCCTGACCGTCTACGCCTGACAGTGTCAAGGGCCGC<br>TTCACCATCTCTCGGGATCACGCCAAGAACACTTTGTATCTGCAAATGAATAAC<br>CTGAAACCCGAAGACACCGCAATGTATTACTGCGCCGCTGGTAGTCCGCGTATG<br>TGTCCATCACTGGAGTTCGGCTTCGACTACTGGGGTCAGGGAACCCAGGTCACC<br>GTGTCCTCTGGTGGCGGTAGCCAGGTCCAGCTGCAAGAATCCGGTGGCGGGCTG<br>GTGCAGCCAGGTGGATCTCTGCGCTTGTCCTGTGCCGCAAGCGGTTTTACTTTC<br>TCACTGAGCGGCATGTCCTGGGTGAGGCAGGCTCCAGGCAAGGGCCTCGAATGG<br>GTCTCAGCCATTAGTAGCGGGGCGCATCCACCTATTACACAGATTCCGTGAAG<br>GGTAGATTCACGATTAGCCGCGACAATGCTAAGAATATGCTGTATCTTCAGTTG<br>AATAGCCTGAAGACAGAGGACACCGCTATGTATTACTGCGCGAAGGGCGGATCT<br>GGCTACGCGACGCCTCCAGGATGACAAGTCCGGGTTCCCAGGGCACACAGGTC<br>ACGGTCTCTAGC |

TABLE 1B-continued

| Name | SEQ ID NO: | Sequence |
|---|---|---|
| DR591-hIL27Ra_VH H17 | 988 | CAGGTGCAGCTCCAGGAGTCCGGCGGAGGCTCAGTCCAGGCTGGGGGCTCCCTC CGCCTGTCCTGTACGGCAAGTGGCGCTATCGCGAGCGGCTACATTGATTCACGC TGGTGCATGGCCTGGTTCAGGCAAGCTCCTGGGAAGGAGCGCGAGGGAGTGGCT GCCATCTGGCCAGGGGGTGGCCTGACTGTGTACGCGGACAGCGTGAAGGGTCGC TTCACAATCTCAAGGGACCACGCCAAGAATACCTTGTATCTTCAGATGAATAAC CTGAAACCCGAGGACACAGCCATGTACTATTGTGCAGCCGGTTCCCCGAGAATG TGCCCTAGTTTGGAGTTCGGCTTCGACTACTGGGGTCAGGGAACCCAGGTGACC GTGTCCAGTGGCGGGTCTGGGGGTTCCGGCGGGTCAGGCCAGGTCCAGCTTCAG GAATCCGGGGAGGCCTGGTTCAGCCAGGTGGAAGCCTTCGCCTGTCCTGCGCT GCATCCGGGTTCACATTCAGCCTGAGTGGCATGTCCTGGGTGAGACAGGCCCCA GGAAAGGGTCTGGAGTGGGTCTCTGCAATCAGCTCCGGCGGTGCTTCTACCTAT TACACCGACTCCGTGAAGGGCCGGTTCACTATTAGTCGCGACAACGCTAAGAAC ATGCTGTACCTGCAACTGAACTCCTTGAAGACAGAAGACACGGCCATGTATTAC TGCGCCAAGGGAGGTTCAGGTTACGGCGACGCCAGCCGCATGACCTCCCCTGGC TCTCAGGGGACTCAGGTTACAGTCTCCTCC |
| DR591-hIL27Ra_VH H18 | 989 | CAGGTCCAGCTCCAGGAAAGCGGAGGCGGGTCCGTCCAGGCTGGCGGTAGTTTG CGCCTCTCATGTACCGCCAGCGGCGCAATCGCTTCTGGATATATCGACTCTCGC TGGTGTATGGCCTGGTTCCGGCAGGCCCCCGGCAAGGAGAGGGAGGGAGTGGCA GCCATCTGGCCGGGTGGCGGGTTGACCGTGTATGCCGACTCTGTCAAGGGCCGC TTCACAATCAGCAGAGACCATGCCAAGAACACCCTGTACCTTCAGATGAATAAC CTGAAGCCCGAAGACACCGCCATGTATTACTGCGCCGCAGGCTCCCCAAGAATG TGCCCTAGTCTGGAGTTCGGCTTCGACTACTGGGGCCAGGGGACCCAGGTGACC GTCAGCTCTGGTGGAGGTAGCCAGGTGCAACTCCAGGAGAGCGGAGGCGGTAGC GTGCAGGCTGGCGGTTCCCTGCGCCTGAGCTGCGTGGCCTCTGGTTACGTTAGT TGCGACTATTTTCTGCCCAGCTGGTATCGTCAGGCTCCGGGCAAGGAAAGAGAA TTTGTCTCCATCATTGACGGAACTGGCTCTACAAGTTACGCCGCAAGTGTCAAG GGTCGCTTCACCGCCAGCCAGGACAAGGGTAAGAACATCGCCTACCTGCAAATG AACTCCCTCAAGCCAGAAGACACCGCGATGTACTATTGCAAGGCCAGCTGTGTA AGGGGCAGGGGCATTAGCGAGTACTGGGGCCAGGGAACCCAGGTGACCGTGTCC TCC |
| DR591-hIL27Ra_VH H18 | 990 | CAGGTCCAGCTCCAGGAGTCAGGCGGTGGATCTGTGCAGGCGGGCGGGAGCCTC AGGCTGAGCTGTACTGCCAGCGGCGCTATTGCCTCCGGTTACATTGACAGCCGC TGGTGTATGGCTTGTTTCGCCAAGCCCTGGAAAGGAGAGGGAGGGCGTTGCT GCCATCTGGCCTGGTGGGGGACTGACCGTCTATGCTGATTCAGTGAAGGGGCGT TTTTACCATCTCCCGCGATCACGCTAAGAACACACTGTACCTCCAGATGAACAAT TTGAAGCCCGAAGACACAGCCATGTACTATTGCGCCGCTGGGAGTCCCCGCATG TGCCCTAGCCTGGAGTTTTGGCTTCGACTATTGGGGCCAGGGCACTCAGGTCACT GTTAGTTCCGGTGGCTCTGGTGGCAGCGGTGGCAGTGGCCAAGTGCAGCTCCAG GAGTCCGGCGGAGGCTCAGTACAGGCCGGTGGCTCCCTTCGCCTGTCCTGCGTC GCCTCCGGTTACGTTAGTTGCGACTATTTTCCTGCCCAGCTGGTATCGCCAGGCA CCAGGGAAGGAGCGCGAGTTCGTGTCCATTATCGACGGAACAGGGTCTACATCT TATGCTGCCAGCGTGAAAGGAAGGTTCACCGCCTCCCAGGATAAGGGAAAAAAC ATCGCCTACCTCCAGATGAACAGCCTGAAGCCAGAGGACACGGCTATGTACTAT TGCAAGGCCTCCTGCGTGCGCGGCAGAGGTATCTCCGAATATTGGGGCCAGGGA ACACAGGTGACCGTGAGCAGC |
| DR591-hIL27Ra_VH H19 | 991 | CAGGTCCAGCTCCAGGAATCTGGTGGCGGAAGCGTGCAGGCCGGTGGGTCCCTG AGACTGAGCTGTACCGCGAGCGGGAGCTATCGCTTCGGGTACATTGACTCCCGG TGGTGCATGGCTGGTTCCGTCAGGCTCCAGGTAAGGAGCGGGAGGGCGTTGCT GCGATCTGGCCAGGAGGGGGATTGACTGTGTACGCTGACTCTGTCAAGGGTCGC TTTACTATCTCCCGCGACCACGCAAAGAATACCTTGTACTTGCAAATGAACAAT CTGAAGCCTGAGGACACCGCCATGTATTACTGTGCCGCTGGTAGCCCACGCATG TGTCCCAGTCTGGAGTTCGGGTTCGATTATTGGGGCCAGGGCACGCAGGTGACT GTGTCCTCTGGTGGAGGCAGCCAAGTGCAGTTGCAGGAGTCAGGCGGAGGGAGC GTGCAGGCGGGAGGTTCCCTGCGGCTGTCCTGTCGCGCGTCCGGTTCCACCTAC TCTAACTATTGCCTCGGTTGGTTCCGCCAGATCACCGGCAAGGAGCGCGAGGGA GTGGCGGTTATCAACTGGGTCGGCGGTATGCTGTACTTTGCAGACTCTGTTAAA GGACGCTTCACTGTGAGCCAGGACCAGGCAAAGAATACTGTGTACTTGCAGATG AACTCCCTGAAGCCAGAAGACACCGCCATGTATTACTGTGCTGCGGAATCTGTG AGTTCCTTCAGTTGCGGTGGGTGGCTCACTAGACCCGATAGAGTCCCATATTGG GGACAGGGTACTCAGGTGACTGTTAGCTCC |
| DR591-hIL27Ra_VH H19 | 992 | CAGGTGCAGTTGCAGGAGAGTGGCGGTGGCAGCGTGCAGGCGGGCGGGAGCCTG AGGCTGTCCTGTACTGCCTCTGGTCAATCGCTTCAGGTTACATTGACTCACGC TGGTGCATGGCTTGGTTTCGCCAGGCTCCAGGCAAGGAGCGCGAGGGTGTGGCC GCTATCTGGCCGGGTGGAGGCCTCACCGTGTACGCCGATACTGTCAAGGGACGC TTTACAATCTCCCGTGACCATGCGAAGAACACATTGTATCTTCAGATGAATAAC CTCAAACCCGAGGACACCGCTATGTATTACTGTGCAGCCGGAAGCCCTCGTATG TGTCCAAGCCTGGAGTTCGGCTTTGATTACTGGGGACAAGGCACCCAGGTGACA GTTTCTAGTGGAGGCTCTGGCGGTTCAGGAGGCTCCGGGCAAGTGCAGTTGCAG GAATCCGGGGTGGCTCCGTGCAGGCTGGGGGCTCTCTGCGGCTGTCTTGTCGT GCATCTGGTTCCACATATAGCAACTACTGCCTGGGCTGGTTCCGCCAGATTACG GGCAAGGAAAGAAGGGTGTTGCAGTGATAAATTGGGTAGGTGGAATGCTGTAC TTTGCCGACTCAGTGAAAGGGCGCTTTACAGTGAGCCAGGACCAGGCCAAGAAC ACAGTCTACTTGCAGATGAACAGCCTCAAGCCTGAAGACACCGCAATGTACTAT |

TABLE 1B-continued

| Name | SEQ ID NO: | Sequence |
|---|---|---|
| | | TGTGCTGCCGAGAGCGTCTCATCCTTTTCCTGCGGAGGCTGGCTGACCCGTCCA<br>GACCGCGTCCCCTACTGGGGCCAGGGCACCCAGGTGACTGTGTCCTCT |
| DR591-<br>hIL27Ra_<br>VH<br>H20 | 993 | CAAGTGCAGCTGCAAGAGTCCGGTGGAGGCAGCGTACAAGCGGGTGGCTCACTG<br>CGCCTGAGTTGTACCGCTTCTGGTGCAATCGCAAGCGGCTACATTGATTCCAGA<br>TGGTGCATGGCATGGTTTCGCCAAGCCCCAGGCAAGGAAAGGGAGGGCGTGGCC<br>GCAATCTGGCCTGGGGGTGGACTGACCGTGTATGCCGACAGCGTGAAGGGGCGC<br>TTTACCATCTCCCGTGACCACGCTAAGAACACACTGTACTTGCAGATGAATAAC<br>CTCAAGCCTGAAGACACTGCTATGTACTATTGCGCTGCCGGAAGTCCCCGCATG<br>TGTCCTAGTCTGAGTTTGGTTTTGATTACTGGGGCCAGGGCACCCAGGTGACC<br>GTTTCAAGCGGAGGGGGCAGTCAGGTTCAGCTCCAGGAATCTGGAGGTGGGCTT<br>GTCCAGCCAGGGGGCAGCCTCCGCCTGTCCTGTGCAGCGTCTGGCTTTACTTTC<br>AGCTCCTATCCCATGTCTTGGGTTAGACAGGCACCAGGCAAGGGCCTGGAGTGG<br>GTGTCCACAATCTCAAGCGGGGGCGATACAACCCTCTATGCCGATTCCGTGAAG<br>GGCAGATTCACAAGCTCTAGGGACAACGCCAAGAATACCTTGTACCTCCAGCTG<br>AACTCCCTGAAGACCGAGGACACTGCGATGTATTACTGCGCTAAGCGCATTGAT<br>TGTAACTCTGGGTATTGTTACAAGCGCTCTTATTGGGGACAGGGCACGCAGGTG<br>ACTGTCAGTTCC |
| DR591-<br>hIL27Ra_<br>VH<br>H20 | 994 | CAGGTGCAGTTGCAAGAGCGGCGGAGGCTCCGTTCAGGCAGGGGGCTCCTTG<br>CGCTTGTCTTGCACCGCATCCGGGGCCATTGCCTCAGGCTATATCGACTCCCGC<br>TGGTGTATGGCTTGGTTCCGGCAAGCGCCGGGTAAGGAGCGTGAGGGGGTGGCA<br>GCCATCTGGCCCGGAGGCGGTTTGACCGTGTATGCCGACTCTGTGAAGGGCGG<br>TTCACCATCTCTAGGGACCATGCGAAGAACACACTGTATCTCCAGATGAATAAC<br>CTGAAGCCCGAAGACACCGCGATGTATTACTGTGCCGCTGGCTCCCCCAGGATG<br>TGCCCCTCATTGGAGTTCGGTTTCGACTATTGGGGCAGGGAACTCAAGTGACC<br>GTAAGCTCCGGCGGGTCCGGCGGTAGTGGAGGCTCTGGGCAGGTGCAGTTGCAG<br>GAGTCAGGCGGGGCTTGGTGCAGCCCGGCGGTAGCCTGAGGCTGAGTTGCGCT<br>GCCTCAGGCTTTACCTTTTCCAGCTACCCTATGTCTTGGGTGCGCCAGGCTCCG<br>GGCAAGGGCTTGGAGTGGGTGTCCACCATCTCCAGCGGAGGCGATACGACCCTC<br>TATGCGGATTCCGTCAAAGGGCGCTTTACCTCCAGCCGCGATAACGCCAAGAAC<br>ACCTTGTACCTCCAGCTGAACTCCCTGAAGACCGAGGATACCGCAATGTACTAT<br>TGTGCAAAGCGGATTGATTGTAACAGCGGCTATTGCTACAAGAGGTCTTACTGG<br>GGCCAGGGCACCCAGGTGACAGTCTCCAGT |
| DR591-<br>hIL27Ra_<br>VH<br>H21 | 995 | CAGGTCCAGCTCCAGGAGAGCGGTGGCGGTTCCGTGCAGGCTGGTGGCAGTCTT<br>CGTCTCTCCTGTACCGCGTCCGGTGCCATCGCCAGTGGCTACATTGATTCTCGC<br>TGGTGCATGGCATGGTTCCGCCAAGCTCCCGGCAAGGAGCGCGAGGGCGTCGCT<br>GCCATTTGGCCAGGTGGCGGGCTGACCGTGTACGCGGACTGTGTGAAGGGTCGG<br>TTTACGATCAGCCGGGACCATGCTAAGAATACGCTCTACCTGCAAATGAACAAT<br>CTGAAACCCGAGGACACAGCAATGTACTATTGCGCAGCCGGAAGTCCTCGCATG<br>TGCCCATCTTTGGAGTTTGGCTTCGATTATTGGGGCCAGGGCACCCAGGTCACT<br>GTGTCCAGTGGGGGCGGTTCTCAGGTGCAGTTGCAGGAAAGTGGAGGTGGCCTTT<br>GTCCAACCTGGAGGGAGTCTGCGTCTCTCCTGCGCTGCCTCCGGGTTCACCTTT<br>AGTCTGTCCAGTATGTCTTGGGTCCGCCAAGCGCCCGGAAAGGGTCTGGAGTGG<br>GTCAGCGCGATTAGCTCCGGTGGAGCCAGTACTTATTACACCGACAGCGTGAAA<br>GGACGGTTTACCATCTCCCGCGATAATGCTAAGAATATGCTCTACTTGCAGCTG<br>AACAGCCTGAAGACCGAGGACACAGCGATGTATTACTGTGCCAAGGGAGGTTCT<br>GGCTATGGTGATGCCAGCCGCATGACCTCCCCTGGCTCCCAGGGAACTCAGGTT<br>ACTGTGTCCTCC |
| DR591-<br>hIL27Ra_<br>VH<br>H21 | 996 | CAAGTGCAGTTGCAGGAGAGCGGTGGCGGTAGCGTCCAAGCTGGGGGCAGTTTG<br>CGCCTGAGCTGTACTGCGTCTGGCGCTATTGCGAGCGGTTACATTGATTCCAGG<br>TGGTGTATGGCCTGGTTCAGGCAGGCACCGGGTAAGAGCGTGAGGGGGTGGCA<br>GCCATTTGGCCTGGCGGTGGACTGACCGTGTACGCGGACTGTCTGTCAAGGGACGT<br>TTCACGATCAGCCGCGATCACGCTAAAAACACCCTCTACCTCCAGATGAATAAC<br>CTGAAGCCTGAGGACACAGCTATGTATTACTGTGCTGCGGGCAGTCCCAGAATG<br>TGTCCCAGCCTGGAGTTCGGCTTCGACTACTGGGGCAAGGCACCCAGGTGACA<br>GTGTCCAGCGGGGCTCCGGCGGGTCTGGGGGCAGCGGCCAGGTGCAACTGCAA<br>GAGTCTGGCGGTGGACTTGTTCAGCCAGGGGGATCTCTGAGGCTCTCCTGCGCC<br>GCTTCCGGTTTTACCTTCTCCCTCAGCAGTATGTCCTGGGTCCGTCAGGCTCCA<br>GGCAAGGCCTGGAATGGGTTTCCGCTATTAGCTCTGGCGGTGCCTCCACCTAC<br>TATACGGACTCAGTCAAAGGCCGTTTCACGATCTCCAGGGACAATGCTAAGAAT<br>ATGCTCTACCTCCAGTTGAACTCTCTGAAAACGGAGGACACCGCTATGTACTAT<br>TGCGCCAAAGGGGGTTCCGGCTACGGCGACGCCTCCCGGATGACATCCCCTGGG<br>TCCCAGGGAACCCAGGTGACCGTGTCCAGC |
| DR591-<br>hIL27Ra_<br>VH<br>H22 | 997 | CAGGTGCAGTTGCAGGAGTCCGGCGGAGGCTCCGTGCAAGCTGGCGGTAGCTTG<br>CGGCTGAGTTGCACTGCCAGCGGTGCCATCGCGAGCGGGTACATCGACAGCAGG<br>TGGTGCATGGCCTGGTTCCGTCAAGCGCCAGGAAAGGAGAGGGAGGGCGTCGCA<br>GCCATCTGGCCGGGCGGAGGCCTGACCGTGTACGCAGATTCCGTCAAAGGCCGT<br>TTCACCATCTCCCGGACCACGCCAAGAACACCCTGTATCTCCAGATGAATAAC<br>CTGAAACCCGAGGACACCGCCATGTACTATTGTGCTGCGGGCTCACCCCGGATG<br>TGTCCCTCTCTGGAGTTCGGCTTCGATTATTGGGGCCAGGGCACCCAGGTCACC<br>GTGTCAAGTGGTGGCGGTTCCCAGGTGCAGCTGCAAGAGAGCGGCGGTGGCAGC<br>GTGCAGGCGGGCGGTAGCTTGCGCCTGAGCTGTCGCGCCTCCGGCAGCACTTAC<br>AGCAACTACTGCCTGGGCTGGTTCCGTCAGACTACAGGTAAGGAGCGTGAGGGC TABLE 1B-continued

| Name | SEQ ID NO: | Sequence |
|---|---|---|
| | | GTAGCGGTAATCAACTGGGTCGGGGGAATGCTTTACTTTGCGGACAGTGTGAAA<br>GGCCGTTTCACCGTGTCTCAGGACCAGGCTAAGAACACTGTGTACCTCCAGATG<br>AACTCTCTGAAGCCTGAGGACACGGCCATGTATTACTGTGCAGCGGAGTCCGTT<br>AGCTCCTTCTCTTGTGGCGGATGGCTGACCCGGCCAGACCGCGTGCCATATTGG<br>GGCCAAGGGACCCAAGTGACCGTGTCATCC |
| DR591-<br>hIL27Ra_<br>VH<br>H22 | 998 | CAGGTGCAGCTCCAGGAGTCCGGCGGTGGGTCCGTGCAGGCTGGTGGATCTCTT<br>AGACTGTCCTGTACCGCTTCTGGAGCGATTGCCTCAGGTTACATTGACAGTAGG<br>TGGTGTATGGCTTGGTTCCGTCAGGCTCCAGGCAAGGAACGCGAGGGCGTTGCT<br>GCCATTTGGCCAGGAGGCGGTCTGACTGTCTACGCTGACAGCGTAAAGGGCCGC<br>TTTACCATCTCTCGGGATCACGCGAAAAATACACTGTACCTCCAGATGAATAAC<br>CTGAAGCCGGAGGACACCGCCATGTATTACTGCGCTGCCGGGAGCCCCCGTATG<br>TGCCCTTCCCTGGAGTTCGGATTTGACTATTGGGGCCAGGGCACCCAAGTGACC<br>GTCAGCTCCGGTGGCTCTGGCGGTTCCGGGGGCTCTGGCCAAGTCAGCTTCAG<br>GAGTCAGGGGGTGGCTCTGTGCAGGCCGGTGGCAGCCTGCGTCTGAGCTGCCGT<br>GCCAGCGGCTCTACCTATTCCAACTACTGCCTGGGGTGGTTTCGGCAGACCACA<br>GGAAAGGAAAGAGAGGGTGTGGCAGTTATCAACTGGGTGGGAGGGATGTTGTAC<br>TTCGCCGACTCCGTCAAGGGGCGCTTCACCGTCAGTCAGGACCAGGCAAAGAAC<br>ACCGTGTACCTCCAGATGAACTCCCTGAAGCCTGAGGATACCGCCATGTATTAC<br>TGCGCCGCTGAGTCTGTGTCATCTTTCTCATGCGGTGGCTGGCTCACCCGCCCA<br>GACCGCGTGCCTTATTGGGGCCAGGGCACACAGGTCACCGTCAGCTCA |
| DR591-<br>hIL27Ra_<br>VH<br>H23 | 999 | CAGGTTCAACTCCAGGAAAGCGGCGGGGGCTCTGTGCAAGCTGGCGGAAGTTTG<br>CGTCTGTCCTGCACCGCCTCTGGAGCCATCGCCAGCGGCTACATCGACTCAAGA<br>TGGTGTATGGCCTGGTTCAGACAGGCTCCAGGAAAAGAACGCGAAGGCGTGGCC<br>GCTATCTGGCCCGGAGGTGGCCTGACCGTGTACGCTGACTCCGTCAAGGGCCGC<br>TTCACCATCTCCCGTGACCACGCAAAGAACACACTGTACCTCCAGATGAATAAC<br>CTGAAGCCCGAGGATACCGCCATGTACTATTGCGCTGCGGGCTCCCCTCGGATG<br>TGTCCCAGCCTGGAGTTCGGCTTCGACTATTGGGGACAGGGAACTCAGGTCACA<br>GTCAGCTCCGGCGGAGGCTCTCAGGTCTCCAGGAATCAGGTGGAGGCTCT<br>GTTCAGGCGGGCGGATCTCTTCGCCTGTCATGCCGTGCATCCAGATCCCCGTAT<br>GGCAACTATTGCCTGGGGTGGTTCCGCCAGAGTACAGGTAAGGAGCGCGAGGGC<br>GTGGCTGTTATCAACTGGGTCGGCGGAATGCTGTATTTTGCCGATTCCGTGAAG<br>GGTCGTTTCACAGTGAGCCAGGATCACGCCAAGAACACCGTGACCTTGCAGATG<br>AACTCCCTGAAGCCTGAAGATACCGCCATGTATTACTGTGCGGAGAGCGTG<br>TCCTCTTTTCTCTTGCGGCGGTTGGCTGACCAGGCCTGATCGTGTCCCCTACTGG<br>GGGCAGGGCACCCAGGTGACCGTCTCTAGC |
| DR591-<br>hIL27Ra_<br>VH<br>H23 | 1000 | CAAGTGCAGTTGCAGGAGTCAGGCGGAGGCTCTGTCCAGGCTGGAGGCTCTCTG<br>AGACTCTCCTGCACCGCATCCGGGGCCATCGCCAGCGGATATATCGACTCCAGA<br>TGGTGTATGGCGTGGTTTCGCCAAGCTCCGGGGAAGGAGCGTGAGGGTGTCGCT<br>GCGATCTGGCCTGGCGGGGACTGACCGTGTATGCTGATTCCGTAAAGGGCCGT<br>TTCACCATCAGCCGCGACCATGCCAAGAACACACTGTACCTCCAGATGAACAAT<br>CTTAAACCCGAGGACACTGCAATGTACTATTGTGCGGCTGGTTCTCCCCGCATG<br>TGTCCTTCCCTGGAGTTCGGCTTCGACTACTGGGGCAGGGCACCCAGGTCACC<br>GTGAGTAGCGGCGGGAGCGGCGGGAGCGGTGGCTCCGGCCAGGTGCAGCTTCAA<br>GAGTCCGGGGGTGGCTCCGGTGCAAGCTGGTGGAAGTCTTCGCCTGAGTTGCCGC<br>GCGTCCCGCTCCCCTTACGGCAATTATTGCCTGGGATGGTTTCGCCAATCCACC<br>GGGAAGGAGCGCGAGGGCGTGGCAGTAATCAACTGGGTGGCCGGTATGCTGTAC<br>TTTGCCGATTCTGTGAAGGGCAGATTTACCGTGTCTCAAGACCACGCCAAGAAC<br>ACTGTCACCTTGCAGATGAACTCACTGAAGCCAGAGGATACCGCTATGTATTAC<br>TGCGCTGCCGAATCAGTCAGCTCCTTCTCTTGCGGTGGCTGGCTGACCCGCCCT<br>GATAGGGTCCCCTATTGGGGCCAGGGCACCCAGGTCACCGTGTCCAGT |
| DR591-<br>hIL27Ra_<br>VH<br>H24 | 1001 | CAGGTCCAGCTCCAGGAGTCCGGCGGAGGTTCTGTCCAGGCCGGTGGATCACTG<br>CGTCTGTCTTGCACCGCCAGCGGCGCAATCGCGTCTGGCTATATCGACAGCCGT<br>TGGTGCATGGCTTGGTTTCGCCAGGCTCCCGGCAAGGAAAGGGAAGGGTGGCC<br>GCGATTTGGCCTGGGGGCGGTCTGACCGTCTACGCCGACAGCGTGAAGGGCCGC<br>TTTACCATCTCCCGCGACCACGCCAAGAACACATTGTACCTGCAAATGAATAAC<br>CTCAAGCCTGAGGACACAGCGATGTATTACTGTGCCGCTGGCTCACCCCGCATG<br>TGTCCGTCCCTGAGTTTGGGTTTGATTATTGGGGCCAGGGCACACAGGTGACT<br>GTGTCATCTGGAGGCGGTTCCCAGGTCCAGTTGCAGGAGTCTGGCGGAGGTCTG<br>GTGCAGCCAGGAGGCAGCCTGCGGCTGTCTTGTGCTGCGTCTGGTTTCACCTTC<br>TCTCACAGCGGCATGTCTTGGGTGCGCCAAGCACCGGGCAAGGGCCTGGAGTGG<br>GTCTCCACAATTAACTCCGGCGGGCCTCCACCTATTACACCGACTCTGTAAAG<br>GGTCGGTTTACCATTAGCCGCGATAACGCCAAAAATATGTTGTATTTGCAGCTT<br>AACTCCCTGAAGACCGAAGATACCGCTATGTATTACTGCGCAAAGGGTGGGAGC<br>GGTTACGGCGACGCCTCCCGCATGACCTCTCCGGGATCTCAGGGAACCCAAGTT<br>ACCGTGAGTAGT |
| DR591-<br>hIL27Ra_<br>VH<br>H24 | 1002 | CAGGTGCAGCTCCAGGAATCTGGAGGCGGTTCCGTGCAGGCAGGCGGTTCCCTG<br>AGGCTTAGTTGTACCGCCTCTGGGCGTCTGCGCCTCCGGCTACATTGACTCTCGC<br>TGGTGTATGGCCTGGTTCAGGCAGGCTCCAGGTAAGGAGCGCGAGGGTGTCGCG<br>GCTATTTGGCCTGGTGGCGGACTGACTGTGTACGCCGATTCTGTGAAGGGCCGG<br>TTTACTATTAGCAGGGATCATGCGAAAAATACCCTTTACTTGCAGATGAACAAT<br>CTGAAGCCGGAGGACACGGCCATGTACTATTGCGCCGCTGGCTCACCTAGAATG<br>TGTCCTAGCTTGGAGTTCGGGTTTGATTACTGGGGCCAGGGAACCCAGGTGACC |

TABLE 1B-continued

| Name | SEQ ID NO: | Sequence |
|---|---|---|
| | | GTCTCTAGCGGTGGGAGCGGCGGGAGCGGGGAAGCGGGCAGGTTCAGTTGCAG<br>GAATCAGGAGGCGGACTGGTGCAACCGGGAGGCTCCCTGCGCCTGTCTTGTGCT<br>GCCTCTGGTTTTACTTTTAGCCATAGCGGGATGTCCTGGGTTCGCCAGGCTCCA<br>GGCAAGGGCCTGGAGTGGGTATCTACCATCAACTCTGGAGGTGCCAGCACCTAT<br>TACACCGACAGCGTGAAGGGGAGGTTCACCATCTCCCGCGACAACGCTAAGAAC<br>ATGCTGTACCTCCAGCTCAACTCTCTGAAGACCGAGGACACCGCTATGTATTAC<br>TGCGCGAAGGGCCGGTTCCGGTTACGGAGACGCCTCCCGCATGACCAGTCCGGGT<br>TCCCAAGGTACACAGGTGACCGTGTCTAGC |
| DR592-<br>hIL27Ra_<br>VH<br>H1 | 1003 | CAGGTTCAACTCCAGGAGTCCGGGGGCGGTTCCGTGCAAGCTGGAGGTTCACTG<br>CGCCTGAGCTGCACTGCGCCAGGCTTCACATCAAATTCTTGTGGTATGGATTGG<br>TATCGGCAAGCCCCCGGAAAAGAGCGGGAGTTCGTGTCCAGTATTAGCACAGAC<br>GGTACGACCGGATATGCGGACTCTGTGAAAGGACGCTTCACGATTTCCAAAGAC<br>AAGGCCAAGGACACCGTGTACCTTCAGATGAACTCACTGAAACCAGAGGACACG<br>GGCATGTACTCCTGTAAGACGAAGGACGGAACAATCGCCACTATGGAATTGTGC<br>GATTTCGGCTATTGGGGCCAGGGGACGCAGGTTACCGTTTCTTCAGGGGGAGGG<br>AGTCAGGTTCAGTTGCAGGAGTCCGGCGGTGGCTTGGTGCAACCTGGGGGAAGC<br>CTGCGTCTTTCTTGTGCAGCCAGCGGCTTCACCTTCAGTTCATACCCCATGAGC<br>TGGGTCCGTCAGGCCCCCGGTAAAGGGCTGGAGTGGATCTCAACCATCTCTGCC<br>GGTGGCGACACCACGCTTTACGCTGACTCCGTCAAAGGCAGATTCACCAGTAGC<br>AGAGACAACGCGAAGAACACCCTCTATTTGCAGCTTAACTCCCTCAAGACCGAG<br>GACGCAGCTATCTACTATTGTGCTAAGAGGATTGACTGTAACAGCGGCTACTGT<br>TATCGTCGCAACTATTGGGGCCAGGGCACTCAGGTCACAGTGTCTTCC |
| DR592-<br>hIL27Ra_<br>VH<br>H1 | 1004 | CAGGTCCAGCTCCAGGAGAGCGGCGGAGGGTCTGTGCAGGCGGGCGGTAGTTTG<br>CGCTTGAGCTGTACCGCACCCGGATTCACCTCCAACAGCTGCGGTATGGACTGG<br>TATCGCCAGGCTCCTGGTAAAGAGCGTGAGTTCGTGTCTTCAATCAGCACCGAC<br>GGTACAACTGGGTATGCCGATTCCGTGAAAGGAAGATTCACCATCTCCAAGGAC<br>AAGGCCAAAGACACAGTTTATCTTCAGATGAACAGTCTGAAGCCCGAGGACACC<br>GGCATGTATTCTTGTAAGACTAAGGACGGGACGATTGCGACAATGGAACTGTGC<br>GACTTCGGTTACTGGGGCCAGGGGACTCAGGTAACTGTGTCAAGCGGAGGCTCT<br>GGCGGAAGTGGAGGCTCAGGACAGGTGCAGCTCCAGGAGTCAGGAGGGGCCTG<br>GTCCAGCCGGGCGGGTCTCTGCGCCTCTCTTGCGCTGCCTCTGGGTTCACATTC<br>AGCAGTTACCCTATGTCCTGGGTACGCCAGGCTCCAGGCAAAGGTCTGGAGTGG<br>ATCTCCACCATCAGTGCCGAGGCGATACCACTCTGTATGCCGACAGCGTGAAG<br>GGACGCTTTACCTCCTCACGCGATAATGCCAAGAACACTCTGTACCTGCAACTC<br>AATAGTCTGAAGACTGAGGACGCGGCCATCTATTACTGCGCCAAGCGCATTGAT<br>TGCAATAGTGGCTACTGTTACCGGCGCAACTATTGGGGACAGGGTACTCAGGTA<br>ACAGTCAGCTCC |
| DR592-<br>hIL27Ra_<br>VH<br>H2 | 1005 | CAGGTCCAACTGCAAGAGTCTGGAGGGGGCTCTGTGCAGGCCGGAGGCTCCCTT<br>CGCCTGTCTTGTACCGCCCCAGGTTTTACCTCAAACTCCTGCGGCATGGATTGG<br>TATAGACAGGCTCCTGGGAAAGAGAGGGAGTTCGTGTCTTCCATCAGCACCGAC<br>GGTACAACCGGCTACGCGGATTCCGTGAAAGGTCGCTTTACCATTTCAAAGGAC<br>AAAGCTAAAGATACCGTGTACCTCCAGATGAACTCACTGAAGCCCGAGGACACT<br>GGCATGTACTCTTGTAAGACCAAGGATGGCACCATCGCCACTATGGAGTTGTGT<br>GATTTCGGGTACTGGGGCCAGGGCACACAAGTGACCGTCTCCAGCGGTGGAGGC<br>AGCCAGGTGCAGCTTCAAGAGTCCGGCGGTGGGCTGGTCCAGCCAGGAGGCTCA<br>CTCCGCCTGTCCTGTGCGGCTTCCGGGTTTACCTTCTCACTGTCCGGCATGTCC<br>TGGGTCCGCCAGGCCCCCGGCAAAGGCCTTGAGTGGGTGTCCGCTATTAGCTCC<br>GGTGGAGCCAGCACTTACTATACTGACTCTGTTAAAGGCCGGTTTACAATCTCC<br>CGTGACAATGCCAAGAACATCCTGTATCTTCAGCTGAACAGTCTCAAGACAGAG<br>GATACTGCCATGTACTATTGTGCTAAAGGTGGCTCCGGCTACGGCGACGCGAGC<br>CGTATGACTTCTCCTGGCTCCCAGGGCACTCAGGTGACTGTTTCCAGC |
| DR592-<br>hIL27Ra_<br>VH<br>H2 | 1006 | CAGGTCCAGCTTCAGGAGAGCGGGGGTGGGAGCGTGCAGGCCGGGGGCTCTCTG<br>CGCCTGTCCTGCACAGCGCCCGGTTTTACGTCCAACTCTTGCGGCATGGATTGG<br>TATCGCCAAGCGCCTGGCAAGGAAAGAGAGTTTGTCAGCTCCATCAGCACCGAT<br>GGCACTACCGGCTACGCCGGATTCTGTAAAGGGTCGTTTCACCATCAGTAAGGAT<br>AAGGCTAAGGACACGGTGTACCTCCAGATGAACTCCCTCAAGCCCGAGGATACC<br>GGGATGTACTCTTGCAAGACCAAGGACGGCACCATCGCCACTATGGAGCTTTGC<br>GACTTCGGCTATTGGGGCCAGGGAACTCAGGTGACTGTGTCAAGTGGTGGGTCA<br>GGAGGTAGCGGAGGTTCTGGCCAGGTGCAGCTTCAGGAATCTGGCGGTGGGCTC<br>GTCCAGCCGGGAGGCTCTCTGCGCCTGAGCTGCGCAGCCTCTGGCTTTACCTTT<br>TCTCTGTCTGGCATGTCTTGGGTCCGCCAGGCACCTGGAAAGGGGCTGGAGTGG<br>GTTTCCGCCATCTCCTCGGTGCGCATCCACATATTACACCGACTCTGTCAAG<br>GGCCGCTTCACCATTTCACGCGATAATGCCAAGAACATCCTGTACCTTCAGCTG<br>AACTCCCTGAAGACCGAGGACACAGCTATGTATTACTGCGCTAAGGGAGGGTCC<br>GGCTACGGGGATGCGAGCAGAATGACCAGCCCTGGTTCACAAGGCACCCAGGTA<br>ACTGTTAGCAGT |
| DR592-<br>hIL27Ra_<br>VH<br>H3 | 1007 | CAAGTCCAACTTCAGGAGTCCGGCGGGGGCTCTGTGCAGGCTGGAGGGTCTCTG<br>CGCCTGTCCTGCACTGCACCTGGGTTCACTTCAAACTCTTGCGGCATGGACTGG<br>TATCGCCAGGCCCCAGGCAAGGAACGTGAGTTTGTGTCCAGCATTTCAACTGAC<br>GGCACAACCGGGTATGCTGATAGCGTGAAGGGTAGGTTTACCATCTCCAAGGAT<br>AAGGCCAAGGATACCGTGTACTTGCAGATGAACTCCCTCAAACCTGAGGATACC<br>GGAATGTATAGCTGCAAGACCAAAGATGGAACCATCGCTACTATGGAGCTGTGT |

TABLE 1B-continued

| Name | SEQ ID NO: | Sequence |
|---|---|---|
| | | GACTTTGGCTACTGGGGGCAGGGCACCCAGGTGACCGTGTCCAGCGGCGGTGGA<br>TCTCAGGTCCAGCTCCAGGAGAGCGGGGCGGGTCTGTGCAGGCAGGCGGGTCC<br>CTGCGTCTGTCATGCGTCGCGTCAGGCTACGTCTCCTGCGATTACTTCCTGCCT<br>TCCTGGTATCGCCAGGCCCCTGGCAAGGAAAGGGAGTTCGTCAGTATCATTGAC<br>GGAACCGGCTCCACCAGCTACGCTGCCTCCGTCAAGGGCCGCTTCACCGCCTCT<br>GAGGACAAAGGGAAGAACATCGCCTACCTCCAGATGAACAGTCTGAAACCAGAG<br>GATACTGCAATGTACTATTGCAAGGCCTCCTGTGTCCGTGGCCGTGCCGTTTCT<br>GAGTACTGGGGCCAAGGGACTCAGGTGACTGTCTCCTCC |
| DR592-<br>hIL27Ra_<br>VH<br>H3 | 1008 | CAGGTTCAGTTGCAGGAGAGTGGAGGGGGCTCCGTGCAGGCCGGTGGCTCCCTG<br>AGGCTGTCCTGCACAGCTCCCGGCTTCACCAGTAATTCCTGTGGCATGGACTGG<br>TATCGCCAGGCCCCCGGTAAGGAAAGAGAGTTTGTGTCCAGTATCTCAACCGAC<br>GGCACCACTGGCTATGCGGACTCCGTCAAGGGCAGGTTCACTATCTCCAAGGAT<br>AAGGCCAAAGACACAGTGTACCTCCAAATGAACTCTCTCAAGCCCGAGGACACG<br>GGCATGTATTCCTGTAAAACCAAGGACGGCACCATCGCTACTATGGAGCTGTGT<br>GATTTCGGATACTGGGGCCAGGGAACCCAGGTGACCGTGTCAAGCGGAGGTAGT<br>GGTGGCTCAGGCGGGTCCGGCAGGTCCAACTCCAGGAGTCTGGAGGCGGGAGT<br>GTGCAGGCTGGTGGCTCCCTGCGGCTGAGCTGCGTGGCTTCCGGGTATGTTTCT<br>TGCGATTACTTCCTGCCGAGCTGGTACAGGCAGGCTCCCGGTAAGGAGCGTGAG<br>TTCGTTTCCATCATTGACGGCACCGGGAGCACAAGCTACGCCGCTAGTGTGAAG<br>GGACGCTTCACGGCAAGCGAAGACAAGGGCAAAAACATCGCGTACTTGCAGATG<br>AACTCCTTGAAGCCCGAGGACACCGCTATGTATTACTGTAAAGCCTCATGCGTC<br>AGAGGGCAGGGCTGTCTCAGAGTACTGGGGTCAGGGCACGCAAGTGACAGTCTCT<br>TCC |
| DR592-<br>hIL27Ra_<br>VH<br>H4 | 1009 | CAAGTGCAACTCCAGGAGTCCGGCGGTGGGTCTGTGCAGGCTGGGGGCTCACTG<br>CGTCTGAGCTGCACCGCTCCCGGTTTTACCAGTAACTCTTGTGGTATGGACTGG<br>TATCGCCAGGCCCCCGGCAAGGAGAGGGAATTTGTCAGTTCCATCTCTACAGAC<br>GGCACTACAGGATACGCCGACTCCGTCAAGGGGCGGTTCACCATCTCAAAAGAT<br>AAAGCAAAGGACACAGTGTACCTTCAGATGAACAGCCTGAAACCTGAGGACACT<br>GGAATGTATAGCTGCAAGACAAAGGATGGAACAATCGCCACGATGGAGCTGTGT<br>GACTTCGGATACTGGGGCCAGGGGACACAGGTCACTGTGTCCTCTGGAGGCGGG<br>TCCCAGGTGCAGCTCCAGGAGAGCGGCGGAGGCCTGGTGCAGCCCGGCGAGTCC<br>CTTAGGCTGAGCTGTACGGCGAGCGGCTTTACTTTCAGCAACTACGCCATGAGC<br>TGGGTCCGTCAAGCGCCGGGGAAGGGGCTGGAGTGGGTTTCTGGCATCAACGTG<br>GCATACGGCATCACCTCCTATGCTGATAGCGTCAAGGGCCGCTTCACCATTTCC<br>AGAGATAATACCAAGAATACCCTCTACCTCCAGCTCAATTCCCTGAAGACCGAG<br>GACACTGCTATTTATTACTGTGTGAAGCACTCTGGCACCACAATTCCTCGCGGC<br>TTTATCAGCTATACAAAGAGAGGCCAGGGAACTCAGGTCACCGTCAGCTCT |
| DR592-<br>hIL27Ra_<br>VH<br>H4 | 1010 | CAGGTCCAGTTGCAGGAATCTGGCGGGGATCAGTGCAGGCCGGGGGCTCCCTG<br>CGTCTTTCTTGCACAGCCCCTGGCTTTACCTCCAATTCCTGTGGCATGGATTGG<br>TATCGGCAGGCCCCCGGCAAGGAGCGCGAGTTTGTCTCTAGCATTAGCACCGAC<br>GGCACCACTGGTTACGCTGACTCAGTGAAGGGACGGTTCACCATTTCCAAGGAC<br>AAGGCTAAAGACACAGTCTACCTTCAGATGAACAGTCTGAAGCCTGAGGATACA<br>GGGATGTACTCCTGTAAGACCAAGGACGGCACCATCGCAACGATGGAGCTGTGC<br>GACTTCGGCTATTGGGGCAAGGGACCCAGGTGACTGTGTCCTCTGGGGGCTCC<br>GGGGGCAGCGGAGGCTCCGGCCAAGTGCAACTCCAGGAGAGCGGCGGTGGACTG<br>GTGCAGCCAGGCGAGAGCCTCCGGCTTTCCTGCACCGCAAGCGGCTTCACTTTT<br>AGCAACTACGCTATGTCCTGGGTAAGGCAGGCTCCAGGTAAGGGCCTGGAGTGG<br>GTGAGCGGTATTAACGTGGCATACGGCATCACTTCCTACGCGGACAGCGTCAAG<br>GGCCGTTTTACTATCAGCAGGGATAATACTAAGAATACTCTGTACTTGCAGCTG<br>AACAGCCTGAAGACTGAAGATACTGCCATCTATTACTGCGTGAAGCACTCTGGA<br>ACAACCATTCCACGGGCTTCATCAGTTACACCAAGCGGGGCCAGGGCACTCAG<br>GTCACCGTGTCTTCC |
| DR592-<br>hIL27Ra_<br>VH<br>H5 | 1011 | CAAGTGCAGCTCCAGGAGTCCGGCGGTGGAAGCGTGCAGGCCGGAGGCTCTCTG<br>CGCTTGAGTTGCACCGCCCCTGGATTCACATCTAACTCCTGTGGTATGGATTGG<br>TACAGGCAGGCACCAGGCAAGGAACGTGAGTTCGTGTCTTCCATCAGTACCGAC<br>GGTACTACCGGCTACGCGGACTCCGTCAAAGGTAGATTTACGATCAGCAAAGAT<br>AAGGCTAAGGATACCGTGTATCTCCAGATGAACTCCCTGAAACCTGAGGATACA<br>GGTATGTATAGCTGCAAGACCAAGGACGGCACTATCGCGACTATGGAATTGTGT<br>GACTTTGGTTACTGGGGCCAAGGAACCCAGGTGACCGTCAGTAGCGGTGGCGGT<br>TCCCAAGTACAGCTGCAAGAGTCTGGAGGTGGATCTGTGCAGGCTGGGGGTAGT<br>CTTCGCCTGTCTTGTACCGCCAGCGGTTACGTGTCCTGTGACTACTTTCTGCCC<br>TCCTGGTACAGACAGGCTCCTGGTAAGGAGCGCGAGTTCGTGAGCGTCATCGAC<br>GGCACAGGGTCCACCAGTTACGCGGCATCCGTAAAGGGACGTTTCACCGCTTCC<br>AAGATAAGGGCAAAACATCGCTTATCTCCAGATGAACAGTTTGAAGCCTGAG<br>GACACAGCGATGTATTACTGTAAGGCTTCCTGCGTGAGAGGCCGCGCTATCTCT<br>GAATATTGGGACAGGGCACTCAGGTGACTGTGTCTTCA |
| DR592-<br>hIL27Ra_<br>VH<br>H5 | 1012 | CAGGTGCAGCTCCAGGAGTCTGGGGGTGGCTCCGTCCAGGCTGGCGGAAGCCTG<br>CGCCTGTCCTGTACCGCTCCGGGTTTCACAAGTAACAGTTGTGGAATGGATTGG<br>TATCGCCAGGCCCCCGGAAAGGAACGGGAGTTCGTCTCTAGCATCTCAACTGAC<br>GGCACTACCGGCTACGCCGACTCCGTCAAGGGCCGTTTCACCATTAGCAAGGAC<br>AAGGCCAAAGACACGGTGTACCTCCAGATGAACTCCCTGAAGCCCGAGGATACC<br>GGGATGTATAGCTGTAAGACCAAGGACGGTACTATCGCTACGATGGAGCTGTGT |

TABLE 1B-continued

| Name | SEQ ID NO: | Sequence |
|---|---|---|
| | | GACTTCGGATACTGGGGCCAGGGGACCCAGGTGACTGTTTCCAGCGGTGGCTCC<br>GGTGGGTCCGGCGGTTCTGGCCAGGTGCAGCTTCAGGAGTCCGGCGGTGGGAGC<br>GTCCAAGCTGGCCGGTTCCCTGCGCTTGAGTTGCACAGCATCTGGCTATGTGTCC<br>TGTGACTATTTCTTGCCATCCTGGTACAGACAAGCGCCTGGTAAGGAGAGAGAG<br>TTCGTGTCCGTGATTGATGGGACGGGCTCAACAAGCTATGCCGCTTCCGTTAAA<br>GGAAGGTTTACCGCTTCTCAAGATAAAGGGAAGAACATCGCTTATCTCCAGATG<br>AATAGCCTCAAACCAGAGGATACTGCTATGTATTACTGCAAGGCATCTTGTGTG<br>CGTGGACGTGCAATCTCCGAGTATTGGGGACAAGGCACCCAGGTTACAGTGTCT<br>TCA |
| DR592-<br>hIL27Ra_<br>VH<br>H6 | 1013 | CAGGTGCAGCTCCAGGAGTCTGGAGGTGGCTCCGTTCAGGCTGGCGGAAGCCTG<br>CGGTTGAGCTGTACTGCCCCTGGATTTACCTCCAATTCTTGTGGCATGGATTGG<br>TATAGACAGGCTCCAGGGAAGAGCGCGAGTTTGTCTCCAGCATTTCCACCGAT<br>GGTACGACTGGTTATGCCGACAGCGTTAAGGGTAGATTTACAATCAGTAAGGAC<br>AAAGCTAAGGACACAGTGTATTTGCAGATGAACTCTCTGAAACCGGAGGATACA<br>GGTATGTATAGTTGTAAGACAAAAGATGGCACCATTGCTACTATGGAACTTTGT<br>GACTTCGGCTACTGGGGACAGGGCACTCAGGTAACAGTCTCTAGCGGTGGAGGC<br>TCTCAAGTGCAGCTTCAGGAGTCTGGCGGAGGCCTCGTCCAGCCGGGAGGCTCC<br>TTGCGCCTGAGCTGTGCCGCTTCTGGTTTTTCATTTAGCTCCTATGCTATGAAA<br>TGGGTGCGCCAGGCTCCCGGCAAGGGCCTGGAGTGGGTCTCCACGATTTCCTCT<br>GGGGGGCTCAAGCACCAACTACGCCGACAGCGTAAAGGGCCGTTTTACCATCTCT<br>CGGGACAACGCCAAAAACACCCTGTACCTTCAGTTGAACTCACTGAAAATCGAG<br>GATACTGCAATGTATTACTGTGCCAAGGCATCGTCCCAACCGGAGCTACAATG<br>GAAAGGGGCCAGGGGACCCAGGTCACCGTGAGTAGC |
| DR592-<br>hIL27Ra_<br>VH<br>H6 | 1014 | CAGGTGCAGTTGCAGGAATCTGGTGGAGGCAGCGTGCAAGCTGGAGGCTCTCTG<br>AGGTTGAGCTGCACCGCCCCTGGGTTTACAAGCAACTCATGTGGCATGGACTGG<br>TATCGGCAAGCGCCTGGGAAAGAGCGCGAATTTGTAAGCTCTATCTCTACTGAC<br>GGCACAACCGGCTACGCAGATAGCGTGAAGGGCAGGTTCACCATCTCAAAGGAT<br>AAAGCCAAGGATACCGTGTACCTGCAAATGAACTCCCTTAAACCCGAGGATACC<br>GGCATGTATAGCTGCAAGACCAAGGACGGCACCATCGCAACGATGGAGCTGTGC<br>GACTTCGGTTATTGGGGACAGGGAACCCAGGTGACCGTTAGTTCCGGTGGCTCA<br>GGCGGTAGCGGAGGCAGTGGCCAGGTGCAGTTGCAAGAGAGCGGAGGTGGGCTG<br>GTGCAGCCAGGGGGCTCCCTGCGTCTGTCCTGCGCAGCCAGCGGCTTTAGCTTT<br>TCCAGCTATGCCATGAAATGGGTTCGGCAAGCGCCTGGGAAGGGTCTGGAATGG<br>GTGTCCACTATCTCCTCAGGGGGCTCCTCTACAAACTACGCAGATTCAGTGAAG<br>GGTCGGTTTACTATTTCTAGGGACAACGCGAAGAACACCCTGTACCTTCAGTTG<br>AACTCCCTCAAGATTGAGGATACTGCCATGTACTATTGCGCGAAGGCCATCGTA<br>CCCACCGGCGCTACAATGGAGAGGGCCAGGGCACCCAAGTAACTGTCTCCTCA |
| DR592-<br>hIL27Ra_<br>VH<br>H7 | 1015 | CAAGTGCAGTTGCAGGAGAGCGGTGGGGGATCTGTCCAGGCCGGAGGCAGTCTC<br>CGCCTGTCCTGCACTGCCCCTGGCTTCACCTCTAACAGTTGTGGCATGGACTGG<br>TATCGCCAGGCCCCTGGTAAAGAGCGCGAATTTGTCAGCTCAATCAGTACACAGAT<br>GGCACAACTGGTTATGCTGACAGCGTTAAGGGCCGCTTTACGATCAGCAAAGAC<br>AAGGCTAAAGATACTGTGTACCTCCAGATGAACAGCCTCAAGCCTGAAGACACC<br>GGAATGTATAGCTGTAAGACCAAGGACGGCACCATTGCGACAATGGAACTGTGC<br>GACTTTGGCTATTGGGGCCAAGGGACCCAGGTCACAGTCAGCAGTGGAGGGGGC<br>AGCCAGGTGCAGTTGCAGGAATCAGGGGGTGGCCTTGTGCAGCCTGGCGGGAGT<br>CTGCGCCTGTCATGTGCGGCCTCCGGGTTCACCTTCAGCTCCTACCCAATGTCT<br>TGGGTGAGGCAGGCACCTGGCAAGGGCCTGGAGTGGATCAGCACTATCAGCGCA<br>GGCGGTGACACCACTCTGTACGCAGACAGCGTGAAGGGAAGATTCACCAGTAGC<br>CGCGATAACGCGAAGAACACACTGTATCTCCAGCTCAATTCACTCAAGACCGAG<br>GACACTGCCATCTACTATTGTGCCAAACGCATTGATTGTAATTCTGGCTACTGC<br>TATCGGCGTAACTACTGGGGACAGGGCACCCAGGTTACCGTCAGTTCC |
| DR592-<br>hIL27Ra_<br>VH<br>H7 | 1016 | CAGGTTCAGCTTCAAGAGAGTGGAGGTGGGTCCGTCCAGGCCGGAGGCTCACTG<br>CGGCTGTCTTGCACCGCTCCTGGTTTCACTAGCAACTCCTGCGGCATGGATTGG<br>TATAGGCAAGCCCCTGGTAAGGAACGTGAGTTTGTTTCTTCCATCTCCACAGAT<br>GGTACTACCGGGTATGCTGACAGTGTGAAAGGCCGTTTTACCATCTCCAAGGAC<br>AAGGCAAAGGACACCGTGTACCTCCAGATGAACAGTCTTAAACCCGAGGACACC<br>GGCATGTACTCTTGTAAGACAAAGGATGGCACAATCGCCACTATGGAGCTGTGT<br>GATTTCGGGTACTGGGGCCAGGGCACACAGGTGACTGTGTCAAGCGGGGAAGC<br>GGAGGCAGCGGTGGCTCAGGCCAGGTCCAGCTCCAGGAGTCCGGCGGTGGACTG<br>GTTCAACCGGGTGGCAGCCTCCGTCTGTCCTGCGCCGCGAGTGGATTCACGTTC<br>AGTAGCTACCCCATGTCTTGGGTCAGACAGGCTCCCGGCAAAGGTCTCGAATGG<br>ATCTCTACAATCTCTGCCGGTGGGACACAACCCTGTATGCGATAGCGTGAAA<br>GGGAGATTCACCAGCAGTAGGGACAACGCTAAGAACACCCTGTATCTTCAGCTG<br>AACAGCCTGAAAACCGAAGACACCAGCGATCTATTACTGTGCAAAGAGAATTGAT<br>TGCAACAGCGGGTATTGCTACCGTCGCAACTATTGGGGCAGGGAACCCAAGTC<br>ACTGTGTCCTCC |
| DR592-<br>hIL27Ra_<br>VH<br>H8 | 1017 | CAGGTGCAGCTCCAGGAATCCGGTGGAGGTTCTGTGCAGGCCGGTGGCAGCCTC<br>CGTCTTAGCTGCACCGCTCCGGGGTTTACCTCCAACAGCTGTGGTATGGATTGG<br>TATCGTCAGGCCCCTGGTAAGGAGCGGGAGTTTGTGTCTTCCATTTCAACTGAT<br>GGCACCACTGGTTACGCCGACAGCGTAAAGGGTCGTTTCACAATCAGTAAGGAT<br>AAGGCAAAGGACACCGTCTATTTGCAGATGAACAGCCTGAAGCCGAAGACACA<br>GGGATGTACTCTTGCAAGACAAAGGACGGCACGATTGCTACGATGGAGCTGTGT |

TABLE 1B-continued

| Name | SEQ ID NO: | Sequence |
|---|---|---|
| | | GACTTCGGCTACTGGGGCCAGGGTACACAGGTGACCGTGTCCAGCGGCGGGGGC<br>AGTCAGGTTCAGTTGCAGGAGTCCGGCGGTGGCAGCGTCCAGGTGGGCGGTAGC<br>CTGCGCCTGTCCTGTGCTGCATCCGGCTTTACCTTCTCTAGTTATCCAATGAGT<br>TGGGTCCGCCAGGCTCCAGGGAAAGGTCTGGAATGGATCTCCACCATTTCCGCA<br>GGTGGGGACACCACACTGTACGCCGATAGCGTGAAGGGCCAGATTCACCGCTCC<br>AGAGACAATGCCAAAAACACTTTGTACCTCCAGCTGAATAGCCTGAAGACCGAG<br>GATACCGCCATCTACTATTGTGCCAAGCGTATTGATTGTAATTCCGGCTATTGT<br>TATCGCAGAAACTACTGGGGCCAGGGCACACAGGTCACTGTATCTAGC |
| DR592-<br>hIL27Ra_<br>VH<br>H8 | 1018 | CAGGTGCAGCTCCAGGAGAGCGGCGGTGGCTCTGTCCAGGCTGGGGGAAGTCTG<br>CGTTTGTCTTGCACTGCACCCGGATTCACCTCAAATTCCTGCGGTATGGATTGG<br>TACAGACAAGCGCCTGGCAAGGAGCGTGAATTTGTAAGCTCCATTAGCACCGAC<br>GGGACCACTGGCTATGCTGATAGCGTGAAGGGCCGCTTCACCATTTCTAAGGAT<br>AAGGCTAAAGACACCGTGTACCTCCAGATGAACTCCTTGAAGCCAGAGGATACC<br>GGGATGTATTCTTGTAAGACCAAGGACGGCACCATCGCAACTATGGAACTCTGT<br>GACTTCGGTTACTGGGGCAGGGAACCCAAGTGACAGTCTCTTCCGGGGGCTCC<br>GGCGGTTCTGGCGGATCTGGGCAGGTGCAACTTCAGGAATCCGGTGGAGGTAGC<br>GTCCAGGTGGGAGGCTCCCTGCGCCTGAGTTGTGCCGCAAGTGGCTTCACCTTC<br>TCATCCTACCCCATGTCTTGGGTACGCCAGGCTCCCGGCAAGGGCCTGGAGTGG<br>ATCTCCACCATCTCCGCCGGAGGTGACACTACCCTGTACGCCGACTCCGTGAAG<br>GGCCGCTTTACAAGCTCCCGTGACAACGCTAAGAATACACTGTACCTCCAGCTT<br>AATTCACTGAAGACCGAAGACACGGCTATTCTACTATTGCGCCAAGCGCATTGAT<br>TGTAACAGCGGGTACTGTTACAGGAGAAACTATTGGGGACAGGGCACACAGGTG<br>ACTGTGTCCTCC |
| DR592-<br>hIL27Ra_<br>VH<br>H9 | 1019 | CAGGTTCAGCTCCAGGAGAGCGGCGGAGGCAGCGTGCAGGCTGGTGGCAGTCTG<br>CGCCTGAGCTGCACAGCCCCCGGCTTCACCAGTAACAGCTGTGGAATGGACTGG<br>TATCGTCAAGCGCCTGGCAAGGAAAGGGAGTTCGTGTCTAGTATCAGCACCGAT<br>GGCACCACAGGATACGCCGACTCCGTGAAGGGACGCTTCACTATCTCAAAGGAT<br>AAGGCAAAAGATACAGTGTATCTCCAGATGAACTCCCTGAAGCCTGAAGACACA<br>GGCATGTACTCTTGTAAGACCAAGGACGGCACTATCGCTACTATGGAGTTGTGC<br>GACTTCGGATACTGGGGACAAGGAACCCAGGTCACCGTATCCTCAGGGGGAGGT<br>TCACAGGTGCAGCTTCAGGAGTCCGGTGGCGGTTCTGTGCAGAGTGGAGGCTCC<br>CTGCGTTTGAGTTGCGCAGCCAGTGGCTTCACCTACTCTACTAGCAACAGCTGG<br>ATGGCGTGGTTCCGCCAGGCCCCCGGCAAAGAACGCGAGGGCGTTGCCGCTATT<br>TACACCGTGGGCGGTTCCATTTTCTACGCCGATTCCGTGCGTGGCAGGTTTACT<br>ATCTCTCAGGATGCCACTAAAAATATGTTCTACCTGCAAATGAACACACTGAAG<br>CCCGAGGACACCGCTATGTATTACTGCGCAGCCGCTTCGGCCGCCTGAGAGGC<br>AAGTGGTTTTGGCCCTACGAGTACAATTACTGGGGTCAGGGCACCCAGGTGACG<br>GTGTCTAGC |
| DR592-<br>hIL27Ra_<br>VH<br>H9 | 1020 | CAGGTGCAACTCCAGGAGTCTGGAGGGGGCTCTGTCCAGGCCGGAGGCTCTCTC<br>CGTCTGAGCTGCACCGCTCCCGGCTTCACCAGTAATAGCTGTGGGATGGACTGG<br>TACAGACAGGCTCCAGGCAAGGAGAGAATTTGTCAGCTCCATTTCTACTGAT<br>GGGACTACGGGCTACGCCGACTCCGTGAAGGGCCGCTTTACCATCTCTAAGGAT<br>AAGGCTAAGGACACCGTATATTTGCAGATGAACTCCCTGAAGCCAGAAGATACT<br>GGCATGTATAGCTGCAAGACGAAGGATGGAACCATCGCCACTATGGAATTGTGC<br>GATTTCGGTTACTGGGGCCAGGGAACACAGGTGACTGTGAGTTCCGGGGGCTCA<br>GGCGGGTCTGGAGGCTCTGGACAGGTGCAACTCCAGGAGAGCGGAGGCGGTTCA<br>GTCCAGTCTGGGGCTCCCTTCGCCTGAGTTGCGCTGCCAGTGGCTTTACCTAC<br>AGTACCAGCAACTCCTGGATGGCGTGGTTCAGACAGGCACCCGGAAAGGAACGC<br>GAAGGCGTGGCTGCCATCTACACAGTCGGGGGCTCCATCTTCTACGCTGACTCC<br>GTTAGAGGCCGCTTCACCATTTCTCAGGATGCCACCAAAAATATGTTCTATCTG<br>CAAATGAACACCTTGAAGCCCGAGGACACCGCCATGTATTACTGCGCAGCTGCC<br>AGCGGACGCTTCGCGGTAAGTGGTTCTGGCCGTATGAGTATAACTACTGGGGA<br>CAGGGCACCCAGGTCACGGTGAGTTCT |
| DR592-<br>hIL27Ra_<br>VH<br>H10 | 1021 | CAAGTGCAGTTGCAGGAAAGTGGAGGCGGTTCCGTGCAGGCAGGAGGCAGTCTG<br>AGGCTGAGTTGTACCGCGCCTGGCTTTACCTCAAACAGTTGCGGCATGGACTGG<br>TATAGGCAGGCCCCAGGCAAGGAGCGCGAGTTTGTCTCAAGCATCTCCACCGAT<br>GGAACCACTGGCTACGCCGACTCCGTCAAGGGAAGGTTCACTATCTCCAAGGAT<br>AAGGCCAAGGACACCGTGTATCTCCAGATGAACTCATTGAAGCCAGAAGACACC<br>GGGATGTACTCCTGTAAAACCAAGGACGGCACGATTGCGACAATGGAACTGTGT<br>GATTTCGGTTACTGGGGTCAGGGAACCAGGTGACCGTGTCTGCAGGGGGCGGT<br>TCCCAGGTTCAGCTCCAGGAGAGCGGTGGGGGCTCTGTGCAGGCCGGTGGAAGT<br>CTGCGTCTGAGCTGTCGCGCCTCTGGCTCCACATACTCCAACTATGCCTGGGA<br>TGGTTTCGGCAAATCACGGGTAAAGAAAGAGGGCGTGGCTGTCATCAACTGG<br>GTGGGCGGAATGCTGTACTTCGCCGATAGTGTGAAGGGGCGCTTCACCGTTTCC<br>CAGGATCAAGCTAAAAACACACTTTACCTTCAGATGAACAGTCTGAAACCCGAA<br>GACACCGCAATGTATTACTGTGCCGCTGAGAGTGTCAGTTCCTTCTCATGCGGA<br>GGTTGGCTTACGAGGCCTGATCGCGTGCCGTATTGGGGCCAGGGGACCCAGGTG<br>ACCGTGAGTTCT |
| DR592-<br>hIL27Ra_<br>VH<br>H10 | 1022 | CAGGTGCAGTTGCAGGAATCCGGCGGAGGCTCCGTGCAGGCTGGGGGAAGCCTG<br>AGACTTAGCTGCACTGCTCCGGGATTTACGAGCAACAGCTGTGGCATGGACTGG<br>TACAGACAGGCCCCTGGGAAGGAGCGCGAGTTCGTGTCAAGCATCAGCACTGAC<br>GGCACAACTGGGTACGCTGATAGCGTGAAGGGCCGTTTTACCATCTCCAAGGAT |

TABLE 1B-continued

| Name | SEQ ID NO: | Sequence |
|---|---|---|
| | | AAGGCCAAAGACACTGTCTACCTGCAAATGAACTCCCTCAAGCCTGAGGACACC<br>GGAATGTACTCCTGTAAGACTAAGGACGGGACCATTGCCACGATGGAGCTTTGT<br>GACTTCGGCTATTGGGACAGGGAACCCAGGTCACCGTCTCTAGTGGAGGCAGC<br>GGCGGTAGTGGCGGGTCCGGCCAGGTTCAGCTCCAGGAGTCCGGTGGCGGATCT<br>GTGCAAGCAGGAGGCAGCCTGCGCCTTAGCTGCCGTGCGAGCGGCAGCACTTAC<br>AGCAATTATTGTCTGGGTTGGTTTCGTCAGATCACTGGTAAAGAACGGGAGGGC<br>GTGGCCGTCATCAACTGGGTCGGCGGTATGCTGTACTTCGCGGACAGCGTCAAA<br>GGCCGGTTTACCGTGTCTCAGGACCAGGCGAAGAACACATTGTACCTCCAGATG<br>AATAGCCTGAAGCCTGAGGATACAGCTATGTATTACTGTGCAGCGGAGTCCGTC<br>TCTTCATTCAGCTGTGGTGGATGGCTCACGAGACCGGATAGAGTGCCTTACTGG<br>GGCCAGGGCACCCAGGTGACCGTGTCCAGC |
| DR592-<br>hIL27Ra_<br>VH<br>H11 | 1023 | CAGGTGCAGTTGCAGGAGTCTGGTGGCGGTTCCGTTCAGGCAGGCGGTTCCCTG<br>AGACTGTCCTGCACCGCCCCTGGTTTTACCTCCAACTCCTGCGGGATGGATTGG<br>TATCGCCAGGCACCAGGCAAGGAACGCGAGTTCGTATCTTCCATTAGCACTGAC<br>GGCACAACTGGTTACGCCGATTCAGTCAAGGGGCGCTTTACAATCAGTAAGGAC<br>AAGGCTAAGGATACCGTTTACTTGCAGATGAATAGCCTGAAACCAGAGGACACC<br>GGAATGTACTCTTGCAAAACTAAAGACGGCACCATTGCAACTATGGAACTCTGT<br>GACTTTGGGTATTGGGGTCAAGGCACTCAAGTGACCGTCTCCTCTGGCGGGGGC<br>TCTCAGGTCCAGTTGCAGGAAAGCGGCGGAGGGAGCGTGCAGGCTGGAGGTAGT<br>CTCAGGCTGTCTTGCCGCGCAGCGGAAGCACCTACTCAAACTACTGCCTTGGC<br>TGGTTTAGACAGAGCACTGGTAAGGAGCGGGAGGGAGTGGCCGTCATCAACTGG<br>GTCGGTGGGATGCTGTATTTCGCTGATAGCGTAAAGGGAAGATTTACGGTAAGC<br>CAGGATCACGCAAAGAACACCGTGACCCTCCAGATGAACTCTCTGAAGCCCGAG<br>GACACTGCCATGTACTATTGCGCAGCCAATCCGTCAGTTCCTTCTCCTGCGGC<br>GGATGGCTGACCCGCCCCGGAAGAGTTCCATATTGGGGTCAGGGGACCCAGGTG<br>ACAGTTTCTTCT |
| DR592-<br>hIL27Ra_<br>VH<br>H11 | 1024 | CAGGTGCAACTCCAGGAGAGCGGTGGAGGTAGCGTGCAGGCTGGCGGTTCCCTG<br>CGGCTGTCCTGCACCGCTCCGGGTTTTACCTCCAACTCCTGCGGGATGGATTGG<br>TACAGACAGGCCCCCGGAAAGGAGCGCGAGTTTGTGTCTTCCATTAGCACCGAC<br>GGCACAACCGGCTATGCAGACAGTGTCAAGGGACGGTTCACAATCTCCAAGGAC<br>AAAGCTAAAGACACGGTGTATCTTCAGATGAACAGCTTGAAGCCTGAAGATACT<br>GGTATGTATTCCTGCAAAACCAAGGATGGTACTATCGCCACTATGGAACTCTGC<br>GATTTCGGATATTGGGGACAGGGGACCCAGGTGACGGTGTCTAGCGGGGGCTCT<br>GGTGGGTCTGGAGGCTCTGGTCAGGTGCAACTCCAGGAGAGCGGGGCGGAAGC<br>GTTCAGGCCGGGGGCAGCCTGCGGCTGTCCTGCCGGGCTAGTGGATCTACGTAC<br>TCCAACTACTGCCTGGGATGGTTTCGCCAATCTACTGGAAAGGAGCGTGAGGGG<br>GTGGCCGTCATCAACTGGGTGGGCGGAATGTTGTATTTTGCCGATTCTGTCAAA<br>GGAAGGTTCACTGTGTCTCAGGACCATGCCAAGAACACCGTCACCCTCCAGATG<br>AACTCTTTGAAGCCGGAAGATACCGCTATGTATTACTGCGCGGCAGAAAGCGTG<br>AGTAGCTTCTCTTGCGGTGGGTGGCTGACACGTCCGGGTAGGGTGCCGTACTGG<br>GGCCAGGGAACTCAGGTAACCGTCTCATCC |
| DR592-<br>hIL27Ra_<br>VH<br>H12 | 1025 | CAGGTCCAACTCCAGGAATCCGGCGGGGGCTCCGTACAGGCAGGTGGCAGTCTG<br>AGGCTTTCCTGCACTGCCCCTGGTTTCACCAGCAACAGCTGTGGGATGGACTGG<br>TATCGCCAGGCTCCCGGCAAAGAGCGGGAGTTCGTCAGCTCTATCTCAACCGAC<br>GGCACAACCGGGTATGCCGACTCCGTTAAAGGCCGGTTCACCATCAGCAAAGAC<br>AAGGCCAAGGATACAGTCTACCTCCAGATGAACAGCCTGAAGCCTGAGGATACC<br>GGAATGTATAGTTGCAAAACTAAGGATGGCACTATCGCCACTATGGAGTTGTGC<br>GATTTCGGATACTGGGGACAGGGCACCCAGGTTACCGTCTCATCTGGAGGGGGC<br>TCCCAGGTGCAGCTGCAAGAATCCGGCGGAGGCAGTGTCCAGGCTGGCGAATCC<br>CTCCGCTTGAGCTGTCGTGCCAGCGGTAGTACCTACTCCAATTACTGCCTGGGT<br>TGGTTTCGCCAGATCACCGGCAAGGAACGTGAAGGCGTGGCCGTCATCAACTGG<br>GTAGGGGGTATGCTCTACTTCGCTGACTCCGTGAAGGGACGCTTCACGGTGAGT<br>CAGGACCAGGCTAAAAACACCGTGTACCTTGAAATGAACTCCTTGAAGCCCGAG<br>GACACCGCTATGTATTACTGCGCCACAGAGTCTGTTTCTTCCTTCTCATGCGGA<br>GGCTGGCTGACTCGTCCAGACCGCGTGCCCTACTGGGGCCAGGGGACCCAGGTG<br>ACCGTGTCCTCA |
| DR592-<br>hIL27Ra_<br>VH<br>H12 | 1026 | CAAGTTCAGTTGCAGGAGAGTGGAGGCGGTTCTGTCCAGGCTGGGGGTAGTTTG<br>CGGTTGAGTTGCACCGCGCCTGGGTTCACCTCCAACAGCTGTGGTATGGATTGG<br>TATCGCCAGGCCCCCGGCAAGGAGCGCGAGTTCGTGAGTTCCATCAGCACCGAC<br>GGCACCACTGGTTACGCAGACTCAGTGAAGGGAAGATTCACCATCAGCAAAGAC<br>AAAGCCAAGGACACTGTGTATCTTCAGATGAATAGCCTCAAGCCGGAGGATACT<br>GGCATGTATTCCTGCAAGACCAAGGACGGCACCATCGCTACGATGGAGTTGTGT<br>GATTTCGGGTACTGGGGACAGGGAACCCAGGTAACTGTGAGTAGCGGAGGTAGC<br>GGGGGAAGCGGCGGGTCAGGCAGGTACAGCTTCAGGAGTCCGGCGGTGGGTCC<br>GTTCAGGCCGGTGAGTCCTTGCGCCTGAGCTGCCGCGCCAGCGGTTCCACCTAC<br>AGTAACTATTGTCTGGGCTGGTTTCGTCAGATCACAGGCAAGGAGCGCGAGGGC<br>GTTGCTGTCATTAACTGGGTTGGCGGAATGCTGTATTTTGCCGACAGCGTGAAG<br>GGTCGTTTCACGGTATCCCAAGACCAAGCAAAGAACACTGTCTATCTTGAAATG<br>AACAGTCTGAAACCAGAAGACACCGCCATGTACTATTGTGCCACCGAGTCCGTA<br>TCCAGTTTCTCCTGCGGCGGATGGCTGACCAGACCTGACCGTGTGCCATACTGG<br>GGACAGGGGACACAGGTGACTGTGTCCAGC |

TABLE 1B-continued

| Name | SEQ ID NO: | Sequence |
| --- | --- | --- |
| DR592-hIL27Ra_VH H13 | 1027 | CAGGTGCAGCTCCAGGAGTCCGGGGGAGGCTCTGTGCAGGCCGGGGGTTCCCTG<br>AGACTTTCATGTACTGCACCAGGCTTTACCTCAAATTCTTGCGGGATGGACTGG<br>TACAGGCAGGCCCCCGGTAAGGAGCGGGAGTTTGTGTCTTCCATTTCCACCGAT<br>GGTACAACCGGCTACGCGGACTCTGTGAAGGGCCGCTTTACCATTTCTAAGGAC<br>AAGGCTAAAGACACCGTCTATCTCCAGATGAACTCTTTGAAGCCTGAAGACACA<br>GGCATGTATAGCTGCAAGACAAAGGATGGCACCATTGCCACGATGGAGTTGTGC<br>GACTTTGGCTATTGGGGTCAGGGCACCCAGGTCACTGTGTCTTCCGGCGGGGGC<br>TCTCAGGTCCAACTCCAGGAGAGCGGGGGAGGGTCTGTTCAGGCTGGTGGCTCA<br>CTGCGCCTCAGTTGCGTGGCCTCTGGATACGTGTCCTGTGACTACTTTCTGCCC<br>TCTTGGTACAGACAGGCCCCAGGCAAAGAGCGCGAGTTCGTGAGCATCATTGAC<br>GGTACTGGCTCTACAAGCTACGCGGCCTCCGTCAAGGGCCGTTTCACTGCCTCC<br>AAGACAGAGGTAAAAACATCGCTTATCTCCAGATGAACAGCCTGAAGCCCGAG<br>GATACGGCTATGTACTATTGCAAGGCCAGCTGTGTACGTGGACGCACTATCTCT<br>GAGTACTGGGGCCAGGGGACACAAGTGACGGTGTCCTCC |
| DR592-hIL27Ra_VH H13 | 1028 | CAGGTGCAGCTTCAAGAGAGCGGAGGCGGGTCTGTGCAGGCTGGTGGGTCCCTC<br>CGCCTGTCATGCACTGCCCCCGGCTTCACTTCTAACAGCTGCGGCATGGACTGG<br>TATCGCCAGGCCCCAGGCAAAGAGCGCGAGTTTGTATCATCCATCTCCACCGAC<br>GGCACGACTGGCTACGCCGACTCCGTGAAGGGCCGGTTCACCATCAGCAAGGAC<br>AAAGCCAAGGATACCGTGTACCTCCAGATGAACTCCCTCAAACCTGAAGACACT<br>GGGATGTACTCATGCAAGACAAAAGACGGTACGATTGCCACTATGGAGCTGTGT<br>GATTTCGGATACTGGGGACAGGGAACTCAGGTGACCGTTTCCTCTGGAGGCAGT<br>GGAGGGAGCGGAGGCTCCGGCCAGGTGCAGCTGCAAGAGAGCGGTGGCGGTAGC<br>GTGCAAGCCGGAGGCTCCCTCCGTCTTTCTTGTGTCGCGAGCGGCTACGTGAGC<br>TGTGATTACTTTCTGCCCAGCTGGTATCGTCAAGCGCCAGGCAAAGAGCGCGAA<br>TTTGTGTCTATTATCGACGGCACCGGCAGCACGAGCTACGCAGCCTCCGTGAAG<br>GGACGTTTCACTGCTTCACAGGATCGCGGCAAAAACATTGCTTACCTCCAGATG<br>AACTCCCTGAAGCCTGAGGACACAGCAATGTATTACTGTAAGGCCTCCTGTGTG<br>CGTGGACGCACCATCTCAGAGTACTGGGGACAGGGAACCCAGGTGACCGTATCT<br>TCC |
| DR592-hIL27Ra_VH H14 | 1029 | CAGGTTCAGCTTCAGGAGTCCGGGGGTGGCTCCGTCCAAGCTGGTGGCTCACTG<br>CGCCTGTCCTGCACCGCCCCTGGCTTCACCTCCAATTCCTGCGGAATGGACTGG<br>TATCGCCAGGCCCCAGGCAAGAACGCGAGTTCGTCAGTAGCATCTCTACTGAT<br>GGAACCACAGGCTACGCCGGACAGCGTGAAGGGCCGTTTCACTATCTCCAAGGAC<br>AAGGCCAAGGACACCGTGTACCTTCAAATGAACTCCCTGAAGCCCGAGGATACT<br>GGAATGTACTCCTGTAAGACCAAGGACGGGACTATCGCCACTATGGAGCTGTGT<br>GACTTCGGATATTGGGGCCAGGGCACGCAGGTGACCGTCAGCTCTGGGGGCGGG<br>TCCCAGGTCCAGCTTCAGGAAAGTGGAGGCGGGTCCGTGCAGGCCGGAGGTTCC<br>CTCCGCCTGTCATGTGTCGCAAGCGGCTACGTGTCTTGCGACTACTTCCTGCCC<br>TCCTGGTATCGCCAGGCTCCGGGCAAGGAGAGAGAGTTCGTAAGCATCATTGAT<br>GGCACCGGCTCTACTTCTTACGCCGCTAGTGTGAAGGGCCGCTTCACAGCGTCC<br>CAGGATAAGGGTAAAAACATCGCTTACTTGCAGATGAATAGCCTGAAGCCTGAG<br>GACACGGCAATGTATTACTGTAAGGCCTCCTGTGTTAGAGGCCGCGCTATTTCT<br>GAATACTGGGGACAGGGCACTCAGGTGACAGTCTCCTCC |
| DR592-hIL27Ra_VH H14 | 1030 | CAGGTGCAGCTTCAGGAGTCCGGTGGGGGCTCTGTGCAGGCTGGAGGTTCCCTT<br>CGCCTGTCATGTACTGCCCCTGGGTTCACTTCTAACTCCTGTGGTATGGACTGG<br>TATCGTCAGGCCCCTGGGAAGGAGCGTGAGTTCGTCAGCTCCATCTCTACTGAT<br>GGCACTACCGGCTATGCCGATTCTGTGAAGGGGCGTTTTACCATCAGCAAGGAC<br>AAGGCCAAGGATACCGTGTACCTGCAAATGAACAGCTTGAAGCCTGAGGACACT<br>GGCATGTATTCTTGTAAAACCAAAGACGGCACCATCGCCACAATGGAGCTGTGT<br>GACTTTGGCTACTGGGGCCAGGGCACTCAAGTGACCGTGTCCTCAGGCGGGTCT<br>GGCGGATCTGGGGGAAGCGGACAGGTGCAGCTTCAGGAGAGCGGAGGTGGCTCT<br>GTCCAGGCCGGTGGGTCCCTGAGACTGTCTTGCGTGGCCAGTGGGTACGTGAGC<br>TGCGATTACTTCCTCCCCAGTTGGTATAGGCAGGCCCCTGGAAAGGAACGTGAG<br>TTCGTAAGCATCATTGACGGCACCGGCTCTACTTCTTATGCGGCCTCCGTAAAG<br>GGCCGCTTCACTGCTTCCCAGGACAAGGGTAAGAATATCGCCTACCTTCAGATG<br>AACAGCCTGAAACCCGAAGCACGGCTATGTATTACTGCAAGGCTTCCTGCGTA<br>AGAGGGGAGAGCAATCTCCGAGTATTGGGGCCAGGGCACCCAGGTGACTGTGTCT<br>TCA |
| DR592-hIL27Ra_VH H15 | 1031 | CAGGTGCAGCTCCAGGAGAGCGGCGGGGGCTCCGTACAAGCGGGCGGTTCCCTC<br>CGTCTGTCTTGTACCGCCCCAGGCTTCACCAGTAACTCCTGTGGCATGGACTGG<br>TACAGACAGGCTCCTGGCAAAGAAAGAGAGTTCGTATCCAGCATCTCCACCGAC<br>GGCACCACAGGCTACGCGGATTCAGTTAAGGGCAGATTTACGATCTCCAAGGAT<br>AAGGCTAAAGATACTGTGTACCTCCAGATGAATAGCCTGAAGCCGGAAGACACC<br>GGCATGTATAGCTGTAAGACTAAGGATGGCACCATTGCCACAATGGAGCTGTGC<br>GACTTCGGCTACTGGGGTCAGGGAACACAGGTGACGGTGTCCTCTGGTGGCGGT<br>AGCCAGGTTCAGTTGCAGGAATCTGGAGGTGGCTCTGTGCAGGCCGGTGGATCT<br>CTGCGTCTGTCTTGCGTGGCCTCCGGCTACGTGAGTTGCGACTATTTCCTTCCC<br>AGCTGGTATCGCCAGGCTCCAGGCAAGGAACGCGAGTTTGTGTCCATTATCGAC<br>GGAACAGGCAGCACATCCTACGCAGCTAGTGTTAAGGGTAGATTCACTGCGAGC<br>CAGGACAAGGGCAAAAACATCGCTTATCTTCAGATGAATACCCTCAAACCTGAG<br>GACACCGCCATGTATTACTGCAAGGCCAGCTGTGTGCGTGGCCGCGCTATCTCT<br>GAATATTGGGGCCAGGGCACCCAGGTGACAGTTTCCTCT |

TABLE 1B-continued

| Name | SEQ ID NO: | Sequence |
|---|---|---|
| DR592-hIL27Ra_VH H15 | 1032 | CAGGTGCAGCTCCAGGAGAGCGGCGGAGGCTCAGTGCAGGCCGGGGGTTCATTG AGGCTGTCCTGCACCGCCCCAGGGTTTACTAGCAACTCTTGTGGGATGGATTGG TATCGTCAGGCCCCTGGGAAGGAACGTGAGTTCGTTTCTAGTATCTCAACCGAT GGTACAACCGGCTATGCAGACTCCGTAAAGGGCCGGTTCACGATCTCCAAAGAT AAGGCTAAGGACACTGTTTATCTGCAAATGAACTCCCTGAAGCCTGAGGACACC GGCATGTACTCCTGTAAGACTAAGGACGGCACCATCGCTACGATGGAGTTGTGC GACTTCGGATATTGGGGTCAGGGAACCCAGGTTACTGTGTCTAGCGGGGGCAGC GGTGGCAGCGGGGGATCTGGCCAGGTGCAGTTGCAGGAATCCGGGGGCGGTTCA GTGCAGGCAGGAGGCTCTCTTCGGTTGTCCTGCGTCGCGAGTGGCTATGTGTCT TGTGATTACTTCCTGCCATCCTGGTATCGTCAGGCCCCAGGGAAGGAACGTGAG TTCGTGTCCATCATTGATGGCACTGGCAGTACTTCCTACGCCGCTTCCGTGAAG GGTAGGTTTACAGCGAGTCAGGATAAGGGTAAGAACATCGCCTATCTCCAGATG AACACCCTGAAACCGGAGGACACAGCCATGTACTATTGCAAGGCCTCTTGTGTG CGTGGCCGCGCAATTAGCGAGTACTGGGGACAGGGTACACAGGTTACCGTCTCC TCC |
| DR592-hIL27Ra_VH H16 | 1033 | CAGGTCCAGCTCCAGGAGAGTGGTGGGGGCAGCGTGCAGGCCGGAGGCTCTCTT AGACTCTCTTGCACCGCCCCCGGCTTCACATCCAACTCCTGTGGACATGGACTGG TATCGCCAGGCTCCCGGCAAGGAGAGGGAATTTGTGTCCAGCATTTCTACCGAC GGAACCACAGGCTACGCTGACAGCGTTAAGGGACGTTTCACTATCAGCAAGGAT AAGGCCAAGGACACCGTATACCTCCAGATGAACTCCCTCAAACCCGAGGACACC GGCATGTATAGCTGTAAAACCAAGGATGGAACCATCGCGACTATGGAGCTGTGC GATTTCGGCTACTGGGGCCAGGGCACTCAAGTGACTGTTTCTAGCGGCGGGGGC AGCCAGGTGCAGCTTCAGGAGTCTGGCGGAGGCAGCGTCCAAGCTGGAGGTAGC CTGCGGCTCTCCTGTCGCGCTTCTGGCTCTACGTACAGTAATTATTGCCTGGGT TGGTTCAGACAGATCACCGGCAAAGAACGCGAGGGTGTTGCAGTCATCAACTGG GTTGGGGGAATGCTGTATTTTGCCGACAGTGTGAAGGGCAGGTTCACGGTCAGC CAAGACCAGGCCAAGAATACCGTCTACCTCCAGATGAACTCTTTGAAACCCGAA GACACCGCCATGTACTATTGTGCTGCGGAGTCAGCTTCATCTTTCTCTTGCGGA GGCTGGCTGACCCGTCCAGACCGCGTACCTTACTGGGGCCAGGGGACCCAGGTG ACCGTCTCCTCC |
| DR592-hIL27Ra_VH H16 | 1034 | CAAGTCCAGCTGCAAGAGAGTGGAGGGGGCAGCGTTCAGGCCGGAGGCTCTCTG CGTCTTTCATGCACCGCGCCCGGTTTCACTTCCAACTCCTGCGGCATGGACTGG TATCGGCAGGCCCCAGGCAAGGAAAGGGAGTTCGTAAGCTCCATCTCCACTGAT GGAACAACCGGCTATGCCGATTCCGTCAAGGGCCGCTTCACCATCAGCAAGGAT AAGGCAAAAGACACTGTATCTGCAAATGAACTCTCTGAAGCCCGAAGACACC GGAATGTACTCTTGTAAAACTAAGGACGGCACCATTGCCACTATGGAGCTGTGT GATTTCGGGTACTGGGGCCAGGGCACCGGTGACGGTCTCTAGCGGGGGCTCA GGGGGCTCTGGTGGCTCTGGTCAGGTGCAGCTCCAGGAGTCCGGTGGCGGAAGC GTGCAGGCTGGAGGTAGTCTGCGCCTGTCTTGTCGTGCCAGCGGCAGCACATAT AGCAATTACTGCCTTGGCTGGTTTAGACAGATTACTGGTAAGGAGCGGGAGGGC GTGGCCGTAATAAATTGGGTTGGCGGGATGCTCTATTTTGCAGACTCAGTCAAG GGCCGCTTCACAGTGTCCCAGGATCAGGCCAAGAACACCGTGTATCTCCAGATG AACTCCCTGAAGCCGGAAGACACCGCCATGTACTATTGTGCCGCAGAGTCCGCT TCCTCTTTCTCTTGCGGCGGATGGCTGACACGTCCTGATCGTGTGCCCTATTGG GGACAGGGCACACAGGTCACCGTGTCCTCC |
| DR592-hIL27Ra_VH H17 | 1035 | CAGGTTCAGCTGCAAGAGAGCGGCGGTGGCTCTGTGCAGGCTGGTGGCAGCTTG AGACTGTCCTGTACTGCGCCTGGCTTCACTTCCAATTCTTGCGGCATGGACTGG TATAGACAAGCTCCGGGAAAAGAACGCGAATTTGTGTCTTCCAGCACCGAC GGAACTACAGGCTATGCTGACAGCGTGAAGGGACGCTTTACCATCTCCAAGGAC AAGGCGAAGGATACCGTCTATTTGCAGATGAACAGTCTGAAACCAGAAGACACC GGCATGTATTCCTGCAAAAACCAAAGATGGCACAATCGCCACTATGGAACTCTGT GATTTTGGCTACTGGGGCCAAGGGACCCAAGTTACCGTGTCTTCCGGCGGAGGC AGCCAAGTCCAGTTGCAAGAGTCAGGTGGCGGTCTGGTCCAGCCGGAGGCTCT CTGAGGCTGAGTGTGCCGCTTCCGGTTTCACATTCTCCCTGAGCGGTATGTCC TGGGTACGCCAGGCTCCCGGCAAGGGCCTCGAATGGGTGTCCGCGATCAGCTCT GGCGGGGCCTCCACTTATTACACAGACAGCGTTAAGGGGCGCTTCACAATCAGC CGCGATAACGCAAAGAATATGTTGTACTTGCAACTCAATTCTCTCAAGACAGAA GACACCGCGATGTATTACTGTGCTAAAGGGGGTTCCGGCTATGGCGATGCCTCT CGTATGACTTCACCCGGTAGCCAGGGAACCCAGGTGACCGTCTCTAGC |
| DR592-hIL27Ra_VH H17 | 1036 | CAGGTGCAGCTCCAAGAGTCTGGGGGCGGTTCTGTGCAGGCAGGCGGGTCCTTG AGACTCTCTTGCACCGCCCAGGCTTTACCAGCAATTCCTGTGGAATGGATTGG TACAGGCAAGCGCCCGGTAAAGAACGCGAGTTCGTCAGCTCTATTAGCACAGAC GGAACCACTGGCTATGCTGACTCAGTTAAGGGCCGGTTCACCATCAGTAAGGAT AAAGCCAAGGACACCGTGTACCTTCAGATGAACTCTCTGAAGCCCGAGGACACT GGCATGTATAGCTGTAAGACAAAAGACGGAACAATCGCGACTATGGAGTTGTGT GACTTCGGATACTGGGGTCAGGGAACGCAGGTGACCGTGTCCAGCGGCGGTTCT GGGGGTAGCGGGGGCAGCGGACAAGTTCAGCTCCAGGAAAGCGGAGGCGGGCTC GTGCAGCCTGGGGGCTCCCTCCGCCTGTCCTGTGCAGCCTCAGGCTTCACGTTT TCACTGTCTGGCATGAGCTGGGTTCGCCAGGCTCCCGGCAAAGGACTCGAATGG GTGTCCGCCATCTCTTCCGGCGGAGCCTCCACCTATTACACAGATTCCGTCAAA GGACGCTTCACTATCTCACGTGATAACGCGAAGAATATGTTGTACCTTCAGTTG AACTCCCTGAAAACCGAGGATACAGCCATGTATTACTGCGCTAAGGGCGGAAGC |

TABLE 1B-continued

| Name | SEQ ID NO: | Sequence |
|---|---|---|
| | | GGATACGGAGACGCCTCCCGCATGACATCCCCTGGTTCCCAGGGGACACAGGTGACCGTGTCCTCA |
| DR592-hIL27Ra_VH H18 | 1037 | CAGGTCCAGCTCCAGGAATCCGGGGCGGGTCCGTGCAGGCGGGTGGCTCCCTTAGGCTCTCCTGTACCGCCCCCGGCTTCACCAGCAACTCCTGTGGGATGATTGGTATCGGCAAGCACCGGGCAAGGAGCGCGAGTTTGTGTCCTCTATCAGCACCGACGGCACTACCGGCTACGCAGACAGCGTAAAGGGTCGTTTCACAATCTCCAAGGATAAGGCAAAGGACACAGTGTATCTTCAGATGAACAGCCTGAAGCCCGAGGATACTGGCATGTATTCCTGCAAGACCAAAGACGGAACCATCGCCACTATGGAACTCTGTGATTTCGGCTACTGGGGGCAAGGCACCCAGGTGACGGTGTCTAGCGGCGGTGGCAGCCAGGTGCAGTTGCAGGAGTCTGGAGGGGGCTCCGTGCAGGCTGGAGGCAGCCTGCGCCTGTCTTGCGTTGCTTCCGGGTATGTCTCTTGCGATTACTTCCTGCCTAGCTGGTACAGACAGGCCCCTGGGAAGGAGCGCGAGTTCGTTTCAATCATTGATGGGACGGGCTCCACCTCCTATGCTGCATCCGTTAAGGGGCGCTTTACAGCCTCTCAGGATAAGGGAAAAAATATCGCCTACCTCCAGATGAACTCTCTGAAGCCTGAGGACACTGCCATGTACTATTGCAAGGCCTCATGTGTTCGCGGGCGCGGTATTAGTGAGTACTGGGGGCAGGGCACCCAGGTGACTGTCTCCAGC |
| DR592-hIL27Ra_VH H18 | 1038 | CAAGTTCAGCTCCAGGAGAGCGGAGGTGGGTCAGTCCAGGCTGGTGGCAGTCTGCGTCTGTCCTGCACTGCCCCCGGTTTCACCTCCAACAGCTGCGGCATGGATTGGTACAGGCAGGCACCTGGCAAAGAAAGGGAGTTCGTGTCCTCTATTTCCACTGACGGAACGACCGGCTACGCCGACAGTGTGAAGGGAAGGTTCACAATCTCCAAGGACAAGGCCAAGGACACCGTGTATCTTCAGATGAACTCACTGAAGCCCGAAGACACCGGGATGTATAGCTGCAAGACAAAGGACGGGACTATCGCTACTATGGAGCTGTGTGATTTCGGTTACTGGGGGCAAGGCACTCAGGTGACCGTTAGCTCCGGCGGTAGCGGCGGATCAGGAGGCTCTGGGCAAGTGCAGCTTCAAGAGTCTGGCGGTGGCTCCGTACAAGCGGGCGGAAGCCTGAGACTGAGTTGCGTGGCTTCCGGCTACGTTAGCTGCGACTACTTTCTGCCAAGCTGGTATCGCCAAGCTCCCGGCAAGGAGCGGGAGTTCGTGTCAATTATCGACGGCACTGGTTCTACCTCTTACGCCGCTTCTGTAAAGGGACGCTTTACCGCCAGCCAGGATAAGGGCAAAAACATCGCATACCTTCAGATGAACTCTCTGAAGCCAGAGGACACAGCAATGTATTACTGTAAGGCTTCCTGCGTTCGCGGTCGCGGTATCTCTGAATATTGGGGCCAGGGGACCCAGGTAACTGTGTCTTCT |
| DR592-hIL27Ra_VH H19 | 1039 | CAGGTGCAACTTCAGGAATCTGGAGGGGGATCAGTCCAGGCCGGGGGTAGTCTGAGATTGTCTTGCACCGCTCCCGGATTTACGTCAAACTCTTGCGGTATGGACTGGTATCGCCAGGCTCCCGGCAAGGAACGTGAGTTCGTGTCCAGCATTAGTACCGATGGCACCACGGGCTATGCTGACAGTGTGAAGGGTCGGTTTACCATCTCCAAGGACAAGGCCAAGGACACCGTGTATCTTCAGATGAACAGCCTGAAGCCCGAAGACACCGGCATGTATTCCTGCAAGACCAAGGATGGCACCATCGCTACGATGGAACTGTGCGATTTCGGTTACTGGGGTCAGGGAACCCAGGTCACCGTGTCTAGCGGAGGCGGTTCTCAAGTGCAGCTCCAGGAATCTGGCGGGGGCTCCGTGCAGGCTGGCGGGTCTCTGCGCCTGTCCTGTCGGGCGAGCGGTTCCACCTACTCCAATTATTGTCTGGGCTGGTTTAGACAGATCACAGGCAAGGAAAGAGAGGGCGTGGCCGTTATCAACTGGGTCGGAGGTATGCTTTACTTCGCCGACAGCGTCAAGGGCAGGTTCACCGTCTCTCAGGACCAAGCTAAGAATACCGTGTACCTTCAGATGAACTCCCTGAAGCCTGAGGATACCGCGATGTATTACTGTGCAGCTGAGTCCGTCAGCTCTTTCTCTTGTGGAGGTTGGTTGACTAGGCCTGATCGGGTGCCATACTGGGGCCAGGGGACACAGGTCACCGTATCTAGC |
| DR592-hIL27Ra_VH H19 | 1040 | CAGGTACAGTTGCAGGAAAGCGGCGGTGGATCTGTCCAGGCCGGGGGTAGCCTCCGCCTGTCCTGCACAGCCCCTGGGTTCACCAGCAACTCATGTGGCATGGACTGGTATCGCCAGGCTCCGGGTAAAGAGCGTGAGTTCGTGTCCTCTATCTCCACAGATGGAACGACAGGCTATGCAGACAGCGTCAAAGGGAGGTTTACAATCTCCAAGGACAAGGCCAAGGATACGGTTTACCTTCAGATGAACTCTCTGAAGCCCGAGGACACCGGCATGTACTCCTGTAAGACTAAGGACGGAACCATCGCCACTATGGAACTCTGCGATTTCGGCTATTGGGGACAGGGAACCCAGGTGACGGTGTCCAGCGGAGGCTCAGGAGGGTCCGGTGGCAGCGGACAGGTCCAACTCCAGGAGTCTGGTGGAGGCTCCGTCCAGGCCGGAGGTTCTCTGAGACTGTCTTGTCGGGCATCTGGATCTACTTACAGCAACTACTGCCTGGGATGGTTCAGACAAATCACAGGAAAGGAGCGCGAAGGTGTGGCCGTGATTAACTGGGTGGCGGTATGCTGTATTTCGCAGACTCCGTCAAGGGCCGCTTCACCGTGTCTCAGGATCAGGCTAAAAACACTGTTTATCTCCAGATGAACTCCCTCAAGCCTGAGGATACTGCCATGTATTACTGTGCCGCAGAGTCCGTAAGCTCCTTCTCTTGCGGGGGCTGGCTGACTCGCCCCGACCGTGTACCGTACTGGGGCCAGGGAACACAGGTCACAGTGTCCTCT |
| DR592-hIL27Ra_VH H20 | 1041 | CAGGTGCAGCTCCAGGAATCTGGCGGTGGCTCCGTGCAGGCCGGTGGCTCCCTCAGACTGTCCTGCACAGCGCCAGGCTTCACGTCCAACTCTTGCGGCATGGATTGGTATCGGCAAGCACCGGGCAAGGAAAGAGAGTTCGTTTCTTCCATCTCCACGGACGGCACGACAGGCTATGCGGACTCAGTCAAAGGCCGTTTCACTATTTCTAAGGATAAAGCCAAGGATACAGTCTACCTTCAGATGAACTCCTTGAAACCAGAGGACACCGGAATGTATAGTTGCAAGACTAAGGACGGCACAATCGCTACTATGGAACTGTGCGACTTCGGGTACTGGGGCCAGGGCACACAGGTCACTGTTAGCTCCGGTGGCGGTTCACAGGTCCAGCTCCAGGAGAGCGGCGGTGGCTGGTTCAGCGGGAGGGAGCCTGCGCCTGTCCTGTGCCGCTTCCGGGTTCACGTTTTCTTCCTACCCTATGTCTTGGGTTCGCCAGGCCCCTGGTAAGGGTCTTGAATGGGTCTCTACAATTTCTAGTGGTGGCGACACAACGCTGTATGCCGACTCCGTCAAGGGTCGCTTTACCTCAAGC |

TABLE 1B-continued

| Name | SEQ ID NO: | Sequence |
|---|---|---|
| | | AGGGATAATGCTAAGAACACCCTCTATTTGCAGTTGAACTCTCTTAAAACTGAG<br>GATACCGCAATGTATTACTGTGCAAAACGTATCGACTGTAATAGCGGTTATTGC<br>TATAAGCGTAGCTACTGGGGTCAGGGCACCCAGGTGACGGTGTCTAGT |
| DR592-<br>hIL27Ra_<br>VH<br>H20 | 1042 | CAGGTGCAACTCCAGGAATCCGGCGGGGGCAGCGTTCAGGCGGGAGGCTCTCTC<br>CGTCTGTCCTGCACCGCCCCCGGCTTCACAAGTAATTCCTGCGGCATGGACTGG<br>TATCGTCAGGCCCCTGGCAAAGAACGGGAGTTCGTAAGCTCCATCTCAACCGAT<br>GGCACAACCGGCTATGCAGACTCCGTGAAGGGGCGCTTCACCATCTCAAAGGAC<br>AAGGCCAAAGATACAGTGTACCTTCAGATGAACAGCCTTAAACCGGAGGATACA<br>GGCATGTATTCTTGCAAGACCAAGGACGGCACCATCGCAACAATGGAGCTGTGC<br>GACTTCGGATACTGGGGTCAAGGCACCCAGGTGACTGTCTCATCGGGGGTAGC<br>GGAGGGAGCGGAGGCAGTGGTCAGGTGCAGCTTCAGGAGAGCGGTGGAGGGCTC<br>GTGCAACCCGGCGGTAGCCTGCGCCTGTCCTGCGCAGCTTCTGGGTTTACGTTT<br>TCTTCCTACCCTATGAGCTGGGTGAGGCAGGCCCCTGGCAAGGGGCTGGAGTGG<br>GTCTCAACCATTTCCAGCGGTGGGGATACCACACTCTACGCCGATTCCGTCAAG<br>GGACGCTTCACCAGTTCCCGCGATAATGCCAAGAACACCCTGTACCTTCAGCTG<br>AACAGCCTGAAGACTGAGGACACTGCCATGTACTATTGTGCGAAGCGGATTGAC<br>TGCAATTCTGGGTACTGTTATAAGCGTTCTTACTGGGGGCAAGGAACCCAGGTG<br>ACCGTGTCCAGT |
| DR592-<br>hIL27Ra_<br>VH<br>H21 | 1043 | CAAGTGCAGCTTCAAGAAAGCGGGGGCGGTTCCGTGCAGGCAGGCGGGAGCCTG<br>CGCTTGAGTTGCACCGCTCCGGGCTTTACAAGTAACAGCTGCGGGATGGATTGG<br>TATCGCCAGGCACCTGGAAAGGAGCGCGAGTTCGTGTCCTCTATTTCCACGGAC<br>GGGACTACCGGGTATGCCGATTCCGTGAAGGGCCGGTTTACTATCTCCAAGGAC<br>AAAGCCAAGGACACCGTTTACCTTCAGATGAACAGCCTCAAGCCTGAAGATACC<br>GGAATGTATAGTTGTAAGACCAAGGACGGCACCATCGCCGATGGAGCTGTGT<br>GATTTCGGATACTGGGGTCAGGGCACACAGGTTACTGTGTCCAGTGGAGGCGGT<br>AGCCAGGTGCAGTTGCAGGAATCTGGCGGGGGCTTGGTCCAGCCTGGGGGCTCT<br>CTGCGCCTCAGCTGCGCGGCCTCCGGCTTCACGTTTAGCCTGAGTAGCATGTCT<br>TGGGTTCGGCAAGCCACCGGGTAAGGGCCTGGAGTGGGTCTCCGCTATTTCCAGC<br>GGCGTGCTAGTACCTATTACACCGACTCTGTGAAAGGCCGCTTCACGATTTCC<br>CGCGACAACGCAAAGAACATGCTTTATCTCCAGCTGAACTCACTGAAGACAGAG<br>GACACAGCAATGTATTACTGTGCCAAGGGAGGTTCCGGCTACGGGGATGCGTCA<br>CGTATGACATCCCTGGTTCACAGGGCACCCAGGTGACGGTGAGCAGC |
| DR592-<br>hIL27Ra_<br>VH<br>H21 | 1044 | CAAGTCCAGCTCCAGGAGTCCGGCGGGGGTTCCGTCCAGGCTGGCGGTAGCCTG<br>AGGCTGTCCTGTACCGCCCCCGGTTTCACATCTAACTCCTGCGGCATGGACTGG<br>TATCGCCAGGCTCCCGGAAAAGAACGCGAGTTCGTGAGTTCCATCTCCACAGAC<br>GGCACCACTGGCTATGCAGACAGTGTGAAGGGAAGGTTCACCATCTCTAAGGAT<br>AAAGCTAAGGACACCGTTTACTTGCAGATGAACTCTCTCAAGCCAGAGGACACC<br>GGAATGTACTCCTGTAAGACCAAAGATGGGACCATCGCGACAATGGAGCTGTGT<br>GACTTTGGATACTGGGGACAAGGGACCCAGGTGACTGTTTCATCCGGCGGTTCT<br>GGCGGGTCTGGTGGGTCCGGTCAGGTGCAGCTCCAGGAGTCCGGCGGGGGACTG<br>GTGCAGCCTGGGGGATCACTGCGCCTCAGCTGCGCTGCCTCAGGTTTCACATTT<br>AGTCTTAGCTCTATGAGCTGGGTGCGCCAGGCACCCGGAAGGGGCTGGAATGG<br>GTCAGCGCAATCAGCTCAGGCGGGGCTTCTACGTATTACACGGATAGCGTGAAA<br>GGGCGCTTCACCATCAGCCGTGACAACGCCAAGAACATGCTGTACCTTCAGCTG<br>AACTCACTGAAGACGGAAGATACTGCCATGTACTATTGTGCCAAGGGTGGATCT<br>GGGTATGGTGATGCCTCCCGTATGACCTCACCTGGAAGCCAGGGTACACAGGTC<br>ACCGTCTCCTCC |
| DR592-<br>hIL27Ra_<br>VH<br>H22 | 1045 | CAGGTGCAGTTGCAGGAGAGCGGCGGGGGCAGCGTGCAAGCCGGTGGCAGCCTG<br>CGGCTGTCTTGTACCGCCCCCGGTTTTACTAGCAATTCTTGCGGCATGGATTGG<br>TATCGCCAGGCCCCAGGCAAGGAAAGAGAGTTCGTGTCCTCTATCAGCACTGAC<br>GGCACAACCGGCTACGCCGATTCAGTGAAGGGCCGCTTCACCATCTCAAAGGAT<br>AAGGCCAAGGACACCGTGTACCTTCAGATGAACTCTCTTAAACCGGAGGACACT<br>GGTATGTACTCTTGCAAGACCAAAGACGGGACCATCGCGACTATGGAGCTGTGC<br>GATTTCGGGTACTGGGGCCAGGGAACACAGGTCACTGTCTCTTCCGGCGGAGGT<br>TCTCAGGTTCAGTTGCAGGAGAGCGGTGGGGGTAGCGTTCAGGCTGGCGGAAGC<br>CTGCGGTTGAGTTGTCGCGCATCTGGCTCTACCTATAGCAACTATTGCCTGGGA<br>TGGTTCAGACAGACAACCGGCAAGGAGCGCGAGGGTGTGGCCGTCATCAACTGG<br>GTCGGGGGTATGCTGTATTTTGCTGATTCCGTGAAGGGCCGTTTCACCGTGAGC<br>CAGGACCAGGCTAAGAACACAGTTTATCTCCAGATGAACAGCCTGAAACCCGAG<br>GATACTGCCATGTACTATTGTGCGGCAGAATCCGTGTCCTCTTTTAGCTGTGGT<br>GGCTGGCTCACACGCCCTGACCGCGTCCCGTACTGGGGTCAGGGAACCCAAGTG<br>ACCGTGAGTTCA |
| DR592-<br>hIL27Ra_<br>VH<br>H22 | 1046 | CAAGTGCAGCTTCAGGAGTCTGGCGGGGGCTCCGTACAGGCTGGGGGCAGCCTT<br>AGATTGTCATGCACTGCCCCTGGATTCACAAGCAACAGCTGTGGCATGGATTGG<br>TATCGCCAAGCACCTGGGAAGGAGCGGGAGTTCGTCTCCAGCATTTCTACTGAT<br>GGTACGACCGGCTACGCTGACAGTGTGAAGGGACGCTTCACTATCTCCAAGGAC<br>AAGGCCAAAGATACCGTGTATTTGCAGATGAACAGTCTCAAGCCGGAGGACACC<br>GGAATGTATTCCTGCAAGACTAAGGACGGGACTATCGCCACTATGGAACTTTGC<br>GACTTTGGCTATTGGGGCCAGGGCACCCAGGTGACCGTAAGTTCCGGGGGTTCC<br>GGCGGAAGCGGCGGTAGCGGCCAGGTTCAACTTCAGGAGTCCGGGGGAGGCTCT<br>GTGCAGGCCGGGGGCTCTCTGAGACTGTCCTGCGGGCCTCCGGCTCCACATAC<br>TCTAACTACTGCCTGGGATGGTTCCGTCAGACTACAGGCAAGGAGCGCGAGGGT |

TABLE 1B-continued

| Name | SEQ ID NO: | Sequence |
|---|---|---|
| | | GTTGCAGTCATCAACTGGGTAGGGGAATGCTGTATTTCGCCGATTCAGTCAAA<br>GGACGCTTCACTGTGTCCCAAGACCAGGCCAAGAACACAGTCTATCTTCAGATG<br>AACAGCCTCAAGCCCGAGGATACCGCTATGTACTATTGCGCAGCTGAGAGCGTG<br>TCCAGCTTCTCTTGCGGAGGCTGGCTGACCAGGCCGGATCGGGTGCCCTATTGG<br>GGTCAAGGCACACAGGTGACAGTTTCAAGT |
| DR592-<br>hIL27Ra_<br>VH<br>H23 | 1047 | CAGGTGCAGCTCCAGGAGAGTGGAGGTGGGTCCGTGCAGGCGGGAGGTAGCCTG<br>CGGCTGTCCTGTACTGCGCCCGGCTTTACCAGTAACAGCTGCGGCATGGACTGG<br>TATAGACAGGCCCCCGGACGAGTTTGTCAGCAGTATCTCTACTGAT<br>GGCACCACTGGATATGCGGACTCCGTGAAGGGTCGGTTCACCATTAGCAAGGAC<br>AAGGCAAAGGATACCGTGTATTTGCAGATGAACAGTCTCAAACCAGAGGACACA<br>GGCATGTATAGTTGCAAAACCAAGGACGGGACCATCGCCACTATGGAACTCTGT<br>GATTTTGGGTATTGGGGCCAGGGGACTCAGGTGACCGTCAGCTCCGGGGGCGGT<br>TCCCAAGTTCAGTTGCAAGAGTCTGGAGGCGGATCAGTGCAGGCCGGGGGCTCT<br>CTGCGGCTTAGCTGCCGTGCTTCTCGCAGCCCTTATGGGAACTACTGTCTTGGC<br>TGGTTCAGGCAGAGTACAGGTAAGGAACGCGAAGGGGTGGCCGTCATCAACTGG<br>GTGGGCGGAATGCTCTATTTCGCTGACTCTGTGAAGGGCCGTTTCACAGTGTCC<br>CAGGACCATGCTAAGAACACTGTCACCCTCCAGATGAACAGCCTGAAGCCAGAG<br>GACACCGCTATGTATTACTGCGCAGCCGAGTCTGTGTCCAGTTTCTCATGCGGT<br>GGGGTGGCTGACCAGACCTGATCGCGTTCCATACTGGGGACAAGGGACTCAGGTC<br>ACAGTGTCCTCT |
| DR592-<br>hIL27Ra_<br>VH<br>H23 | 1048 | CAGGTGCAGCTCCAGGAGTCCGGGGGTGGCTCCGTTCAGGCGGGAGGCTCTTTG<br>CGTTTGTCCTGCACCGCACCCGGTTTCACAAGTAACTCCTGCGGCATGGACTGG<br>TATCGTCAGGCTCCAGGCAAGGAGCGCGAGTTCGTGAGTTCTATCTCCACAGAC<br>GGCACCACGGGCTACGCCGACAGTGTTAAGGGTCGCTTTACTATCTCAAAGGAT<br>AAGGCGAAGGACACCGTATACCTTCAGATGAACTCCCTCAAGCCTGAAGACACC<br>GGAATGTATAGCTGTAAGACCAAGGACGGCACCATCGCCACAATGGAGCTGTGC<br>GACTTTGGATACTGGGGCAGGGAACACAGGTGACAGTATCCAGCGGGGGCTCT<br>GGCGGTTCCGGCGGTTCCGGCCAGGTCCAGTTGCAGGAGTCTGGTGGCGGTAGC<br>GTCCAGGCTGGGGGCAGCCTGCGGCTGTCCTGTCGCGCATCAAGAAGCCCTTAC<br>GGCAATTATTGTTTGGGCTGGTTCCGCCAATCAACTGGTAAGGAGAGAGAAGGA<br>GTCGCTGTCATTAACTGGGTGGGCGGTATGCTTTATTTTGCCGATAGCGTGAAG<br>GGGCGCTTCACGGTGTCTCAGGACCATGCCAAGAATACCGTTACGTTGCAGATG<br>AACAGCCTGAAACCCGAAGACACCGCAATGTATTACTGTGCCGCTGAGTCCGTA<br>TCCTCTTTCTCCTGTGGAGGCTGGCTGACACGCCCCGACCGCGTGCCTTATTGG<br>GGCCAAGGGACCCAGGTTACCGTGTCCTCC |
| DR592-<br>hIL27Ra_<br>VH<br>H24 | 1049 | CAGGTGCAGTTGCAGGAAAGTGGTGGAGGCAGCGTGCAGGCAGGAGGCTCTCTG<br>CGCCTGAGCTGCACAGCGCCTGGCTTTACCTCCAACAGCTGTGGAATGGACTGG<br>TATCGCCAGGCTCCCGGTAAGGAGCGGGAATTTGTCAGCTCCATTTCCACCGAC<br>GGCACCACTGGCTACGCCGATTCCGTCAAGGGCAGGTTCACAATCTCAAAGGAC<br>AAAGCCAAGGACACAGTGTATCTCCAGATGAACTCCCTGAAGCCTGAGGACACA<br>GGTATGTATAGCTGCAAGACTAAGGACGGCACAATCGCCACGATGGAATTGTGC<br>GACTTCGGATATTGGGGACAAGGTACTCAGGTGACCGTCTCCTCTGGAGGGGGC<br>TCCCAGGTGCAGCTCCAGGAGTCTGGCGGTGGCCTGGTGCAGCCCGGTGGGTCT<br>CTGCGGCTGAGTTGTGCTGCGTCTGGATTCACCTTTTCCCACAGCGGGATGTCA<br>TGGGTGAGGCAGGCACCCGGCAAGGGCCTGGAGTGGGTGAGCACAATTAACTCC<br>GGGGGTGCTTCCACGTACTATACCGATAGCGTGAAGGGCAGGTTTACCATCTCA<br>CGCGACAACGCGAAGAACATGCTGTATCTTCAGCTGAATAGTTTGAAGACCGAG<br>GACACCGCTATGTATTACTGCGCCAAAGGCGGTTCTGGCTACGGGGACGCCTCC<br>CGCATGACAAGCCCTGGGTCTCAGGGCACACAGGTGACCGTGTCTTCT |
| DR592-<br>hIL27Ra_<br>VH<br>H24 | 1050 | CAAGTTCAGCTTCAGGAATCAGGTGGCGGTAGCGTGCAGGCTGGGGGCTCCTTG<br>AGATTGTCCTGCACGGCCCCAGGATTCACCAGCAACTCTTGCGGGATGGATTGG<br>TATCGCCAGGCTCCGGGGAAGGAGAGGGAGTTCGTAAGCTCCATTTCAACCGAT<br>GGGACCACTGGATACGCTGACTCCGTTAAGGGTAGGTTCACGATCAGTAAGGAC<br>AAGGCCAAGGATACAGTGTATCTTCAAATGAACTCACTGAAGCCCGAGGACACC<br>GGGATGTACTCCTGTAAGACCAAAGATGGCACTATCGCAACGATGGAGCTGTGC<br>GACTTCGGCTATTGGGGCCAGGGAACCCAGGTTACTGTGTCCAGCGGAGGCAGC<br>GGCGGTTCTGGAGGCTCTGGACAGGTCCAACTCCAGGAATCTGGGGGCGGTCTC<br>GTGCAGCCAGGTGGGTCACTGCGCTTGTCATGTGCGGCCTCCGTTTCACCTTC<br>AGCCATTCTGGAATGAGCTGGGTGCGTCAAGCACCGGGCAAAGGCCTCGAATGG<br>GTCTCTACTATTAACAGCGGAGGTGCATCTACCTACTATACAGACAGCGTTAAG<br>GGGAGGTTCACCATCTCTCGCGATAATGCTAAAAACATGCTGTATTTGCAGCTT<br>AATTCACTGAAGACGGAGGACACCGGCCATGTACTATTGTGCCAAGGGTGGGTCC<br>GGGTACGGTGACGCCTCTCGCATGACCTCCCCAGGAAGTCAGGGCACCCAGGTG<br>ACCGTGTCATCC |
| DR593-<br>hIL27Ra_<br>VH<br>H1 | 1051 | CAGGTGCAGCTCCAGGAATCTGGCGGTGGCAGCGTGCAGGCCGGTGGCTCCCTG<br>AGGCTGTCCTGTGCTGCCTCTGGATACCCATACTCCAACGGGTACATGGGCTGG<br>TTCCGTCAGGCCCCTGGAAAGGAACGTGAGGGCGTGGCCACTATTTACACCGGC<br>GACGGTCGTACTTATTACGCCGACTCCGTGAAAGGCCGCTTCACCATTTCTAGG<br>GATAACGCTAAGAACACAGTTGACCTCCAGATGTCTAGCCTGAAACCTGAGGAT<br>ACCGCCATGTATTACTGCGCTGCCAGGGCTGCCCCACTCTACAGCTCTGGTTCT<br>CCCCTGACACGCGCCAGGTATAACGTGTGGGACAGGGGACCCAGGTCACAGTG<br>AGTTCTGGCGGGGGTTCTCAGGTGCAACTCCAGGAATCTGGCGGAGGCCTGGTC |

TABLE 1B-continued

| Name | SEQ ID NO: | Sequence |
|---|---|---|
| | | CAGCCTGGTGGCTCCCTTCGCCTGAGCTGTGCAGCCTCTGGCTTCACATTCAGC<br>TCCTATCCTATGTCCTGGGTGCGCCAGGCCCCTGGGAAGGGCCTGGAGTGGATC<br>TCCACCATCTCTGCGGGTGGCGACACTACACTCTACGCCGACAGCGTGAAGGGC<br>CGCTTTACCTCCAGTCGCGATAACGCTAAGAATACACTGTACCTCCAGCTTAAC<br>AGCCTGAAGACAGAGGACGCTGCAATCTATTACTGTGCCAAGAGGATCGACTGC<br>AACAGCGGATATTGCTACCGTAGGAATTATTGGGGCCAGGGAACCCAGGTTACC<br>GTATCATCC |
| DR593-<br>hIL27Ra_<br>VH<br>H1 | 1052 | CAAGTTCAGTTGCAGGAATCCGGTGGCGGTAGCGTGCAGGCTGGTGGCAGCCTG<br>CGTCTGAGCTGCGCTGCATCCGGGTATCCGTACAGCAACGGTTACATGGGATGG<br>TTCCGCCAAGCTCCTGGGAAGGAGCGCGAAGGCGTGGCGACCATTTACACCGGA<br>GACGGACGCACTTATTACGCCGACTCAGTGAAGGGCCGCTTTACGATCTCTCGG<br>GACAACGCTAAGAATACCGTGGACTTGCAGATGAGTTCCCTGAAGCCTGAGGAC<br>ACCGCAATGTATTACTGTGCCGCACGCGCTGCGCCCCTCTACAGCTCTGGTTCT<br>CCCCTGACCCGTGCCCGTTACAATGTATGGGACAAGGCACCCAGGTGACCGTG<br>AGTAGCGGGGAAGCGGAGGCAGCGGGGATCTGGCCAGGTGCAGCTCCAGGAA<br>AGCGGCGGGGCCTGGTCCAGCCCGGTGGCAGCCTGCGCCTGTCCTGTGCTGCC<br>AGTGGATTCACCTTTTCTTCCTATCCTATGTCATGGGTCCGCCAGGCACCTGGC<br>AAGGGCCTGGAGTGGATTTCCACTATCTCAGCTGGCGGAGACACAACTCTCTAC<br>GCGGACTCTGTAAAGGGTCGGTTTACGTCTTCCCGCGACAACGCCAAGAATACC<br>CTGTACCTTCAGTTGAACTCCCTTAAAACCGAAGATGCAGCTATCTACTATTGT<br>GCGAAGCGTATTGATTGCAACTCCGGTTACTGCTACCGGCGTAACTACTGGGGT<br>CAAGGCACACAGGTCACAGTCTCCTCC |
| DR593-<br>hIL27Ra_<br>VH<br>H2 | 1053 | CAAGTCCAGCTCCAAGAGAGTGGGGGCGGTTCCGTGCAGGCTGGAGGCTCCCTC<br>AGATTGAGTTGTGCGGCTAGTGGCTATCCCTATAGCAACGGCTACATGGGATGG<br>TTCCGCCAGGCCCCCGGCAAGGAAAGGGAGGGTGTTGCAACCATCTACACAGGA<br>GATGGCCGCACTTACTATGCAGACTCCGTTAAGGGTCGTTTCACCATTTCCCGC<br>GATAACGCTAAGAATACAGTGGATCTTCAGATGTCCAGCCTCAAACCAGAGGAT<br>ACTGCAATGTATTACTGCGCAGCGCGGGCCGCGCCCCTGTACTCTTCCGGCTCT<br>CCACTGACCCGCGCTCGCTACAACGTGTGGGGCCAAGGCACGCAGGTCACAGTT<br>TCTTCCGGCGGGGGCAGCCAGGTCCAGCTCCAGGAAAGTGGCGGGGGCCTGGTT<br>CAGCCCGGCGGTTCCCTGCGCCTCAGCTGTGCTGCCTCTGGGTTTACCTTCAGC<br>CTGTCAGGCATGAGCTGGGTGCGGCAGGCTCCTGGCAAGGGTCTGGAATGGGTT<br>TCCGCCATTTCAAGCGGCGGGGCCTCTACCTATTACACAGACTCCGTGAAGGGC<br>CGTTTCACGATCAGTCGCGACAACGCGAAAAACATTCTCTATCTCCAGCTGAAC<br>AGCTTGAAGACCGAGGACACTGCGATGTATTACTGTGCCAAAGGGGGATCAGGA<br>TACGGCGATGCGTCTCGCATGACTTCCCCAGGTTCACAGGGCACTCAGGTTACC<br>GTCTCTTCC |
| DR593-<br>hIL27Ra_<br>VH<br>H2 | 1054 | CAGGTACAGCTTCAAGAAAGCGGCGGGGAAGCGTGCAAGCTGGCGGGAGCCTT<br>AGGCTGAGTTGCGCGGCCTCAGGTTACCCCTATAGCAACGGATATATGGGATGG<br>TTCCGGCAGGCACCGGGGAAGGAACGCGAGGGAGTGGCCACCATTTACACCGGG<br>GACGGGAGGACCTACTATGCCGACTCTGTGAAGGGCCGTTTCACTATCTCTAGG<br>GATAACGCGAAGAACACAGTGGACTTGCAGATGTCATCTCTCAAGCCGGAGGAC<br>ACTGCCATGTATTACTGTGCGGCTCGTGCCGCTCCTCTCTACAGCTCCGGGAGT<br>CCACTGACCCGCGCAAGGTACAACGTGTGGGTCAGGGAACTCAGGTGACCGTT<br>TCATCCGGGGGCAGCGGTGGCTCCGGTGGCTCTGGTCAGGTTCAGCTCCAGGAA<br>AGCGGGGGCGGGCTGGTGCAGCCCGGAGGCTCCCTGCGTCTTTCTTGCGCTGCC<br>AGTGGCTTTACCTTTTCCCTGAGTGGAATGAGCTGGGTGAGGCAAGCGCCAGGC<br>AAGGGACTGGAATGGGTGAGCGCAATCAGTTCAGGCGGGGCCAGTACTTATTAC<br>ACTGACTCCGTCAAGGGTCGGTTTACCATCTCTCGGGATAACGCTAAGAACATC<br>CTTTATTTGCAGCTCAACTCCTTGAAGACGGAAGACACCGCTATGTATTACTGC<br>GCTAAAGGAGGGAGTGGATACGGAGACGCATCTCGCATGACCAGTCCAGGTTCC<br>CAGGGAACCCAGGTGACTGTGTCAAGC |
| DR593-<br>hIL27Ra_<br>VH<br>H3 | 1055 | CAGGTCCAGCTTCAGGAAAGCGGCGGTGGGTCTGTCCAGGCAGGTGGCTCTCTG<br>AGACTGTCCTGTGCTGCCAGCGGGTATCCGTACTCAAATGGCTACATGGGCTGG<br>TTCCGCCAGGCCCCTGGAAAGGAGCGCGAGGGCGTGGCCACGATCTATACCGGG<br>GACGGACGCACCTATTACGCTGACAGTGTCAAAGGTAGATTCACTATCTCAGCCGG<br>GACAACGCGAAGAACACCGTTGACCTTCAGATGTCAAGCCTGAAGCCTGAGGAC<br>ACTGCCATGTATTACTGCGCTGCAAGGGCTGCCCCTCTTTACAGCTCCGGCTCT<br>CCCCTTACAAGAGCCCGGTACAACGTCTGGGCCAGGGAACTCAGGTGACCGTT<br>AGCTCCGGCGGGGCTCCCAGGTGCAGCTCCAGGAGTCCGGTGGCGGAAGTGTT<br>CAGGCGGGCGGAAGTCTGCGCCTGTCTTGCGTGGCCTCTGGATACGTCTCCTGT<br>GACTATTTCTTGCCCAGCTGGTATCGCCAGGCTCCGGGAAAGAGAGAGAGTTC<br>GTGAGCATCATTGACGGCACTGGCTCCACCAGCTACGCAGCCTCCGTTAAGGGT<br>CGCTTTACCGCCTCAGAGGATAAGGGTAAGAACATCGCATACTTGCAGATGAAC<br>AGTCTCAAGCCCGAGGATACCGCTATGTATTACTGCAAGGCCAGCTGCGTCCGG<br>GGTCGCGCTGTCTCCGAATACTGGGGACAGGGCACCCAGGTGACCGTATCTAGT |
| DR593-<br>hIL27Ra_<br>VH<br>H3 | 1056 | CAGGTTCAGCTCCAGGAGAGTGGCGGAGGGAGTGTGCAAGCTGGCGGTTCTTTG<br>CGCCTCTCTTGTGCTGCCTCCGGTTATCCCTACAGTAACGGCTATATGGGCTGG<br>TTTCGCCAAGCACCAGGGAAGGAACGGGAGGGGGTCGCCACCATTTATACTGGC<br>GATGGCCGCACCTATTACGCCGACTCCGTGAAAGGTCGCTTCACCATCAGTCGG<br>GACAATGCAAAGAACACTGTAGACTTGCAAATGTCTTCCCTCAAGCCTGAGGAT<br>ACTGCTATGTACTATTGCGCTGCAAGGGCAGCTCCCCTGTACTCTAGTGGCTCT |

TABLE 1B-continued

| Name | SEQ ID NO: | Sequence |
|---|---|---|
| | | CCTCTGACCCGCGCTCGGTACAACGTCTGGGGTCAGGGAACCCAGGTTACCGTC<br>TCTAGCGGGGGCTCAGGTGGCAGCGGCGGTTCCGGCCAGGTCCAACTCCAGGAG<br>TCCGGCGGTGGCTCCGTTCAAGCCGGAGGCAGTCTGAGACTGAGCTGCGTGGCG<br>TCCGGTTACGTCTCCTGTGACTACTTCCTGCCTAGCTGGTATCGGCAAGCGCCT<br>GGTAAGGAAAGAGAGTTCGTGAGTATCATTGATGGGACCGGCTCCACCTCCTAC<br>GCCGCATCTGTTAAGGGGCGCTTCACAGCTTCCGAAGACAAGGGAAAGAACATC<br>GCTTATCTTCAGATGAACTCTCTCAAACCTGAAGACACGGCTATGTACTATTGC<br>AAGGCCTCCTGTGTACGGGGTCGCGCCGTGTCCGAGTACTGGGGGCAGGGGACA<br>CAGGTTACCGTATCCAGC |
| DR593-<br>hIL27Ra_<br>VH<br>H4 | 1057 | CAGGTGCAGCTGCAAGAGAGCGGCGGAGGCAGCGTGCAAGCTGGAGGCTCTCTC<br>CGGCTTTCATGCGCTGCCAGCGGCTATCCTTATAGCAACGGCTACATGGGCTGG<br>TTCCGCCAAGCGCCCGGCAAGGAGCGCGAGGGGGTGGCGACGATTTATACGGGG<br>GACGGCAGGACTTATTACGCAGACTCCGTCAAAGGGCGCTTCACCATCTCCCGC<br>GACAACGCCAAAAATACCGTCGATCTTCAGATGTCAAGCCTCAAGCCCGAGGAT<br>ACAGCCATGTACTATTGCGCAGCCCGCGCCGCACCCCTCTATTCCTCAGGATCT<br>CCACTCACACGCGCCCGGTACAATGTGTGGGGTCAAGGAACCCAGGTGACCGTA<br>TCCAGCGGGGGCGGTTCTCAAGTCCAGCTTCAGGAGTCCGGCGGAGGCCTTGTG<br>CAGCCCGAGAATCTCTGAGACTGTCCTGTACTGCCAGCGGGTTCACCTTTTCT<br>AACTACGCGATGAGCTGGGTACGGCAAGCGCCCGGAAAGGGTCTGGAATGGGTC<br>AGCGGAATCAATGTTGCCTACGGCATCACTTCTTACGCCGACAGTGTTAAGGGC<br>CGCTTCACTATTAGTCGTGACAACACCAAAAACACTCTGTATCTCCAGCTCAAC<br>AGCCTGAAAACAGAGGATACTGCGATTTACTATTGTGTCAAACACTCTGGCACC<br>ACTATCCCAAGGGGGTTCATCTCCTACACTAAGCGCGGTCAGGGAACCCAGGTG<br>ACCGTGTCATCC |
| DR593-<br>hIL27Ra_<br>VH<br>H4 | 1058 | CAGGTGCAGTTGCAGGAGAGTGGTGGCGGAAGCGTGCAAGCTGGCGGAAGCCTG<br>AGACTGAGCTGCGCTGCGAGCGGCTACCCTTACTCAAATGGCTACATGGGGTGG<br>TTCCGTCAGGCCCCCGGCAAGGAGCGTGAGGGGGTGGCCACGATCTACACTGGA<br>GATGGCCGCACTTATTACGCCGATTCTGTTAAGGGGAGATTCACAATCAGCCGC<br>GACAATGCTAAGAACACCGTGGACCTTCAGATGTCCAGCCTCAAACCGGAAGAC<br>ACTGCAATGTATTACTGTGCGGCCCGTGCCGCGCCGCTTTACTCTTCAGGGTCA<br>CCTCTGACCCGCGCTCGGTACAATGTATGGGGCCAGGGTACACAGGTGACCGTG<br>TCTAGCGGAGGCAGCGGTGGCTCAGGAGGTTCTGGGCAAGTCCAGCTCCAAGAG<br>TCAGGTGGCGGTCTGGTGCAGCCAGGTGAAAGCCTGCGTCTTTCCTGCACTGCC<br>AGCGGCTTTACCTTCTCCAACTATGCCATGTCCTGGGTGCGCCAAGCTCCGGGG<br>AAGGGCCTGGAATGGGTATCCGGCATTAACGTGGCCTATGGGATCACAAGTTAC<br>GCTGACTCTGTGAAGGGCAGATTACTATTAGCAGAGACAACACCAAGAATACC<br>TTGTACTTGCAACTGAACTCCCTCAAGACCGAGGATACAGCCATCTACTATTGC<br>GTGAAACACAGCGGCACTACAATCCCGCGCGGCTTTATTAGTTATACGAAGAGG<br>GGACAAGGTACGCAGGTGACCGTGTCCAGC |
| DR593-<br>hIL27Ra_<br>VH<br>H5 | 1059 | CAGGTGCAGTTGCAGGAGTCCGGCGGGGGCAGCGTTCAGGCTGGGGGCTCTCTC<br>AGACTGTCCTGTGCCGCGAGCGGCTATCCATACAGTAACGGATACATGGGCTGG<br>TTCCGCCAAGCGCCCGGCAAGGAGAGGGAGGGTGTCGCCACTATCTACACGGGG<br>GATGGCCGGACTTATTACGCGGATAGCGTGAAAGGTCGTTTTACCATCTCCCGC<br>GACAACGCGAAGAACACCGTGGATTTGCAGATGTCTAGCCTCAAACCCGAGGAC<br>ACGGCTATGTACTATTGCGCAGCCCGTGCCGCACCTTTGTATTCCTCTGGTTCA<br>CCCCTCACTAGGGCCAGATATAACGTGTGGGACAGGGGACCCAGGTGACTGTG<br>AGTTCTGGGGGTGGCTCCCAGGTGCAGCTCCAGGAGAGCGGAGGTGGCTCCGTT<br>CAGGCGGGAGGCTCCCTGAGGCTGTCTTGCACCGCCTCTGGATACGTTTCCTGC<br>GACTATTTCCTCCCCTCCTGGTACAGACAGGCACCCGGAAAGGAACGCGAGTTT<br>GTGAGCGTCATCGACGGAACAGGGAGCACCTCCTATGCGGCCTCAGTGAAGGGC<br>AGATTCACAGCTTCCCAAGACAAGGGTAAGAACATCGCATACCTTCAGATGAAC<br>TCCCTGAAACCCGAAGATACCGCCATGTATTACTGCAAAGCATCTTGCGTTCGG<br>GGAAGGGCAATCAGCGAATACTGGGGCCAGGGCACGCAGGTGACCGTGTCCTCT |
| DR593-<br>hIL27Ra_<br>VH<br>H5 | 1060 | CAGGTGCAGCTTAAGAGAGTGGTGGAGGGTCCGTCCAGGCCGGGGGTTCTCTG<br>AGGTTGTCCTGCGCAGCCAGCGGTTACCCCTACTCCAACGGCTATATGGGGTGG<br>TTCCGTCAGGCCCCAGGCAAGGAACGCGAAGGGGTCGCAACAATCTACACAGGT<br>GATGGCCGCACTTATTACGCTGATAGCGTGAAAGGTCGGTTCACCATTTCTCGG<br>GACAACGCCAAGAACACCGTAGATTTGCAGATGTCTTCCTTGAAACCCGAGGAC<br>ACTGCCATGTATTACTGCGCTGCACGGGCTGCCCCACTCTATAGTTCCGGCTCC<br>CCACTCACACGCGCCAGATACAACGTGTGGGGCAAGGGACACAGGTCACTGTG<br>TCTAGTGGGGCTCCGGTGGCAGCGGAGGTAGCGGCCAGGTTCAGCTTCAGGAA<br>TCTGGCGAGGCTCCGTGCAAGCCGGTGGGAGCCTCAGACTGTCTTGTACTGCC<br>AGCGGGTACGTAAGCTGCGACTACTTCCTGCCTTCCTGGTATCGCCAAGCTCCA<br>GGGAAGGAACGTGAGTTCGTATCTGTGATCGACGGAACAGGCTCTACATCTTAT<br>GCAGCTTCAGTGAAGGGGAGATTCACAGCCAGCCAGGACAAGGGTAAAAACATT<br>GCTTATCTCCAGATGAACTCACTCAAGCCGGAGGACACCGCTATGTATTACTGT<br>AAAGCATCCTGCGTGAGAGGACGGGCTATCAGCGAATACTGGGGGCAGGGAACC<br>CAGGTGACCGTGAGCAGC |
| DR593-<br>hIL27Ra_<br>VH<br>H6 | 1061 | CAGGTGCAGTTGCAGGAGTCCGGGGGAGGTTCCGTCCAGGCCGGGGGAAGTCTG<br>CGCTTGTCATGCGCTGCCAGCGGCTATCCCTACTCCAACGGCTATATGGGCTGG<br>TTTAGGCAGGCCCCTGGGAAGGAACGCGAAGGCGTCGCGACGATCTACACGGGC<br>GATGGGAGGACCTATTACGCAGATTCCGTAAAGGGCAGATTTACCATCTCCCGT |

TABLE 1B-continued

| Name | SEQ ID NO: | Sequence |
|---|---|---|
| | | GATAACGCCAAGAATACCGTTGACCTCCAGATGTCCTCTCTGAAACCCGAGGAT<br>ACCGCCATGTACTATTGCGCCGCTCGCGCCGCTCCCCTCTACAGCTCTGGATCA<br>CCACTGACCCGCGCTAGGTATAACGTGTGGGGTCAGGGGACACAGGTGACCGTC<br>AGCTCTGGGGGAGGCTCCCAGGTTCAGCTCCAGGAGTCTGGAGGGGGCCTTGTG<br>CAGCCCGGCGGGTCCCTCCGTCTGAGTTGTGCTGCCTCAGGCTTTAGTTTCTCT<br>TCCTACGCTATGAAATGGGTCCGTCAAGCGCCCGGCAAAGGCCTGGAGTGGGTC<br>TCTACCATTAGCTCCGGGGGTTCCAGCACGAATTATGCTGACTCCGTCAAAGGC<br>AGGTTCACTATCAGCCGCGACAACGCCAAGAATACCCTGTACTTGCAGCTCAAC<br>AGCCTGAAGATCGAGGACACCGCGATGTATTACTGCGCTAAAGCCATCGTGCCT<br>ACTGGAGCGACGATGGAACGCGGACAGGGCACTCAGGTCACCGTGTCCAGC |
| DR593-<br>hIL27Ra_<br>VH<br>H6 | 1062 | CAAGTGCAGCTGCAAGAATCAGGCGGAGGCAGTGTCCAAGCTGGCGGTAGTCTG<br>CGCCTGAGCTGCGCCGCATCAGGCTACCCATACTCTAACGGCTATATGGGGTGG<br>TTTAGGCAAGCCCCCGGCAAGGAGCGCGAAGGCGTGGCGACCATCTACACTGGT<br>GATGGCCGCACTTACTATGCGGACTCTGTGAAAGGACGCTTCACAATTTCTCGT<br>GACAATGCTAAGAACACTGTGGATCTTCAGATGAGTTCCCTGAAGCCCGAAGAC<br>ACGGCGATGTATTACTGTGCTGCCAGAGCCGCTCCGCTGTACTCCAGCGGCAGC<br>CCCCTCACCCGCCCGTTATAACGTCTGGGGGCAGGGCACCCAGGTCACTGTT<br>TCTTCCGGTGGCAGTGGAGGCTCTGGGGGCAGCGGACAAGTACAACTCCAGGAG<br>TCAGGCGGGGGCCTGGTTCAGCCAGGGGGTTCCCTGCGCCTGAGCTGTGCCGCT<br>TCTGGCTTTTCATTCTCTTCCTATGCCATGAAGTGGGTGCGCCAGGCCCCTGGG<br>AAGGGGACTGGAGTGGGTGAGCACCATTTCAAGTGGAGGTAGCTCCACCAACTAC<br>GCGGATTCCGTCAAAGGCCGCTTCACCATTTCCAGGGACAACGCTAAAAACACC<br>CTGTATCTTCAGCTCAACTCCCTGAAGATCGAAGACACTGCTATGTACTATTGC<br>GCCAAGGCCATCGTCCCCACAGGTGCCACAATGGAGAGGGGCCAGGGCACGCAG<br>GTGACAGTCAGCAGT |
| DR593-<br>hIL27Ra_<br>VH<br>H7 | 1063 | CAGGTGCAGCTCCAGGAATCCGGCGGAGGCTCCGTGCAGGCTGGCGGGTCCCTT<br>AGGTTGTCTTGCGCTGCCAGCGGATACCCTTACAGCAATGGATATATGGGTTGG<br>TTCCGCCAGGCCCCTGGCAAGGAGAGAGAGGGAGTGGCCACCATCTACACGGGT<br>GACGGGCGTACCTACTATGCCGATTCCGTTAAGGGCAGGTTCACAATCTCCCGC<br>GACAACGCCAAGAACACCGTGGACCTGTGCAAATGTCTTCCCTTAAACCCGAAGAC<br>ACTGCCATGTATTACTGCGCTGCCCGCGCGGCCCCACTCTACAGCTCTGGGAGC<br>CCTTTGACCCGTGCTCGCTATAACGTGTGGGGCCAGGGTACTCAGGTGACCGTC<br>TCAAGCGGCGGAGGCTCTCAGGTGCAGCTCCAGGAGTCAGGTGGAGGTTTGGTG<br>CAGCCAGGAGGCTCACTGAGACTGAGCTGCGCTGCCAGCGGGTTCACTTTCTCC<br>TCTTATCCTATGTCCTGGGTTCGCCAGGCACCCGGCAAAGGCTTGGAGTGGATC<br>AGCACCATCAGTGCGGGTGGCGACACAACTTTGTACGCCGACTCTGTGAAGGGT<br>CGTTTTACCTCCAGTCGCGACAATGCTAAAAACACACTGTATCTGCAACTGAAC<br>TCTCTGAAGACCGAGGACACCGCCATCTATTACTGTGCCAAAGAATTGACTGT<br>AACAGCGGATATTGCTATAGACGCAACTATTGGGGTCAGGGCACACAGGTTACC<br>GTGTCCTCA |
| DR593-<br>hIL27Ra_<br>VH<br>H7 | 1064 | CAAGTCCAGCTCCAGGAATCCGGCGGTGGCAGCGTTCAAGCCGGTGGCTCCCTG<br>CGCCTGAGTTGTGCAGCTTCAGGTTATCCCTACAGCAACGGATACATGGGATGG<br>TTCCGTCAGGCTCCCGGTAAGGAGCGTGAGGGTGTGGCAACATCTATACGGGA<br>GATGGCAGGACCTACTATGCGGACTCTGTGAAGGGCAGGTTCACGATCTCTCGT<br>GATAACGCTAAGAACACCGTCGATCTCCAGATGTCTTCCTTGAAGCCTGAGGAT<br>ACGGCTATGTATTACTGCGCCGCGAGAGCTGCCCCGCTCTATTCCTCTGGCAGT<br>CCTCTGACTCGGGCACGGTACAACGTGTGGGGCCAAGGCACCCAGGTCACTGTG<br>TCCTCTGGCGGTAGCGGTGGCTCTGGCGGTTCAGGTCAGGTGCAGCTGCAAGAA<br>TCCGGTGGAGGCCTGGTGCAGCCCGGCGGTTCCCTCCGTCTGTCCTGTGCTGCA<br>TCTGGATTCACTTTTTCTAGCTACCCAATGTCATGGGTGCGCCAGGCCCCAGGC<br>AAAGGGCTGGAGTGGATCTCAACTATCTCCGCAGGTGGCGATACTACCCTCTAC<br>GCTGACTCCGTGAAGGGCGGTTTACCAGTTCCCGTGACAACGCCAAGAACACT<br>TTGTATCTTCAGCTGAACTCATTGAAGACTGAGGACACCGCCATCTATTACTGC<br>GCTAAGAGAATCGACTGCAACTCAGGGTACTGCTATAGACGCAACTATTGGGGC<br>CAGGGGACTCAGGTGACCGTGTCAAGC |
| DR593-<br>hIL27Ra_<br>VH<br>H8 | 1065 | CAGGTGCAGTTGCAGGAAAGCGGCGGTGGCTCCGTGCAGGCTGGGGGCTCTCTG<br>CGTTTGTCATGTGCCGCAAGTGGATACCCCTACAGCAACGGCTACATGGGCTGG<br>TTCAGGCAGGCTCCCGGAAAGGAGCGCGAAGGGGTGGCCACCATCTACACTGGG<br>GATGGAAGGACTTACTATGCGGATAGCGTAAAGGGGCGTTTTACTATCTCCAGA<br>GACAATGCCAAAAACACAGTTGACCTCCAGATGTCTAGCTTGAAGCCTGAAGAC<br>ACTGCCATGTACTATTGTGCAGCGCGGGCAGCCCCGCTGTATAGCTCCGGCTCC<br>CCTCTGACACGCGCCCGCTACAACGTGTGGGACAGGGCACCCAGGTTACCGTG<br>AGTTCCGCGGTGGGTCCCAGGTCCAGCTTCAGGAGTCCGGGGCGGTTCCGTC<br>CAAGTTGGTGGCAGCCTGCGCCTGTCCTGCGCTGCCTCCGGGTTTACTTTCAGT<br>TCCTACCCAATGTCATGGGTGCGCCAGGCTCCTGGTAAGGGGCTGGAATGGATT<br>TCTACTATCAGTGCAGGCGGAGATACGACCCTCTACGCCGATAGCGTGAAGGGG<br>CGGTTCACTTCATCTCGTGATAACGCCAAGAACACCCTGTACCTTCAGCTGAAC<br>TCCCTGAAGACGGAAGACACCGCCATTTATTACTGCGCGAAGAGGATCGACTGC<br>AACTCCGGCTACTGCTATCGTCGCAACTATTGGGGCCAGGGTACGCAGGTGACG<br>GTCAGTTCC |

TABLE 1B-continued

| Name | SEQ ID NO: | Sequence |
|---|---|---|
| DR593-hIL27Ra_VH H8 | 1066 | CAGGTGCAGCTCCAGGAGTCAGGCGGTGGCTCTGTGCAGGCCGGAGGGTCTCTC CGGTTGAGTTGTGCAGCTTCAGGCTACCCTTATAGCAACGGCTACATGGGATGG TTCAGACAGGCACCCGGTAAGGAACGCGAGGGCGTAGCCACGATCTACACTGGT GATGGGAGGACCTATTACGCTGACTCTGTGAAAGGTCGCTTCACAATTAGTCGC GATAACGCTAAGAACACCGTGGATCTCCAGATGAGCAGTTTGAAGCCTGAGGAC ACCGCAATGTACTATTGTGCTGCACGCGCGGCCCCTCTCTACAGTTCCGGCAGC CCACTGACTAGAGCCCGGTACAACGTCTGGGGCCAAGGCACCCAGGTCACCGTC AGTAGCGGCGGGAGCGGAGGCTCCGGTGGCTCCGGCCAGGTGCAGCTCCAGGAG TCTGGAGGCGGATCTGTCCAGGTTGGAGGGAGCCTGCGCTTGAGTTGCGCTGCC AGCGGATTCACCTTTTCTTCATACCCCATGAGCTGGGTGCGCCAAGCGCCCGGA AAGGGGCTGGAGTGGATCTCAACGATCAGCGCCGGAGGTGATACAACCCTCTAC GCAGACAGCGTCAAAGGCAGGTTTACATCTAGCCGCGACAACGCAAAGAACACC CTGTATTTGCAGCTGAACAGCCTGAAAACGGAAGACACCGCCATCTATTACTGC GCCAAAAGAATTGATTGCAATTCTGGTTATTGTTACAGACGCAATTACTGGGGA CAGGGGACCCAGGTTACAGTCTCCAGT |
| DR593-hIL27Ra_VH H9 | 1067 | CAGGTCCAGCTTCAGGAAAGCGGCGGGGGTAGCGTCCAGGCAGGTGGCAGCCTG CGTCTGAGCTGTGCGGCCAGCGGTTATCCTTACTCCAACGGTTACATGGGCTGG TTCCGCCAGGCCCCTGGCAAGGAGCGTGAGGGAGTGGCCACCATCTACACTGGA GATGGAAGAACCTACTATGCAGATTCAGTTAAGGGCAGGTTTACAATCAGCCGC GATAATGCCAAGAACACAGTCGATCTCCAGATGTCCTCTCTGAAGCCCGAAGAC ACTGCCATGTATTACTGTGCTGCACGCGCTGCCCCGCTGTATTCTTCAGGTAGT CCCCTCACACGCGCCCGCTACAACGTGTGGGGCAGGGTACACAGGTAACTGTG TCTAGCGGCGGTGGGAGCCAGGTCCAGCTCCAGGAGTCTGGTGGCGGATCTGTG CAGAGCGGGGGTTCCCTGCGCCTGTCCTGTGCTGCCTCGGGTTCACGTATAGC ACTTCCAACAGCTGGATGGCCTGGTTCCGTCAAGCGCCTGGAAAGGAGCGTGAG GGGGTGGCTGCCATCTATACAGTGGGAGGTTCTATCTTTTACGCAGACAGCGTG CGTGGACGTTTCACAATCTCTCAAGACGCTACTAAGAATATGTTTTACCTTCAG ATGAACACTCTCAAGCCCGAGGACACCGCAATGTATTACTGCGCTGCGGCATCT GGCCGCCTGAGAGGCAAGTGGTTTTGGCCCTACGAGTATAATTACTGGGGCCAG GGCACGCAGGTGACGGTCTAGT |
| DR593-hIL27Ra_VH H9 | 1068 | CAAGTTCAACTTCAGGAGAGTGGGGGTGGCTCTGTGCAGGCCGGTGGCTCTCTG AGACTCAGTTGTGCTGCCTCCGGTTACCCTTATTCCAACGGCTACATGGGCTGG TTCCGTCAGGCCCCAGGCAAGGAGCGCGAAGGCGTCGCCACATTTACACAGGC GACGGACGCACATACTATGCTGATTCTGTGAAGGGCAGATTTACCATCAGCCGG GATAACGCCAAAAATACCGTGGACCTTCAAATGAGTTCTCTGAAGCCTGAGGAT ACCGCCATGTATTACTGCGCCGCGCGGGCAGCTCCCCTCTACAGCAGTGGTTCC CCGCTGACCCGCGCCCGCTATAACGTGTGGGGCCAAGGCACCAGGTGACCGTG TCCAGCGGGGGCTCCGGGGGCTCTGGGGGCTCAGGACAGGTCCAGTTGCAGGAA TCTGGCGGTGGCAGCGTTCAGAGTGGAGGTTCCCTGCGGCTCTCTTGTGCCGCT TCCGGCTTCACCTACTCAACCTCTAATAGCTGGATGGCCTGGTTCCGTCAAGCC CCCGGCAAGGAGCGCGAAGGCGTGGCTGCAATCTACACCGTAGGCGGATCTATC TTCTACGCCGATTCAGTGCGCGGCAGGTTTACCATCTCACAGGACGCCACTAAG AATATGTTTTATTTGCAGATGAATACTCTGAAGCCTGAGGACACCGCTATGTAT TACTGCGCTGCGGCCAGTGGCCGCCTGAGGGGCAAGTGGTTCTGGCCATACGAA TACAACTACTGGGGACAGGGGACCCAGGTTACAGTTAGTAGC |
| DR593-hIL27Ra_VH H10 | 1069 | CAGGTGCAGTTGCAGGAATCTGGGGGTGGCAGTGTGCAGGCTGGAGGCTCCCTG CGCCTGTCCTGTGCGGCCTCTGGCTATCCATATAGTAATGGTTACATGGGATGG TTTAGGCAGGCTCCGGGCAAGGAGCGCGAGGGCGTGGCCACTATCTACACTGGT GATGGTCGGACCTACTATGCTGACTCTGTGAAGGGGCGCTTCACAATTTCTCGG GATAACGCCAAAAATACCGTGGACTTGCAGATGAGTTCCCTCAAACCGGAAGAC ACCGCCATGTATTACTGTGCAGCTAGGGCGGCACCGCTGTATAGTTCTGGCAGC CCTCTGACTCGGGCTCGCTATAATGTCTGGGGCCAGGGAACCCAGGTTACAGTC TCCAGCGGGGGTGGGTCCCAAGTCAGTTGCAGGAATCCGGTGGGGTTCCGTT CAGGCCGGAGGCTCACTGCGGCTGTCTTGCAGAGCGTCCGGCTCCACTTACTCT AACTATTGCCTGGGCTGGTTCCGTCAGATTACTGGCAAGGAGAGGGAGGGCGTG GCCGTCATAAATTGGGTGGGAGGTATGCTGTACTTTGCCGATTCAGTTAAAGGA CGTTTTACGGTGAGCCAGGACCAGGCTAAGAACACCCTTTACCTTCAGATGAAC AGCCTGAAGCCCGAAGCACAGCCATGTACTATTGTGCTGCGGAGTCCGTGTCT AGCTTTTCTTGCGGAGGCTGGCTCACGAGACCGGATAGAGTGCCATACTGGGGC CAGGGCACCCAGGTGACCGTCTCCAGC |
| DR593-hIL27Ra_VH H10 | 1070 | CAGGTGCAGCTCCAGGAAAGCGGAGGCGGGTCTGTCCAGGCAGGGGGCTCCCTG AGACTCTCTTGTGCTGCGAGCGGTTATCCTTATAGCAACGGGTATATGGGATGG TTTCGCCAGGCTCCGGGGAAGGAGCGCGAGGGTGTGGCTACCATCTATACGGGT GATGGTCGGACTTACTATGCAGACAGTGTCAAGGGCCGCTTCACCATCAGCAGA GACAACGCAAAAATACCGTGGACTTGCAGATGTCATCCCTCAAGCCAGAGGAC ACAGCAATGTATTACTGCGCCGCGAGAGCTGCGCCCCTGTACTCCTCTGGATCT CCCTTGACCAGAGCCCGCTATAATGTCTGGGGACAGGGAACCCAGGTAACAGTG TCCAGCGGAGGTTCCGGGGGTTCTGGAGGTTCTGGACAGGTTCAACTCCAGGAG TCTGGCGGGGGCTCAGTCCAGGCTGGCGGGTCTTTGCGCCTGTCCTGTCGGGCC AGCGGCTCCACCTACTCCAACTACTGCCTCGGTTGGTTCCGCCAGATTACTGGC AAAGAGCGTGAGGGCGTGGCTGTTATCAACTGGGTGGGCGGAATGCTGTACTTC GCCGATTCTGTTAAGGGACGCTTCACCGTCTCTCAGGACCAGGCCAAGAACACG CTGTATTTGCAGATGAACAGTCTGAAGCCAGAGGATACAGCAATGTATTACTGT |

TABLE 1B-continued

| Name | SEQ ID NO: | Sequence |
|---|---|---|
| | | GCTGCGGAGTCTGTTAGCTCTTTTTCCTGTGGTGGCTGGCTGACCAGGCCGGAT<br>CGCGTGCCTTACTGGGGCAGGGAACCCAGGTGACTGTCAGCAGT |
| DR593-<br>IL27Ra_<br>VH<br>H11 | 1071 | CAGGTGCAGCTTCAGGAGTCCGGCGGAGGCAGTGTCCAGGCAGGGGGCTCCCTG<br>CGCCTCTCTTGTGCGGCCTCTGGATATCCCTACTCTAACGGATACATGGGCTGG<br>TTTCGTCAGGCCCCAGGAAAAGAGCGGGAGGGGGTGGCGACAATCTACACTGGC<br>GATGGCCGCACCTACTATGCTGATTCCGTTAAGGGGCGCTTCACCATCAGCAGA<br>GACAACGCAAAGAACACTGTCGATCTTCAGATGAGTTCCCTCAAACCTGAAGAC<br>ACAGCCATGTATTACTGTGCAGCCCGCGCGGCCCCTCTTTACAGCTCTGGGAGC<br>CCCCTGACACGCGCTCGCTACAATGTTTGGGGTCAGGGCACACAGGTGACAGTC<br>TCCTCTGGCGGAGGCTCCCAAGTCCAGCTTCAGGAATCCGGCGGTGGGAGTGTG<br>CAAGCTGGTGGATCTCTGCGCCTGAGCTGTAGGGCCTCCGGCAGCACATACTCT<br>AACTACTGCCTGGGCTGGTTTAGGCAGTCCACAGGAAAAGAACGCGAAGGAGTC<br>GCGGTAATAAATTGGGTCGGGGTATGCTCTACTTCGCCGACTCCGTGAAAGGC<br>CGCTTCACAGTGTCTCAGGATCACGCCAAAAATACCGTAACCCTTCAGATGAAC<br>TCCTTGAAGCCAGAGGACACCGCGATGTATTACTGCGCTGCGGAGTCCGTATCC<br>AGCTTCAGCTGTGGTGGCTGGCTGACCCGCCCAGGACGGGTTCCATACTGGGGC<br>CAGGGTACACAGGTCACAGTGTCTAGC |
| DR593-<br>hIL27Ra_<br>VH<br>H11 | 1072 | CAGGTGCAGCTCCAGGAGTCCGGCGGAGGGTCCGTCCAGGCCGGAGGTTCCCTC<br>CGTCTGTCTTGCGCCGCGTCCGGTTATCCTTACAGCAACGGCTATATGGGTTGG<br>TTCCGTCAGGCCCCCGGAAAGGAAAGAGAAGGCGTCGCCACGATCTACACCGGG<br>GATGGCAGGACCTACTATGCTGACTCCGTGAAGGGCCGCTTCACAATTAGTCGC<br>GACAATGCCAAGAACACGGTGGACCTCCAGATGTCTTCACTTAAACCCGAGGAC<br>ACCGCTATGTATTACTGTGCAGCCAGAGCAGCTCCTCTGTACTCCTCAGGCTCT<br>CCCCTCACCCGTGCTCGCTACAACGTGTGGGACAGGGCACACAGGTCACAGTG<br>TCATCCGGGGGTTCCGGTGGCAGTGGAGGCAGCGGACAGGTACAGCTTCAGGAG<br>TCCGGCGGGGGTTCTGTGCAGGCTGGAGGCTCTTTGCGCCTTAGCTGTCGCGCG<br>AGCGGTTCCACCTACTCCAATTACTGCCTGGGTTGGTTCAGGCAGAGCACCGGC<br>AAGGAGCGCGAAGGAGTGGCCGTCATCAACTGGGTCGGTGGGATGCTCTATTTT<br>GCTGACTCTGTGAAGGGCAGGTTTACTGTGAGCCAGGACCATGCCAAGAACACT<br>GTGACTCTCCAGATGAATAGTCTTAAACCAGAGGACACGGCTATGTATTACTGT<br>GCAGCCGAATCAGTCTCCTCTTTCTCTTGTGGTGGGTGGTTGACGAGGCCGGGT<br>CGTGTTCCCTATTGGGGCCAGGGGACCCAGGTGACTGTATCCTCT |
| DR593-<br>hIL27Ra_<br>VH<br>H12 | 1073 | CAGGTGCAGCTCCAAGAGTCCGGTGGCGGGAGCGTGCAGGCGGGCGGTTCCCTT<br>CGCCTGTCTTGTGCTGCCTCCGGCTACCCCTACTCTAATGGCTACATGGGCTGG<br>TTCCGCCAAGCTCCAGGGAAGGAAAGGGAAGGCGTGGCCACTATTTACACGGGC<br>GACGGTCGCACATATTACGCTGACTCTGTTAAAGGCCGCTTCACTATCTCCAGA<br>GACAACGCAAAGAACACGGTGGACCTCCAGATGTCCTCTCTGAAGCCCGAAGAC<br>ACCGCTATGTATTACTGCGCTGCAAGGGCTGCCCCTCTGTACTCCAGCGGTTCC<br>CCTCTGACCAGAGCCCGCTATAACGTCTGGGCCAAGGAACACAGGTCACTGTC<br>AGCTCCGGTGGCGGGTCACAGGTGCAGCTTCAGGAGAGCGGCGGGGGCAGTGTC<br>CAAGCTGGTGAGAGCCTCAGACTGAGTTGCAGAGCCAGCGGTTCCACCTACTCC<br>AACTACTGCTTGGGTTGGTTCAGGCAGATCACAGGCAAGGAGCGTGAGGGCGTC<br>GCTGTCATCAACTGGGTGGGCGGGATGCTCTACTTTGCTGACAGCGTTAAGGGC<br>CGGTTCACCGTGAGCCAGGATCAGGCGAAGAACACGGTTTATCTGGAGATGAAC<br>TCACTGAAGCCCGAGGATACAGCTATGTATTACTGTGCAACTGAGTCAGTTTCC<br>TCTTTCTCCTGCGGCGGGTGGCTGACCAGGCCGGATAGGGTGCCGTATTGGGGC<br>CAAGGGACTCAGGTTACCGTCTCCTCT |
| DR593-<br>hIL27Ra_<br>VH<br>H12 | 1074 | CAAGTGCAGCTCCAAGAATCAGGAGGCGGTTCCGTGCAGGCCGGGGGCTCCCTG<br>CGCTTGTCTTGCGCGGCCAGCGGGTATCCCTACTCTAATGGTTACATGGGCTGG<br>TTCCGTCAGGCTCCTGGCAAGGAACGGGAGGGAGTGGCCACTATCTATACTGGC<br>GACGGGAGGACCTACTATGCCGACTCCGTGAAGGGCCGGTTCACCATCAGCCGC<br>GACAACGCAAAAATACCGTGGACTTGCAAATGAGTTCCCTGAAGCCCGAGGAC<br>ACCGCGATGTACTATTGTGCGGCCCGCGCCGCGCCTCTGTACTCCAGTGGGAGC<br>CCTCTCACCCGCGCCAGATACAACGTGGGGCAGGGCACCCAGGTCACGGTG<br>TCTAGCGGAGGCAGCGGTGGATCTGGTGGCTCTGGACAAGTGCAACTCCAGGAG<br>TCAGGCGGTGGCTCCGTGCAGGCTGGCGAGAGCTTGCGGCTGTCTCGCGCGCG<br>TCTGGCAGCACGTACAGCAATTACTGCCTGGGATGGTTCCGGCAGATCACCGGG<br>AAAGAGCGTGAGGGAGTCGCCGTGATTAACTGGGTCGGGGCATGTTGTATTTT<br>GCTGATTCCGTGAAAGGGCGCTTTACCGTCAGCCAGGACCAGGCCAAGAACACG<br>GTGTATCTTGAGATGAACTCACTCAAGCCTGAGGACACAGCTATGTATTACTGT<br>GCGACCGAGTCCGTGTCATCTTTTTCCTGTGGCGGTTGGCTTACAAGGCCTGAT<br>CGCGTTCCTTACTGGGGCCAGGGCACTCAGGTGACCGTGTCTAGC |
| DR593-<br>hIL27Ra_<br>VH<br>H13 | 1075 | CAGGTACAGTTGCAGGAAAGTGGCGGAGGCAGCGTGCAGGCCGGGGGCAGTCTC<br>CGTCTGTCTTGTGCCGCTAGTGGCTATCCCTATTCTAACGGCTATATGGGATGG<br>TTCCGCCAGGCACCCGGCAAAGAGAGGGAAGGCGTCGCCACCATCTACACAGGT<br>GATGGAAGGACATACTATGCAGACAGCGTGAAGGGCCGCTTCACGATTAGCCGC<br>GACAACGCGAAGAACACTGTGGATCTCCAAATGAGTTCCCTCAAGCCTGAGGAC<br>ACTGCGATGTATTACTGCGCAGCCAGAGCAGCTCCCCTTTACAGCAGTGGAAGC<br>CCGCTGACTCGGGCAAGATACAACGTCTGGGCCAGGGAACTCAGGTTACGGTA<br>TCTTCCGGCGGTGGATCTCAGGTTCAGCTTCAGGAATCAGGCGGTGGATCAGTG<br>CAGGCGGGCGGAAGTTTGCGCCTGTCCTGTGTAGCCTCCGGGTACGTCTCCTGT<br>GACTATTTCCTGCCCAGCTGGTATAGGCAGGCCCCCGGCAAGGAGCGCGAGTTC TABLE 1B-continued

| Name | SEQ ID NO: | Sequence |
|---|---|---|
| | | GTGTCCATCATTGATGGCACCGGGTCCACGTCCTACGCCGCTTCTGTGAAGGGG<br>AGATTCACGGCGAGCCAAGATCGCGGCAAAAACATCGCATACTTGCAGATGAAC<br>TCACTCAAGCCCGAGGATACCGCCATGTATTACTGTAAGGCCAGCTGCGTTCGC<br>GGTCGCACTATCTCTGAATATTGGGGCCAGGGAACCCAGGTGACAGTAAGCAGT |
| DR593-<br>hIL27Ra_<br>VH<br>H13 | 1076 | CAAGTGCAGCTCCAGGAGAGTGGTGGGGGCTCCGTACAGGCGGGCGGTTCTCTG<br>CGCCTTAGTTGCGCGGCCAGCGGCTACCCTTATTCCAACGGTTACATGGGCTGG<br>TTCCGCCAGGCACCAGGCAAAGAGAGAGAGGGGGTTGCAACCATCTACACTGGC<br>GATGGTAGAACTTATTACGCCGACTCTGTAAAGGGGCGCTTCACAATTTCCCGT<br>GATAATGCCAAGAACACCGTTGACCTCCAGATGAGCAGTCTGAAGCCAGAGGAT<br>ACAGCCATGTATTACTGCGCCGCTCGGGCAGCCCCACTCTACAGCTCCGGTAGC<br>CCCCTGACCCGTGCCCGCTACAACGTGTGGGACAGGGCACACAGGTCACCGTG<br>TCCTCTGGTGGCTCCGGGGGCAGCGGCGGATCAGGCCAGGTGCAGCTCCAGGAA<br>AGCGGAGGCGGATCTGTGCAAGCCGGAGGCTCTCTGAGACTCTCCTGTGTTGCC<br>AGCGGCTACGTGTCCTGTGACTACTTCTTGCCTTCTTGGTATCGTCAGGCACCT<br>GGAAAGGAGCGTGAGTTCGTGTCCATCATTGACGGCACAGGCTCTACCTCCTAC<br>GCCGCGAGCGTGAAGGGTCGTTTCACCGCTTCACAGGATCGCGGTAAGAACATC<br>GCGTATCTCCAGATGAACTCCCTGAAACCCGAAGACACCGCCATGTATTACTGC<br>AAAGCCTCCTGTGTGCGCGGGCGCACGATCAGCGAATACTGGGGGCAGGGTACA<br>CAGGTCACCGTGTCCTCC |
| DR593-<br>hIL27Ra_<br>VH<br>H14 | 1077 | CAGGTGCAGTTGCAGGAGAGCGGTGGAGGCTCCGTTCAGGCAGGTGGCAGCCTG<br>CGGCTCTCCTGCGCCGCATCCGGTTACCCATACAGCAATGGCTACATGGGATGG<br>TTCCGCCAAGCGCCTGGAAAAGAAAGGGAAGGTGTGGCCACTATCTACACTGGT<br>GATGGCCGGACGTACTATGCCGACTCAGTGAAGGGCCGGTTCACAATCAGCCGG<br>GATAACGCTAAGAACACAGTGGATCTTCAGATGAGTTCCCTGAAACCCGAGGAC<br>ACTGCCATGTATTACTGTGCGCCAGGGCGGCTCCCCTGTACTCTTCCGGCTCC<br>CCCTTGACCCGTGCCCGTTATAATGTGTGGGTCAAGGCACACAGGTCACTGTG<br>TCTTCCGGGGAGGCTCCCAGGTCCAACTCCAGGAAAGTGGTGGAGGCTCTGTG<br>CAGGCAGGCGGTTCCCTCCGCCTGAGCTGTGTGGCCTCCGGCTACGTGTCATGT<br>GATTACTTTCTGCCAAGCTGGTATCGTCAGGCTCCCGGTAAGGAGCGCGAGTTC<br>GTTAGCATTATCGACGGCACCGGCTCCACCAGCTATGCGGCCAGCGTCAAGGGG<br>CGCTTCACCGCCTCTCAGGACAAAGGTAAGAACATCGCCTACCTGCAAATGAAC<br>TCCCTGAAGCCCGAGGACACAGCCATGTATTACTGCAAGGCCTCCTGTGTCAGA<br>GGTAGGGCGATCTCAGAGTACTGGGGTCAGGGAACCCAGGTGACCGTGTCCTCC |
| DR593-<br>hIL27Ra_<br>VH<br>H14 | 1078 | CAAGTGCAGTTGCAGGAGAGCGGCGGAGGCTCTGTGCAGGCGGGAGGCAGTCTG<br>AGACTGTCCTGTGCCGCTTCCGGCTACCCCTATAGCAACGGTTATATGGGTTGG<br>TTCCGCCAGGCCCCAGGAAAAGAGCGCGAGGGCGTAGCGACTATTTACGCGGGT<br>GATGGTAGAACTTACTATGCAGATTCAGTAAAGGGCCGTTTCACCATTTCCCGT<br>GACAACGCTAAGAATACCGTAGATTTGCAGATGTCTTCCCTGAAGCCGGAAGAC<br>ACTGCCATGTATTACTGCGCTGCACGCGCGGCTCCCCTTTATTCTTCCGGGTCA<br>CCACTCACCCGTGCCCGCTACAACGTGTGGGCAGGGCACGCAGGTCACTGTA<br>TCCAGCGGAGGCAGCGGCGGAAGCGGGGGCTCTGGCCAAGTCCAGCTCCAGGAG<br>TCAGGCGGTGGCTCAGTCCAGGCTGGGGGCTCACTGCGCCTGAGCTGCGTGGCC<br>TCTGGCTATGTCAGTTGTGATTACTTCCTTCCGAGCTGGTATCGCCAAGCGCCT<br>GGGAAGGAGAGGGAGTTCGTGTCTATTATCGACGGGACCGGCAGCACCAGCTAT<br>GCGGCTAGTGTGAAGGGCCGTTTCACCGCTTCCCAGGATAAGGGCAAGAACATC<br>GCCTATTTGCAAATGAACAGTCTTAAACCGGAGGATACTGCTATGTACTATTGC<br>AAGGCCTCCTGCGTGCGGGGAAGAGCCATCAGTGAGTACTGGGGGCAGGGCACC<br>CAGGTCACGGTATCCTCC |
| DR593-<br>hIL27Ra_<br>VH<br>H15 | 1079 | CAGGTTCAGCTTCAGGAGAGTGGAGGCGGTAGCGTGCAGGCCGGGGGCAGCTTG<br>CGCCTGTCTTGCGCTGCCTCCGGTTACCCTTATAGTAACGGATACATGGGTTGG<br>TTCAGGCAGGCCCCCGGCAAAGAGAGAGAGGGCGTTGCTACCATTTACACCGGC<br>GATGGCCGCACCTACTATGCTGACTCTGTGAAGGGTCGCTTCACAATCTCCCGT<br>GATAACGCTAAAAATACCGTCGATCTCCAGATGTCTTCCCTGAAACCCGAGGAT<br>ACTGCAATGTATTACTGTGCTGCCCGCGCCGCTCCTCTGTACTCTTCAGGTTCT<br>CCTCTGACCCGCGCCAGGTACAACGTCTGGGGTCAGGGCACCCAGGTTACCGTA<br>AGCTCCGGTGGAGGCTCTCAAGTCAGTTGCAGGAATCAGGAGGTGGCTCCGTC<br>CAGGCAGGTGGGAGCCTCCGCCTCTCATGCGTCGCAAGCGGCTACGTGAGCTGC<br>GACTACTTCTTGCCCTCATGGTATCGCCAGGCTCCTGGGAAGGAGCGTGAGTTC<br>GTGAGCATCATTGACGGCACCGGCTCCACCAGCTATGCCGCTTCCGTGAAGGGC<br>CGGTTCACTGCGTCCCAGGATAAGGGCAAGAACATCGCGTACCTTCAGATGAAC<br>ACCCTGAAGCCGGAGGATACAGCTATGTACTATTGCAAGGCATCTTGCGTGAGG<br>GGTAGAGCCATCAGCGAGTATTGGGGCCAAGGAACCCAGGTGACTGTTTCCTCT |
| DR593-<br>hIL27Ra_<br>VH<br>H15 | 1080 | CAGGTGCAGTTGCAGGAGTCCGGTGGGGGATCTGTGCAGGCGGGAGGGAGCCTG<br>CGTCTTAGCTGCGCCGCAAGCGGATACCCCTACTCCAACGGATACATGGGTTGG<br>TTTCGCCAAGCCCCTGGGAAGGAAAGGGAGGGCGTGGCCACCATCTATACCGGA<br>GATGGCCGCACCTATTACGCTGATTCCGTGAAGGGACGTTTCACAATCAGCAGA<br>GATAACGCTAAGAACACTGTGGACCTCCAGATGTCTAGCCTGAAACCCGAAGAC<br>ACTGCCATGTATTACTGCGCGGCCAGAGCAGCCCCTCTGTATTCCTCTGGAAGC<br>CCGTTGACCAGAGCCCGCTACAATGTGGGGACAGGGCACCCAGGTCACTGTG<br>TCATCCGGCGAAGCGGCGGTAGTGGGGCTCTGGCCAAGTTCAGCTCCAGGAA<br>AGCGGCGGAGGCAGCGTGCAGGCTGGCGGATCACTGAGATTGAGCTGTGTTGCT<br>TCCGGCTATGTGAGCTGTGATTATTCCTCCCCAGCTGGTACAGACAGGCTCCC |

TABLE 1B-continued

| Name | SEQ ID NO: | Sequence |
|---|---|---|
| | | GGCAAGGAACGCGAGTTTGTCAGTATCATTGATGGCACCGGCTCTACCAGTTAC<br>GCTGCGTCAGTTAAAGGACGCTTCACCGCGTCCCAAGACAAAGGCAAGAACATC<br>GCCTATTTGCAGATGAACACCCTGAAGCCAGAAGACACTGCCATGTATTACTGC<br>AAGGCTTCTTGCGTGCGCGGTCGCGCCATTTCTGAATACTGGGGCCAGGGCACT<br>CAAGTCACCGTGTCTTCC |
| DR593-<br>hIL27Ra_<br>VH<br>H16 | 1081 | CAGGTGCAGCTCCAGGAGTCTGGAGGCGGAAGTGTCCAGGCTGGCGGTAGCCTG<br>CGGCTTTCATGTGCCGCTTCCGGCTACCCGTACTCAAACGGCTACATGGGCTGG<br>TTCAGACAAGCGCCTGGAAAAGAGAGAGAAGGCGTGGCCACCATCTATACAGGT<br>GATGGCCGTACTTATTACGCTGACTCCGTCAAGGGCCGCTTCACCATCAGCCGG<br>GATAACGCTAAGAATACCGTCGATCTTCAAATGAGTTCCTTGAAGCCGGAAGAC<br>ACCGCTATGTATTACTGTGCCGCGGGCTGCCCCGCTGTATAGTAGCGGCTCT<br>CCCCTCACCCGCGCTCGCTACAACGTGTGGGGACAGGGGACTCAAGTAACCGTG<br>AGTTCCGGCGGTGGCTCTCAGGTGCAGCTGCAAGAAAGCGGCGGGGGCTCCGTG<br>CAGGCAGGCGGAAGCCTGCGCCTGTCTTGCAGAGCCTCCGGCAGTACCTACAGT<br>AACTATTGTCTGGGCTGGTTTCGCCAGATCACAGGTAAAGAGAGAGAAGGTGTT<br>GCCGTTATCAACTGGGTAGGTGGAATGCTGTACTTTGCCGATTCCGTGAAGGGT<br>CGCTTCACCGTGTCCCAAGACCAAGCCAAGAATACTGTATATTTGCAGATGAAC<br>TCCCTGAAGCCCGAGGACACAGCTATGTACTATTGTGCCGCTGAGTCTGCTAGT<br>AGCTTTTCCTGCGGGGGTTGGCTGACCCGCCCGGACCGCGTCCCCTACTGGGGA<br>CAGGGCACCCAGGTAACCGTGAGTTCT |
| DR593-<br>hIL27Ra_<br>VH<br>H16 | 1082 | CAGGTGCAGTTCAGGAGTCTGGGGGTGGAAGCGTGCAAGCCGGGGGATCTCTG<br>CGGCTGAGCTGCGCTGCCAGTGGATATCCATATTCAACGGCTATATGGGCTGG<br>TTTCGCCAAGCGCCCGGCAAGGAGCGCGAAGGCGTCGCCACAATCTACACAGGC<br>GATGGCCGCACCTATTACGCTGATTCCGTTAAAGGACGGTTCACGATCAGCCGC<br>GACAACGCCAAGAACACAGTTGACCTCCAGATGTCCAGCCTGAAGCCCGAGGAT<br>ACTGCGATGTATTACTGTGCCGCGAGAGCTGCCCCACTCTACAGTTCCGGGAGC<br>CCCCTTACTCGCGCCCGTTACAATGTTTGGGGACAGGGCACTCAAGTGACAGTG<br>TCCAGCGGAGGTTCCGGTGGCTCCGGCGGGTCTGGACAGGTGCAGTTGCAGGAG<br>TCCGCGGAGGGAGCGTACAGGCCGGGGGCTCTTTGCGTCTGTCTTGCAGAGCT<br>TCCGGGTCTACCTATTCCAATTATTGTCTGGGTTGGTTCCGCCAGATTACTGGC<br>AAGGAGCGTGAAGGGGTCGCCGTCATCAACTGGGTGGGTGGGATGCTCTATTTC<br>GCGGATAGTGTGAAGGGCCGCTTTACAGTCTCTCAGGACCAGGCTAAGAATACT<br>GTCTATCTTCAGATGAACTCTTTGAAGCCCGAGGATACGGCCATGTACTATTGC<br>GCTGCGGAAAGTGCCTCTAGCTTCAGCTGTGGCGGTTGGCTCACCCGCCCAGAC<br>CGCGTCCCCTACTGGGGCCAGGGAACCCAGGTGACAGTGTCCAGT |
| DR593-<br>hIL27Ra_<br>VH<br>H17 | 1083 | CAGGTTCAGCTGCAAGAATCCGGCGGAGGGTCCGTCCAAGCGGGAGGCAGTCTC<br>AGACTTTCCTGCGCAGCTTCTGGATACCCTTACTCTAACGGATATATGGGTTGG<br>TTTAGACAGGCACCCGGCAAGGAGAGGGAAGGCGTGGCCACGATCTACACTGGG<br>GATGGCAGGACCTATTACGCAGACAGCGTGAAGGGCCGCTTCACCATTTCCAGA<br>GATAATGCTAAGAACACCGTTGATCTCCAGATGAGTTCCCTGAAGCCAGAAGAT<br>ACCGCCATGTATTACTGCGCTGCCCGCGCCGCGCCTCTTTACAGCTCTGGGAGC<br>CCGCTGACTCGTGCTAGGTATAACGTCTGGGGCCAGGGAACCCAGGTGACTGTC<br>AGCTCTGGGGGCGGGAGCCAGGTGCAGCTCCAGGAGAGTGGCGGTGGCCTTGTT<br>CAGCCCGGTGGCTCCTTGCGGCTGTCATGTGCTGCCTCCGGCTTCACATTTTCT<br>CTGAGCGGGATGTCCTGGGTGCGGCAGGCCCCCGGCAAGGGCCTTGAGTGGGTC<br>TCCGCTATCTCCAGCGGCGGTGCAAGCACTTACTATACCGACAGCGTCAAGGGC<br>CGTTTCACTATCTCACGCGATAACGCCAAAAACATGCTGTATCTCCAGCTGAAC<br>TCCCTCAAGACCGAGGATACCGCTATGTACTATTGTGCCAAAGGCGGTTCCGGC<br>TATGGCGATGCGTCCCGCATGACTTCTCCCGGCTCCCAGGGCACTCAGGTTACC<br>GTGTCTAGC |
| DR593-<br>hIL27Ra_<br>VH<br>H17 | 1084 | CAAGTTCAGCTTCAGGAGAGTGGAGGCGGATCTGTCCAGGCAGGTGGCTCACTT<br>AGGCTGTCTTGTGCTGCCAGTGGCTACCCCTACTCCAACGGATATATGGGTTGG<br>TTTCGCCAGGCACCAGGGAAGGAGCGCGAGGGCGTCGCTACCATCTACACTGGC<br>GACGGACGCACCTACTATGCGGACAGCGTGAAGGGCCGGTTCACCATCAGCCGC<br>GACAACGCCAAAAACACCGTCGATTTGCAGATGTCTTCCCTGAAGCCTGAAGAC<br>ACAGCCATGTATTACTGTCCGCGCGTGCTGCCCCACTCTACTCCTCTGGGAGC<br>CCCCTCACCCGTGCCCGCTACAACGTGTGGGGACAGGGCACACAGGTGACCGTT<br>TCCAGTGGTGGCAGCGGTGGCAGCGGGGGTTCCGGCCAGGTCCAGCTCCAGGAG<br>TCAGGGGGTGGGCTGGTGCAGCCCGGCGGTAGCCTGCGCTTGTCCTGCGCTGCC<br>AGCGGGTTCACCTTCAGTCTGTCAGGTATGTCCTGGGTAAGGCAGGCTCCCGGT<br>AAGGGCCTGGAGTGGGTATCCGCCATCTCTAGCGGTGGAGCCAGCACCTATTAC<br>ACTGATTCAGTAAAAGGACGCTTCACCATTAGCAGGGACAACGCCAAAAACATG<br>CTGTATCTTCAACTGAACTCCCTCAAGACTGAGGACACAGCCATGTACTATTGC<br>GCCAAGGGAGGGTCTGGCTACGGCGATGCCTCCAGGATGACCTCCCCCGGTAGC<br>CAGGGCACTCAGGTGACAGTGTCAAGC |
| DR593-<br>hIL27Ra_<br>VH<br>H18 | 1085 | CAGGTGCAGCTCCAGGAGAGCGGTGGGGGAAGCGTGCAGGCTGGCGGAAGCCTC<br>CGCCTGTCCTGTGCGGCATCTGGCTACCCATATTCTAACGGTTATATGGGCTGG<br>TTTCGGCAAGCGCCTGGGAAGGAGCGCGAGGGGGTCGCCACCATTTATACTGGC<br>GATGGCCGCACCTATTACGCCGATTCTGTGAAGGGCCGCTTCACGATTTCTAGG<br>GATAACGCTAAAAACACCGTGGATCTGCAAATGTCCAGCCTGAAGCCAGAAGAC<br>ACAGCCATGTACTATTGCGCCGCTCGGGCCGCTCCTTTGTACTCATCGGCTCA<br>CCTCTCACTAGAGCCCGTTACAACGTCTGGGGACAGGGTACTCAGGTTACCGTA |

TABLE 1B-continued

| Name | SEQ ID NO: | Sequence |
|---|---|---|
| | | AGCTCTGGGGGTGGCTCACAAGTGCAGTTGCAGGAGAGCGGTGGAGGTTCCGTT<br>CAGGCTGGAGGCTCCCTGCGGCTTTCCTGCGTGGCTTCCGGCTACGTGTCATGC<br>GACTACTTCCTGCCTAGCTGGTATCGCCAGGCTCCTGGGAAGGAGCGTGAATTT<br>GTTAGCATCATTGATGGCACAGGCAGCACTAGCTACGCGGCTTCTGTTAAGGGA<br>CGTTTTACAGCGTCTCAGGACAAAGGGAAGAACATCGCCTACCTCCAGATGAAC<br>TCCCTGAAACCGGAGGATACCGCCATGTACTATTGCAAGGCCTCCTGCGTGCGC<br>GGTCGCGGTATTAGCGAATACTGGGGACAGGGCACCCAGGTCACTGTGTCTTCA |
| DR593-<br>hIL27Ra_<br>VH<br>H18 | 1086 | CAGGTCCAGCTCCAGGAATCCGGTGGAGGCTCCGTGCAGGCCGGAGGGTCTCTC<br>AGACTCAGCTGCGCTGCCAGTGGTTATCCGTACTCTAATGGGTACATGGGTTGG<br>TTCCGCCAGGCCCCCGGCAAGGAGAGGGAAGGCGTGGCCACAATCTATACCGGC<br>GACGGGCGTACATATTACGCGGATAGTGTGAAGGGACGCTTCACCATCAGCCGT<br>GACAACGCCAAGAACACCGTGGACCTTCAGATGTCTTCCTTGAAGCCAGAAGAC<br>ACCGCGATGTATTACTGCGCGGCTCGCGCAGCTCCCCTCTATTCCTCTGGCTCC<br>CCACTGACCCGCGCCAGATACAATGTTTGGGGCCAGGGCACTCAGGTCACTGTG<br>TCCAGTGGCGGTAGCGGCGGTAGTGGTGGCTCCGGTCAGGTGCAGCTCCAGGAG<br>TCAGGGGGTGGCTCCGTACAGGCTGGTGGCTCACTCCGTCTGAGTTGTGTAGCC<br>AGCGGTTACGTCTCCTGCGATTATTTCCTTCCTTCCTGGTATCGCCAGGCTCCC<br>GGCAAAGAGCGGGAGTTCGTTTCCATTATCGACGGAACTGGATCAACATCCTAT<br>GCCGCTTCTGTCAAGGGGCGCTTCACCGCCTCACAGGATAAGGGCAAGAATATC<br>GCTTACCTCCAGATGAACAGCCTGAAACCAGAAGCACCGCGATGTATTACTGT<br>AAGGCGAGCTGTGTTCGCGGCGGGGGATCTCAGAGTATTGGGGCCAGGGCACA<br>CAGGTGACCGTATCCTCC |
| DR593-<br>hIL27Ra_<br>VH<br>H19 | 1087 | CAAGTGCAGCTCCAGGAGTCAGGCGGTGGCAGCGTACAGGCCGGAGGCTCCCTG<br>AGACTGAGCTGTGCAGCCTCTGGCTACCCATACAGCAATGGCTATATGGGATGG<br>TTCCGCCAGGCTCCGGGTAAAGAGCGCGAGGGCGTGGCCACTATTTATACCGGG<br>GACGGAAGAACCTATTACGCGGATTCCGTGAAAGGCCGCTTCACAATTTCCGT<br>GACAACGCGAAGAACACCGTCGATCTCCAGATGTCTTCCTGAAGCCAGAGGAC<br>ACCGCTATGTATTACTGCGCCGCTAGGGCAGCTCCGCTTTACAGTAGCGGATCT<br>CCCCTCACCCGCGCCCGCTACAACGTGTGGGGACAGGGAACACAAGTGACAGTT<br>TCCTCAGGCGGTGGCTCTCAGGTGCAGCTCCAGGAATCTGGGGGAGGGTCCGTA<br>CAGGCCGGAGGCTCCCTGAGATTGAGCTGCCGCGCAAGTGGGTCCACCTACAGC<br>AACTATTGTCTGGGGTGGTTTCGCCAGATTACTGGTAAGGAGAGGGAGGGCGTG<br>GCCGTCATCAACTGGGTGGGCGGAATGCTCTACTTCGCCGACTCCGTGAAGGGT<br>CGGTTCACCGTTTTCACAGGACCAAGCAAAGAACACCGTGTACCTCCAGATGAAC<br>AGTCTGAAGCCCGAGGATACCGCCATGTATTGTGCGGCTGAATCCGTCAGC<br>TCCTTCTCCTGCGGCGGGTGGCTGACACGGCCAGATCGGGTCCCTTACTGGGGA<br>CAGGGCACACAGGTGACTGTGTCCTCC |
| DR593-<br>hIL27Ra_<br>VH<br>H19 | 1088 | CAGGTGCAGTTGCAGGAGAGTGGAGGTGGCAGCGTGCAGGCCGGAGGCAGCCTT<br>CGCCTCTCTTGCGCTGCGAGTGGCTACCCCTACAGCAATGGGTACATGGGCTGG<br>TTCCGTCAGGCACCCGGTAAAGAAAGAGAGGGCGTGGCTACTATCTACACTGGG<br>GATGGCAGGACCTATTACGCCGATAGCGTCAAGGGCCGGTTCACGATTAGCCGT<br>GACAACGCCAAAAATACTGTGGACCTCCAGATGTCTTCACTGAAACCTGAGGAC<br>ACAGCAATGTATTACTGCGCTGCCCGTGCCGCTCCTCTCTACAGCTCCGGCTCT<br>CCATTGACCCGCGCCCGTTACAATGTTTGGGGGCAGGGCACCCAAGTCACCGTG<br>TCATCCGGCGGTTCCGGCGGAAGCGGTGGCAGCGGCCAGGTGCAGCTTCAGGAG<br>TCTGGTGGCGGTAGCGTTCAGGCAGGTGGCAGTCTGCGTCTGAGCTGCCGGGCG<br>AGCGGCAGCACATACTCCAACTATTGCCTGGGCTGGTTTCGGCAGATCACTGGT<br>AAGGAGCGCGAGGGCGTGGCTGTCATAAATTGGGTCGGAGGTATGCTGTACTTC<br>GCCGACTCAGTTAAAGGACGCTTCACCGTGTCCCAGGACCAGGCTAAGAATACT<br>GTGTATCTCCAGATGAACAGTCTGAAACCAGAGGACACAGCAATGTATTACTGT<br>GCTGCCGAAAGCGTCTCATCTTTCTCCTGTGGGGCTGGCTCACACGCCCGGAC<br>CGTGTTCCGTATTGGGGTCAGGGAACCCAGGTGACCGTAAGCTCC |
| DR593-<br>hIL27Ra_<br>VH<br>H20 | 1089 | CAAGTGCAGCTCCAGGAGTCCGGGGCGGGTCTGTGCAAGCTGGCGGTTCTCTG<br>AGGCTGTCCTGCGCTGCATCCGGCTACCCTTACTCCAATGGCTACATGGGTTGG<br>TTCAGACAAGCTCCCGGAAAGGAGAGGGAGGGTGTGGCTACCATCTACACCGGC<br>GACGGACGCACTTATTACGCAGACTCCGTGAAGGGCCGCTCACCATTTCTCGG<br>GATAACGCTAAGAACACCGTGGACCTTCAGATGTCTTCCCTTAAACCTGAGGAC<br>ACTGCCATGTATTACTGTGCCGCTCGGGCCGCGCCACTGTACTCTTCCGGGTCC<br>CCACTTACACGTGCTCGTTACAATGTGTGGGTCAAGGAACCCAGGTGACTGTG<br>TCCAGCGGAGGCGGTTCACAAGTGCAGCTTCAGGAAAGCGGAGGCGGGTTGGTG<br>CAGCCTGGGGGCTCACTCCGTCTGAGCTGTGCCGCTTCTGGTTTCACCTTCTCT<br>TCATATCCTATGAGTTGGGTGAGACAAGCGCCGGGCAAAGGACTGGAGTGGGTC<br>TCCACTATTTCTTCCGGCGGTGATACTACCTTGTATGCTGACTCCGTGAAGGGT<br>CGTTTCACCTCCAGTCGCGACAATGCGAAGAATACCCTGTACCTCCAGCTCAAC<br>TCCCTGAAGACCGAGGACACAGCGATGTATTACTGCGCTAAGCGTATCGACTGC<br>AATTCCGGGTACTGCTACAAGAGAAGCTACTGGGGCAAGGGACTCAGGTGACA<br>GTGTCTAGC |
| DR593-<br>hIL27Ra_<br>VH<br>H20 | 1090 | CAGGTCCAACTTCAGGAGTCTGGTGGAGGCTCCGTTCAGGCGGGCGGGTCCCTG<br>CGCTTGTCTTGTGCAGCCAGCGGTTACCCATACAGCAACGGATATATGGGCTGG<br>TTCCGGCAGGCCCCTGGGAAGAACGTGAGGGCGTCGCGACTATCTATACTGGA<br>GATGGACGCACTTATTACGCCGATAGCGTCAAGGGACGGTTTACCATCAGCAGG<br>GACAACGCCAAAAACACCGTGGACCTTCAGATGTCTTCCCTGAAACCCGAGGAC |

TABLE 1B-continued

| Name | SEQ ID NO: | Sequence |
| --- | --- | --- |
| | | ACGGCTATGTACTATTGCGCGGCCCGCGCTGCCCCTCTCTATAGTTCTGGGAGT
CCCTTGACAAGGGCCAGATACAACGTGTGGGGCAGGGGACTCAGGTTACTGTC
TCCTCTGGTGGCTCCGGTGGCAGCGGAGGCTCTGGCCAGGTGCAGTTGCAGGAG
AGTGGGGGTGGCCTGGTGCAGCCTGGTGGCAGCCTGCGCCTGTCTTGCGCAGCC
TCTGGGTTTACCTTTAGCTCTTACCCCATGTCCTGGGTCCGCCAGGCTCCCGGC
AAAGGACTGGAGTGGGTGTCCACCATTTCTAGCGGAGGCGATACTACCCTGTAC
GCCGACTCTGTGAAGGGGCGCTTCACTAGCTCACGGGACAATGCTAAGAACACA
CTGTACCTTCAGCTGAACTCACTGAAAACCGAAGACACTGCTATGTATTACTGC
GCTAAACGCATTGATTGCAACAGCGGCTATTGTTATAAAAGATCCTACTGGGGC
CAGGGCACCCAGGTCACGGTCTCCAGC |
| DR593-
hIL27Ra_
VH
H21 | 1091 | CAAGTTCAGCTCCAGGAGAGTGGAGGGGGCAGTGTTCAGGCCGGAGGTAGCCTG
CGCCTCAGCTGTGCAGCCAGTGGCTACCCCTACTCTAATGGCTACATGGGCTGG
TTCAGGCAGGCCCCCGGAAAAGAGCGTGAGGGTGTGGCTACAATTTATACCGGA
GACGGCAGAACCTACTATGCCGACTCCGTGAAGGGCCGCTTCACAATCTCTCGG
GACAACGCTAAGAACACAGTGGATCTTCAGATGAGCAGTCTCAAGCCAGAGGAT
ACCGCCATGTATTACTGTGCCGCGCGGGCTGCCCCTTTGTACTCATCTGGGAGC
CCTCTGACCCGCCCCGCTATAATGTGTGGGGCCAGGGGACCCAAGTGACGGTA
TCCTCTGGGGGCGGTAGCCAGGTGCAGCTCCAGGAAAGCGGAGGGGGACTGGTG
CAGCCCGGCGGGAGCCTGCGGCTTAGCTGCGCAGCCTCCGGCTTCACCTTCTCC
CTCAGTTCCATGAGTTGGGTTCGCCAGGCTCCAGGGAAGGGACTGGAATGGGTG
TCAGCCATCTCCTCTGGCGGGGCGTCCACTTATTACACAGACTCCGTGAAGGGT
AGGTTCACCATTTCTAGGGATAATGCCAAGAACATGCTGTACCTCCAGCTGAAC
AGTCTGAAACAGAAGACACAGCTATGTACTATTGCGCCAAAGGTGGGTCCGGT
TATGGCGATGCGTCCAGGATGACTTCCCCTGGGTCCCAGGGCACACAGGTCACC
GTGAGTAGC |
| DR593-
hIL27Ra_
VH
H21 | 1092 | CAGGTGCAACTCCAGGAGAGCGGCGGAGGCTCTGTCCAAGCAGGCGGGTCTCTC
CGTCGTCTTGCGCCGCAAGCGGATACCCCTACAGCAACGGTTATATGGGTTGG
TTCCGCCAGGCCCCCGGAAAGGAGCGTGAGGGTGTGGCCACCATCTACACTGGC
GATGGAAGAACCTATTACGCAGACAGCGTGAAGGGCCGGTTTACCATCAGCCGC
GACAACGCCAAGAACACCGTTGACTTGCAGATGTCCAGCCTGAAACCTGAGGAC
ACAGCTATGTACTATTGTGCTGCCAGAGCGGCTCCTCTCTACAGTTCTGGATCT
CCCCTTACACGGGCTAGGTACAATGTTGGGGCAGGGCACCCAGGTCACCGTG
TCCTCTGGCGGATCAGGAGGCAGCGGGGCTCTGGTCAAGTGCAGCTCCAGGAG
TCCGGCGGGGACTGGTTCAGCCTGGAGGTTCCCTGCGCCTTTCTTGTGCTGCC
AGCGGCTTCACGTTCTCCCTGAGTTCCATGAGCTGGGTCCGGCAGGCCCCCGGC
AAAGGCCTGGAGTGGGTTTCCGCTATCTCCAGCGGCGGGGCCTCCACCTACTAT
ACCGACTCCGTGAAGGGACGGTTCACAATCTCCAGGGACAATGCTAAGAATATG
TTGTACCTTCAGTTGAACTCCCTGAAAACCGAAGACACGGCCATGTATTACTGC
GCCAAGGGAGGCTCCGGTTACGCGATGCCAGCAGAATGACCTCCCCTGGTAGC
CAGGGGACACAGGTGACTGTATCCAGC |
| DR593-
hIL27Ra_
VH
H22 | 1093 | CAGGTGCAGTTGCAGGAGTCCGGCGGAGGCTCCGTTCAGGCCGGTGGCAGCCTC
AGACTGTCATGTGCAGCCTCCGGTTATCCCTATTCCAATGGTTACATGGGATGG
TTCCGTCAGGCCCCTGGGAAAGAGAGGGAGGGCGTCGCCACGATCTACACCGGC
GATGGACGCACATATTACGCCGACAGTGTTAAGGGCCGTTTCACCATCTCTCGC
GACAACGCCAAAAACACAGTTGATTTGCAGATGAGTTCCCTCAAGCCCGAAGAC
ACCGCTATGTACTATTGTGCAGCCCGCGCCGCTCCTCTCTACAGCTCTGGCTCC
CCACTGACGAGGGCGCGGTACAACGTGTGGGGCAGGGCACCCAGGTTACCGTT
TCTAGTGGCGGTGGCTCCCAGGTCCAGCTCCAGGAGAGTGGCGGAGGCAGCGTG
CAGGCAGGCGGTAGCCTTCGCCTGAGCTGCCGGGCCTCCGGGAGCACGTACTCT
AACTACTGTCTTGGATGGTTCCGGCAGACAACTGGGAAGGAGCGCGAGGGAGTC
GCCGTTATCAACTGGGTAGGGGAATGCTGTACTTTGCCGATTCCGTCAAGGGA
CGCTTTACCGTCTCTCAGGATCAGGCCAAGAACACCGTCTACCTCCAGATGAAC
AGTCTGAAGCCCGAGGACACCGCTATGTACTATTGCGCTGCGGAGAGCGTTTCC
TCTTTCTCCTGCGGCGGTTGGCTTACCCGCCCCGACCGGGTGCCTTACTGGGGT
CAGGGCACACAGGTGACCGTCTCCTCC |
| DR593-
hIL27Ra_
VH
H22 | 1094 | CAGGTTCAGCTTCAGGAAAGTGGAGGGGGCTCCGTTCAAGCCGGGGGTTCCCTT
AGGCTGTCCTGCGCCGCTTCTGGTTATCCGTATTCAAATGGGTACATGGGATGG
TTCCGCCAGGCTCCCGGCAAGGAGCGCGAGGGTGTCGCAACAATCTATACGGGC
GACGGTCGGACCTACTATGCAGACTCTGTCAAGGGCCGGTTCACAATCTCCCGC
GATAACGCCAAGAACACAGTGGACCTCCAGATGTCATCCCTGAAGCCAGAGGAT
ACAGCAATGTATTACTGTGCTGCACGTGCCGCTCCCCTGTACTCTAGTGGGAGC
CCCCTCACCAGAGCGCGGTATAACGTGTGGGTCAGGGGACTCAGGTAACCGTG
TCCAGCGGCGGTTCCGGCGGTAGCGGAGGCTCCGGCCAGGTACAGCTCCAGGAG
AGCGGAGGGGGCTCCGTCCAGGCTGGCGGGTCCCTGCGCCTGTCCTGCCGGGCC
TCCGGTAGCACATACTCTAACTACTGCCTGGGCTGGTTCAGGCAGACCACTGGA
AAGGAACGCGAGGGCGTCGCTGTAATCAACTGGGTCGGAGGTATGCTTTACTTC
GCAGACTCCGTGAAGGGTCGCTTCACAGTGAGCAGGACCAAGCTAAGAACACT
GTGTACCTCCAGATGAACTCTCTCAAGCCGGAGGATACCGCCATGTATTACTGT
GCAGCCGAGAGTGTGTCTAGCTTCTCCTGCGGAGGCTGCTGACGAGACCCGAT
AGGGTCCCGTACTGGGGCAGGGCACTCAAGTCACTGTGAGCAGC |

TABLE 1B-continued

| Name | SEQ ID NO: | Sequence |
|---|---|---|
| DR593-hIL27Ra_VH H23 | 1095 | CAGGTACAACTTCAGGAAAGCGGGGGAGGCTCCGTACAGGCGGGAGGCAGCTTG<br>CGCCTGAGCTGTGCCGCAAGTGGTTACCCGTACAGCAACGGCTACATGGGCTGG<br>TTTCGTCAGGCTCCTGGGAAAGAGAGAGGGCGTGGCTACGATCTACACGGGT<br>GACGGACGCACCTATTACGCCGACTCCGTGAAAGGAAGATTCACCATCAGCCGC<br>GATAACGCTAAGAACACAGTTGACCTGCAAATGTCTAGCCTGAAACCGGAGGAC<br>ACTGCTATGTACTATTGTGCCGCACGCGCTGCCCCTCTCTATTCTTCCGGCAGC<br>CCCCTCACCAGGGCTCGCTACAACGTCTGGGGCCAAGGGACCCAGGTGACTGTG<br>TCCAGCGGTGGAGGGAGCCAGGTGCAGCTCCAGGAGAGCGGCGGGGGCTCTGTC<br>CAGGCCGGTGGCAGTCTGCGCCTGTCCTGCCGGGCCTCCCGTTCCCCTTACGGG<br>AATTATTGCTGGGCTGGTTCAGACAGTCTACGGGTAAGGAGCGGGAAGGCGTG<br>GCAGTTATCAACTGGGTCGGCGAATGCTGTACTTTGCCGACTCCGTCAAAGGC<br>CGCTTCACTGTGTCTCAGGACCATGCAAAGAACACCGTAACCTTGCAGATGAAC<br>TCTCTGAAACCCGAAGACACGGCGATGTATTACTGCGCTGCCGAGTCCGTTTCT<br>AGCTTCAGCTGTGGCGGTTGGTTGACAAGGCCAGATCGCGTCCCGTACTGGGGC<br>CAAGGAACCCAGGTAACCGTAAGCAGT |
| DR593-hIL27Ra_VH H23 | 1096 | CAAGTCCAGCTGCAAGAGAGCGGAGGCGGGAGCGTTCAGGCTGGTGGCAGCCTG<br>CGGCTGAGTTGTGCTGCCAGCGGATACCCCTATTCCAATGGTTATATGGGTTGG<br>TTTAGACAGGCACCTGGAAAGGAACGCGAGGGCGTAGCTACTATTTACACTGGA<br>GACGGCAGGACTTATTACGCGGATAGCGTGAAGGGCCGTTTCACAATTTCACGC<br>GACAATGCCAAAAACACCGTGGATCTGCAAATGTCCAGCCTGAAGCCCGAGGAC<br>ACCGCCATGTACTATTGCGCCGCACGCGCGGCTCCCCTGTACTCCTCAGGTAGC<br>CCTTTGACTCGCGCACGCTATAATGTGTGGGGCCAGGGCACCCAGGTGACGGTT<br>TCTAGCGGAGGGAGCGGGGGTTCTGGTGGCTCAGGTCAGGTGCAGCTTCAGGAA<br>TCTGGAGGTGGCTCCGTACAGGCTGGGGGCTCCCTGCGTCTGAGCTGCCGGGCG<br>AGCAGGTCCCCTTATGGTAACTACTGTCTCGGTTGGTTCCGCCAATCCACCGGC<br>AAGGAGCGCGAGGGAGTGGCCGTTATAAATTGGGTGGGCGGTATGCTGTACTTT<br>GCTGACAGTGTTAAGGGACGTTTCACCGTATCTCAGGACCACGCCAAGAACACC<br>GTGACATTGCAGATGAACTCTCTCAAGCCAGAGGACACCGCTATGTATTACTGT<br>GCCGCTGAGTCAGTGTCCTCTTTCAGCTGCGGCGGGTGGCTCACTCGCCCTGAC<br>AGAGTACCCTATTGGGGGCAGGGGACACAGGTCACGGTTTCCAGC |
| DR593-hIL27Ra_VH H24 | 1097 | CAAGTACAGTTGCAGGAGTCCGGCGGTGGCAGTGTTCAGGCGGGCGGGTCCCTG<br>CGCCTCAGCTGCGCAGCCAGCGGATACCCATACTCTAACGGTTACATGGGTTGG<br>TTCCGCCAGGCCCCAGGTAAGGAAAGAGAGGGAGTGGCGACTATTTATACCGGG<br>GATGGCCGCACCTACTATGCCGATTCTGTAAAAGGTAGGTTCACGATCTCTCGC<br>GATAACGCCAAAAACACAGTCGATCTCCAGATGTCTTCCCTGAAGCCCGAGGAC<br>ACCGCCATGTATTACTGTGCGGCACGGGCAGCTCCCCTTTACAGCTCCGGTTCC<br>CCGCTGACTCGTGCCCGTTACAACGTCTGGGGCCAGGGCACACAGGTAACCGTG<br>TCCAGCGGCGGAGGTTCACAGGTGCAGCTCCAGGAGTCTGGTGGCGGACTGGTG<br>CAGCCCGAGGCTCCCTGCGTCTCAGCTGTGCAGCCAGCGGCTTTACATTTAGC<br>CACTCCGGTATGAGCTGGGTACGGCAGGCACCTGGAAAGGGTCTGGAGTGGGTG<br>TCCACAATCAACTCAGGCGGAGCCTCTACATACTATACTGACTCAGTCAAGGGA<br>CGTTTCACCATCTCCCGCGACAACGCTAAAAACATGCTGTACCTTCAGTTGAAC<br>AGTCTGAAGACTGAGGATACAGCCATGTATTGTGTGCCAAAGGGGGCTCTGGC<br>TACGGGGATGCCTCCAGAATGACTAGCCCTGGCTCCCAGGGCACCCAGGTGACC<br>GTGTCTTCC |
| DR593-hIL27Ra_VH H24 | 1098 | CAGGTGCAGTTGCAAGAGTCTGGCGGAGGCTCCGTCCAAGCAGGCGGGAGTCTT<br>CGGCTGTCTTGTGCAGCCTCCGGGTATCCGTACTCTAATGGTTACATGGGCTGG<br>TTCAGGCAGGCCCCAGGTAAAGAACGGGAGGGCGTGGCCACCATTTACACCGGC<br>GATGGCCGCACATACTATGCCGACTCCGTGAAGGGTAGGTTCACCATTTCACGT<br>GACAATGCCAAGAATACCGTGGATCTCCAGATGGTCTAGCCTGAAGCCGGAGGAC<br>ACAGCCATGTATTACTGTGCTGCCCGCGCTGCCCCTCTGTACTCCAGCGGTTCT<br>CCTCTGACTAGAGCCCGGTACAACGTGTGGGGCCAGGGCACCCAAGTCACTGTG<br>TCTAGTGGCGGGTCCGGCGAAGCGGTGGCTCAGGCCAAGTTCAGCTCCAGGAA<br>TCAGGTGGGGGCCTGGTCCAGCCCGGTGGATCTCTGCGGCTGTCCTGTGCTGCC<br>AGCGGATTCACGTTTAGCCACAGCGGCATGAGCTGGGTACGCCAGGCTCCAGGC<br>AAAGGATTGGAATGGGTGTCCACAATTAACTCTGGCGGGGCCAGCACCTATTAC<br>ACTGACAGCGTTAAAGGGCGCTTTACAATCTCTCGCGACAACGCCAAGAATATG<br>TTGTACCTCCAGCTGAACTCACTCAAGACCGAGGATACTGCCATGTATTACTGT<br>GCTAAAGGCGGAAGCGGCTACGGCGACGCTTCCAGGATGACCAGTCCTGGCTCC<br>CAGGGCACACAGGTGACCGTGTCCTCC |
| DR594-hIL27Ra_VH H1 | 1099 | CAGGTCCAGCTTCAGGAGTCCGGCGGAGGCAGCGTACAGGCGGGCGGGTCCTTG<br>CGCCTGTCCTGTGTGGCCTCCGCATCTACGTATTGCACCTATGATATGCACTGG<br>TATCGTCAGGCCCCTGGCAAAGGTCGGGAGTTCGTGAGCGCCATTGATTCTGAT<br>GGCACTACCCGCTACGCCGACAGTGTGAAGGGACGGTTTACCATTTCCCAGGGA<br>ACCGCGAAGAATACCGTGTACCTCCAGATGAACAGCCTGCAACCCGAGGACACA<br>GCTATGTACTATTGTAAGACCGTGTGTGTCGTGGGTTCCCGCTGGAGCGACTAT<br>TGGGGACAGGGCACCCAAGTGACCGTCAGCTCCGGCGGGGGCTCTCAGGTGCAG<br>TTGCAGGAGAGCGGGGTGGATTGGTGCAGCCCGGCGGATCTCTGCGCCTGAGC<br>TGCGCCGCTTCCGGGTTCACTTTTTCATCTTACCCAATGTCCTGGGTGCGCCAA<br>GCGCCGGGCAAGGGACTGGAGTGGATCTCCACGATCAGCGCTGGCGGTGATACA<br>ACCCTTTACGCCGACTCCGTGAAGGGCCGCTTTACCAGCTCAAGAGACAACGCA<br>AAAAACACTCTGTACTTGCAGCTGAACTCTCTCAAGACCGAGGATGCGGCCATT |

TABLE 1B-continued

| Name | SEQ ID NO: | Sequence |
|---|---|---|
| | | TATTACTGCGCCAAGCGCATTGATTGTAACTCTGGGTACTGTTATAGACGCAAC<br>TATTGGGGTCAGGGCACGCAGGTGACCGTGTCTTCC |
| DR594-<br>hIL27Ra_<br>VH<br>H1 | 1100 | CAGGTTCAGCTCCAGGAAAGCGGCGGAGGCAGTGTGCAGGCAGGCGGAAGCCTG<br>AGACTGTCCTGTGTAGCGTCAGCCAGTACCTACTGCACATACGATATGCACTGG<br>TATCGCCAAGCTCCTGGGAAAGGAAGAGTTCGTTTCCGCCATGCGACTCTGAC<br>GGCACTACAAGATATGCCGATAGCGTTAAAGGCCGCTTTACAATTTCCCAGGGC<br>ACCGCGAAGAACACCGTCTACCTGCAAATGAATAGTTTGCAGCCAGAAGACACT<br>GCTATGTACTATTGCAAGACCGTGTGCGTGGTCGGGTCAAGGTGGAGCGATTAC<br>TGGGGCCAAGGTACTCAGGTCACCGTCAGCTCCGGTGGAAGCGGGGGCTCCGGG<br>GGCTCTGGACAGGTCCAGCTCCAGGAGTCTGGCGGAGGCCTCGTTCAGCCAGGG<br>GGCTCATTGAGGCTTTCCTGTCGGCCTCCGGCTTCACATTTTCTAGCTACCCG<br>ATGAGTTGGGTACGCCAGGCTCCTGGAAAAGGCCTGGAATGGATCAGCACAATC<br>AGCGCAGGTGGGACACAACCCTGTACGCTGATAGCGTGAAGGGTAGGTTTACA<br>TCTTCCCGCGACAACGCTAAGAACACCCTTTACTTGCAGCTCAATTCCCTCAAG<br>ACCGAGGACGCGGCCATCTATTACTGCGCCAAACGTATTGACTGCAACTCTGGT<br>TATTGTTACAGAAGGAATTACTGGGGCCAGGGGACCCAGGTGACCGTATCTTCC |
| DR594-<br>hIL27Ra_<br>VH<br>H2 | 1101 | CAGGTGCAGCTCCAAGAATCCGGGGGTGGCAGTGTGCAGGCCGGTGGCTCTCTG<br>AGGTTGAGCTGCGTCGCCTCAGCCAGCACTTACTGCACCTATGACATGCACTGG<br>TACAGACAGGCACCCGGTAAGGGACGTGAGTTCGTGTCTGCTATTGATTCCGAT<br>GGCACTACCAGATATGCCGATTCCGTGAAAGGCAGATTCACGATTTCCCAAGGA<br>ACCGCTAAGAACACCGTGTATCTCCAAATGAACTCCCTTCAGCCCGAAGACACC<br>GCTATGTATTACTGTAAGACCGTGTGCGTAGTGGGCAGTCGTTGGTCAGACTAT<br>TGGGGCCAGGGCACCCAGGTCACCGTCAGTTCCGGCGGAGGCTCTCAGGTCCAA<br>CTTCAGGAATCTGGGGAGGTTTGGTGCAGCCGGGTGGCTCCCTGCGGCTGTCC<br>TGTCGGCAAGTGGCTTCACCTTCAGCCTCTCCGGCATGTCCTGGGTGCGCCAA<br>GCGCCCGGTAAGGGGCTGGAGTGGGTGTCCGCCATTAGCTCTGGCGGTGCTTCT<br>ACCTATTACACCGACTCCGTCAAGGGTCGGTTTACCATCTCTCGCGACAACGCT<br>AAGAACATCTTGTACCTTCAGCTCAATTCTCTGAAGACTGAGGACACTGCCATG<br>TATTACTGTGCGAAAGGTGGCTCCGGCTACGGAGATGCCTCTCGCATGACCTCC<br>CCTGGGTCCCAGGGCACACAGGTTACCGTGTCCTCC |
| DR594-<br>hIL27Ra_<br>VH<br>H2 | 1102 | CAGGTCCAGCTCCAGGAGTCTGGCGGAGGGAGCGTTCAGGCCGGGGGCTCTCTG<br>AGGCTCTCCTGTGTGGCGAGCGCCTCTACTTACTGTACTTACGACATGCACTGG<br>TATCGCCAAGCCCCAGGCAAGGGCAGGGAGTTCGTCAGTGCCATCGACTCCGAC<br>GGCACAACTCGCTACGCCGACTCCGTCAAGGGACGTTTCACAATCTCTCAGGGC<br>ACGGCTAAGAACACTGTGTATCTCCAAATGAACAGTCTCCAGCCTGAAGATACA<br>GCCATGTACTATTGCAAAACTGTGTGTGGTCGGCTCACGGTGGTCTGACTAC<br>TGGGGTCAGGGGACCCAGGTCACAGTAAGCTCAGGAGGTTCCGGCGGTTCTGGC<br>GGTTCAGGACAGGTGCAACTTCAGGAAAGCGGTGGCGGACTCGTCCAGCCCGGA<br>GGTTCACTGCGTCTCAGCTGTGCTGCCAGCGGTTTTACCTTCAGCCTCAGTGGA<br>ATGAGCTGGGTCAGACAGGCCCCTGGCAAAGGGCTGGAGTGGGTGAGTGCCATT<br>TCCTCAGGAGGTGCCTCTACCTATTACACCGACTCTGTCAAAGGCAGGTTTACC<br>ATCAGCCGCGATAACGCCAAGAACATCCTGTATCTCCAGCTTAATTCCCTCAAG<br>ACAGAAGACACAGCTATGTATTACTGTGCGAAAGGGGCTCCGGTTACGGGGAC<br>GCTTCCAGAATGACATCCCCTGGTTCTCAGGGCACACAGGTGACCGTGTCCTCA |
| DR594-<br>hIL27Ra_<br>VH<br>H3 | 1103 | CAAGTTCAGCTCCAGGAATCTGGCGGTGGGTCTGTTCAAGCCGGTGGCTCCCTG<br>CGCCTTTCATGTGTCGCCTCTGCTTCTACATACTGCACCTACGACATGCACTGG<br>TATCGTCAGGCTCCCGGCAAGGGCCGCGAATTTGTTAGTGCTATCGACTCCGAC<br>GGCACTACACGCTATGCCGACAGTGTTAAAGGCCGCTTCACCATCTCTCAGGGC<br>GCCATGTATTACTGCAAGACAGTCTGTGTCGTGGGATCTCGCTGGTCTGACTAC<br>TGGGGACAGGGGACCCAGGTTACTGTCCTCTGGCGGAGGCAGCCAGGTGCAG<br>CTTCAGGAGTCCGGTGGGGCTCCGTGCAGGCTGGCGGAAGCCTGCGCCTGTCC<br>TGCGTTGCATCCGGTTATGTTAGCTGCGATTACTTCCTGCCCTCCTGGTATCGT<br>CAAGCTCCCGGCAAGGAGCGCGAGTTTGTTTCCATTATCGACGGCACCGGCAGC<br>ACGTCATACGCTGCGAGCGTTAAGGGCCGCTTCACCGCTTCCGAAGACAAGGGC<br>AAGAACATCGCCTACTTGCAGATGAACTCCCTGAAGCCTGAGGATACCGCCATG<br>TATTACTGCAAGGCCAGCTGCGTCCGGGGCCGGGCCGTGTCCGAGTATTGGGGG<br>CAGGGCACCCAGGTGACAGTGAGTAGC |
| DR594-<br>hIL27Ra_<br>VH<br>H3 | 1104 | CAAGTCCAACTCCAGGAAAGTGGCGGTGGGTCCGTACAGGCCGGGGGCAGTCTG<br>CGGCTTTCCTGTGTGGCCTCTGCATCTACTTACTGTACTTACGACATGCACTGG<br>TATCGCCAGGCCCCAGGTAAGGGTCGGGAGTTTGTTAGCGCAATCGACTCAGAC<br>GGGACTACCCGCTACGCGGATAGCGTCAAGGGCCGGTTCACCATCTCTCAGGGC<br>ACCGCCAAGAACACCGTTTATTTGCAGATGAATAGCCTCCAACCTGAAGATACT<br>GCAATGTATTACTGCAAGACAGTGTGCGTGGTTGGCAGCCGCTGGTCAGACTAT<br>TGGGGTCAGGGCACCCAGGTCACCGTTAGCTCTGGAGGCAGCGGCGGTAGCGGT<br>GGCAGCGGACAGGTCCAGCTCCAGGAGTCAGGAGGGGGCTCTGTCCAGCCCGGG<br>GGCTCTCTCCGTCTTTCTTGCGTCGCCTCAGGCTACGTCAGCTGCGATTACTTC<br>CTCCCCTAGCTGGTATCGTCAAGCGCCGGGGAAGGAACGGGAGTTTGTGTCAATC<br>ATTGACGGCACCGGCTCTACTTCCTATGCTGCCAGCGTGAAGGGCCGCTTTACA<br>GCCTCCGAAGACAAGGGCAAGAACATCGCTTACCTCCAGATGAACTCTCTGAAG<br>CCCGAAGACACCGCTATGTACTATTGCAAGGCCAGCTGCGTCAGAGGTAGGGCT<br>GTGTCCGAATATTGGGGTCAGGGCACGCAGGTTACCGTGTCTTCT |

TABLE 1B-continued

| Name | SEQ ID NO: | Sequence |
| --- | --- | --- |
| DR594-hIL27Ra_VH H4 | 1105 | CAGGTCCAACTCCAGGAGAGCGGAGGCGGTTCCGTGCAAGCAGGTGGCTCCCTG<br>CGCTTGAGCTGTGTGGCCTCCGCTAGTACTTACTGCACTTACGATATGCACTGG<br>TATAGGCAAGCCCCAGGGAAGGGGCGCGAGTTCGTGTCCGCCATTGACAGCGAC<br>GGTACAACCCGGTATGCCGACTCTGTGAAAGGCCGTTTCACAATCTCCCAGGGA<br>ACAGCCAAGAACACCGTATACCTCCAGATGAACTCCTTGCAGCCTGAGGATACA<br>GCCATGTACTATTGTAAAACCGTGTGCGTGGTCGGCTCACGCTGGAGTGATTAC<br>TGGGGCCAAGGAACCCAGGTCACTGTCTCCTCAGGGGGAGGTAGCCAGGTCCAG<br>CTTCAGGAGTCCGGCGGTGGCCTGGTTCAGCCTGGGGAATCACTGCGTCTCTCT<br>TGCACTGCCAGTGGATTCACATTTTCAAACTATGCTATGTCTTGGGTGCGGCAG<br>GCCCCTGGGAAGGGGCTCGAATGGGTATCCGGTATTAACGTGGCATACGGCATC<br>ACCTCCTACGCTGATTCCGTGAAGGGCAGGTTCACCATCTCTCGCGACAACACC<br>AAGAACACACTGTACTTGCAACTTAACAGTCTTAAAACTGAAGACACTGCTATC<br>TACTATTGCGTCAAGCACAGCGGTACGACTATCCCGCGTGGATTCATCAGCTAT<br>ACAAAGAGGGGCCAAGGCACCCAAGTCACTGTGAGCAGC |
| DR594-hIL27Ra_VH H4 | 1106 | CAGGTCCAACTTCAGGAATCTGGCGGAGGCTCTGTGCAGGCTGGAGGGAGTCTT<br>AGACTGTCCTGTGTCGCAAGCGCAAGCACGTACTGCACCTACGACATGCACTGG<br>TATCGCCAGGCTCCCGGGTAAGGGACGCGAATTTGTGAGCGCAATCGACTCCGAC<br>GGGACCACAAGGTACGCCGATAGCGTTAAGGGACGTTTCACCATCAGTCAGGGT<br>ACTGCCAAGAACACGGTCTACCTCCAGATGAATAGCCTCCAGCCGGAAGATACC<br>GCTATGTATTACTGCAAGACAGTGTGCGTAGTGGGCAGCCGTTGGTCCGATTAT<br>TGGGGCCAGGGTACACAGGTGACAGTCTCCAGTGGAGGCTCCGGCGGATCTGGG<br>GGCAGCGGTCAGGTGCAGTTGCAGGAGAGCGGCGGTGGCTTGGTGCAACCCGGT<br>GAATCTTTGCGTCTGAGCTGCACAGCGAGCGGATTCACATTTAGCAACTACGCC<br>ATGTCCTGGGTGCGCCAGGCTCCCGGTAAGGGTCTGGAGTGGGTGAGTGGTATC<br>AATGTGGCCTATGGGATCACCAGTTATGCGGATAGCGTGAAGGGCCGGTTTACC<br>ATCAGCCGGGACAACACCAAGAACACCCTGTACCTTCAGCTTAACTCTCTGAAG<br>ACCGAAGATACAGCCATCTATTACTGTGTGAAGCACTCAGGGACTACCATCCCT<br>CGTGGTTTTATTAGCTACACTAAGCGTGGGCAAGGAACACAAGTGACGGTGTCT<br>TCC |
| DR594-hIL27Ra_VH H5 | 1107 | CAGGTGCAGCTCCAGGAATCCGGCGGGGGCAGCGTGCAGGCCGGAGGCTCCTTG<br>CGTCTGTCTTGCGTCGCATCCGCCAGCACGTACTGCACCTACGATATGCACTGG<br>TATCGTCAGGCTCCCGGTAAGGGGAGGGAGTTTGTCAGTGCTATCGACAGCGAT<br>GGGACCACTCGCTACGCTGACTCCGTGAAGGGTCGTTTTACCATCAGCCAGGGC<br>ACAGCTAAGAACACGGTGTACTTGCAGATGAACTCTCTCCAGCCGGAAGACACC<br>GCGATGTATTACTGCAAGACTGTTTGCGTCGTGGGCTCTCGTTGGTCTGACTAT<br>TGGGGTCAGGGCACCCAAGTCACGGTGAGTAGCGGCGGGGGTAGCCAAGTGCAG<br>CTTCAGGAGTCCGGTGGCGGAAGCGTGCAGGCTGGGGGCAGCCTTCGGCTGTCA<br>TGTACCGCCTCCGGTTACGTGTCTTGTGACTACTTCTTGCCAAGCTGGTATCGT<br>CAGGCCCCTGGTAAAGAGCGGGAGTTCGTCAGCGTGATTGATGGCACTGGGTCC<br>ACCAGCTACGCTGCCAGCGTTAAGGGCCGCTTCACCGCCAGCCAGGACAAGGGA<br>AAGAATATTGCATATCTCCAGATGAACTCCCTGAAGCCTGAAGATACCGCTATG<br>TATTACTGCAAGGCCTCATGCGTCCGTGGACGCGCTATTTCCGAGTATTGGGGA<br>CAGGGTACTCAGGTCACCGTGAGTTCT |
| DR594-hIL27Ra_VH H5 | 1108 | CAGGTGCAGCTGCAAGAAAGCGGTGGGGGCTCCGTCCAGGCGGGCGGTAGCCTG<br>AGGCTGAGTTGCGTCGCCAGCGCTAGTACATACTGTACCTACGACATGCACTGG<br>TATCGCCAGGCCCCCGGCAAAGGCAGGGAGTTCGTGTCAGCCATCGACTCTGAC<br>GGGACTACCAGATACGCCGACTCCGTGAAAGGGCGGTTTACCATCAGTCAGGGT<br>ACAGCTAAGAATACCGTGTACCTCCAGATGAACTCCTTGCAGCCTGAGGACACT<br>GCAATGTATTACTGCAAGACCGTGTGTGTTGTCGGCAGCCGTTGGTCCGACTAC<br>TGGGGACAGGGAACCCAGGTCACAGTCTCTAGCGGCGGAAGCGGGGGCTCAGGA<br>GGCTCTGGGCAAGTGCAGTTGCAGGAGAGTGGCGGAGGCAGTGTGCAACCGGG<br>GGCTCCCTCCGCCTGAGCTGTACTGCGAGCGGCTACGTCAGCTGTGACTACTTT<br>CTGCCATCTTGGTATCGTCAGGCTCCCGGAAAGGAACGCGAGTTTGTGTCTGTG<br>ATCGACGGGACCGGCTCTACCTCTTACGCCGCTTCCGTCAAGGGCCGCTTTACC<br>GCTTCCCAAGATAAGGGGAAGAATATCGCTTACTTGCAGATGAACTCCCTGAAG<br>CCAGAAGACACCGCCATGTACTATTGCAAGGCTTCCTGTGTTCGTGGCCGCGCC<br>ATTAGCGAGTACTGGGGCCAGGGCACCCAGGTCACCGTGTCCAGT |
| DR594-hIL27Ra_VH H6 | 1109 | CAGGTACAACTCCAGGAGAGTGGTGGCGGGAGCGTGCAAGCAGGGGGCTCCCTG<br>CGCCTGTCCTGCGTCGCGTCCGCCAGCACATATTGCACCTACGATATGCACTGG<br>TATCGCCAGGCCCCTGGGAAGGGTCGCGAGTTCGTGTCCGCCATCGACTCAGAC<br>GGCACTACCCGCTACGCGGATTCTGTGAAGGGCAGATTCACAATTTCCCAGGGG<br>ACCGCCAAGAACACGGTGTATCTCCAGATGAACTCTTTGCAGCCCGAGGACACT<br>GCCATGTATTACTGCAAGACCGTGTGTGTCGTGGGCTCCAGGTGGAGCGACTAT<br>TGGGGCCAGGGGACACAGGTTACCGTGTCCAGCGGTGGCGGTTCCCAGGTACAG<br>CTCCAGGAGTCTGGCGGTGGCCTGGTACAGCCCGGTGGAAGCCTGCGCCTCAGC<br>TGTGCCGCTTCCGGCTTTAGCTTCAGTTCTTATGCCATGAAGTGGGTCCGCCAG<br>GCCCCCGGCAAGGGCCTGGAATGGGTCTCCACCATCTCCAGTGGGGGTAGCTCC<br>ACCAACTATGCTGATAGCGTGAAGGGACGCTTTACCATCAGTCGTGATAACGCG<br>AAGAACACCCTTTACCTTCAGCTGAACTCTCTGAAGATCGAAGACACCGCCATG<br>TACTATTGTGCCAAGGCTATCGTGCCTACCGGGGCCACTATGGAAAGAGGACAG<br>GGCACCCAGGTGACAGTGTCCTCC |

TABLE 1B-continued

| Name | SEQ ID NO: | Sequence |
|---|---|---|
| DR594-hIL27Ra_VH H6 | 1110 | CAGGTGCAGTTGCAGGAGTCTGGTGGCGGGTCAGTGCAGGCTGGAGGCTCCCTC<br>AGGCTGAGTTGTGTCGCAAGCGCAAGCACATACTGCACCTATGATATGCACTGG<br>TATCGCCAAGCTCCTGGCAAAGGTCGGGAGTTTGTGTCTGCTATTGATAGCGAC<br>GGCACCACGCGCTACGCGGACTCCGTGAAGGGCAGATTTACAATCTCACAAGGG<br>ACGGCGAAAAATACCGTGTACCTCCAGATGAACTCTCCAGCCCGAGGATACC<br>GCTATGTATTACTGCAAGACCGTCTGCGTCGTGGGTAGCAGGTGGTCCGACTAC<br>TGGGGTCAGGGCACTCAGGTGACGGTGTCTTCAGGAGGCTCCGGGGGCTCTGGC<br>GGTAGCGGACAGGTGCAGTTGCAGGAGAGCGGCGGGGGTCTGGTCAGCCTGGG<br>GGTTCCCTGAGACTGAGCTGCGCCGCTTCTGGTTTCAGTTTTAGTTCTTACGCT<br>ATGAAGTGGGTACGCCAAGCCCCTGGTAAGGGTCTGGAGTGGGTTTCTACGATT<br>TCTAGCGGGGGCAGCTCTACAAACTACGCGGATAGCGTGAAAGGACGCTTTACC<br>ATCTCCCGCGACAATGCAAAGAACACTTTGTACCTCCAGCTTAATTCACTGAAG<br>ATCGAGGACACGGCTATGTACTATTGCGCTAAGGCCATCGTGCCGACCGGAGCC<br>ACTATGGAAAGAGGTCAAGGCACCCAGGTGACTGTGTCCTCA |
| DR594-hIL27Ra_VH H7 | 1111 | CAGGTCCAGCTCCAGGAGTCCGGCGGAGGCTCTGTGCAGGCAGGGGGCTCTCTG<br>AGGCTGAGCTGCGTCGCCTCAGCCTCTACCTACTGCACCTATGACATGCACTGG<br>TATCGTCAGGCTCCTGGCAAGGGTCGCGAGTTCGTTTCTGCCATTGATTCCGAC<br>GGCACCACTAGATACGCTGACTCCGTCAAGGGCCGCTTCACCATCTCCCAGGGG<br>ACTGCTAAGAACACCGTGTACCTTCAGATGAACTCTCTTCAGCCTGAAGATACT<br>GCGATGTATTACTGCAAGACTGTTTGCGTTGTGGGAAGTCGTTGGTCCGATTAC<br>TGGGGCCAGGGTACTCAAGTGACTGTAAGCTCAGGTGGCGGATCTCAGGTCCAG<br>CTCCAGGAGTCAGGCGGTGGCCTCGTTCAGCCAGGCGGGTCTCTGAGACTGAGC<br>TGCGCTGCCTCTGGATTCACCTTCTCATCTTACCCCATGTCTTGGGTGCGTCAA<br>GCGCCTGGGAAAGGTCTGGAGTGGATCAGCACAATTTCAGCTGGTGGAGATACC<br>ACTCTCTACGCTGACAGCGTGAAAGGCCGGTTCACCTCCAGCCGCGACAACGCC<br>AAGAATACCCTGTACCTCCAGCTTAACTCCCTCAAGCAGAGGACACTGCAATT<br>TACTATTGCGCTAAGCGGATTGATTGTAACTCCGGCTACTGCTACAGGCGTAAC<br>TATTGGGGCCAGGGGACGCAGGTGACAGTGTCATCC |
| DR594-hIL27Ra_VH H7 | 1112 | CAGGTCCAGCTCCAGGAGAGTGGAGGCGGATCTGTGCAGGCCGGGGCTCCCTG<br>CGTCTCTCATGCGTCGCCAGCGCATCTACTTACTGCACATACGACATGCACTGG<br>TATCGTCAGGCACCGGGCAAGGGCCGTGAGTTCGTCTCTGCGATTGACTCTGAC<br>GGAACTACCCGCTACGCCGATTCTGTGAAAGGGCGGTTCACCATCTCTCAGGGC<br>ACTGCCAAGAATACCGTCTACCTGCAAATGAACAGCCTCCAGCCAGAGGATACC<br>GCCATGTACTATTGCAAGACGGTCTGCGTCGTGGGCTCCAGATGGTCCGATTAC<br>TGGGGCCAGGGAACACAAGTGACAGTTAGTTCCGGTGGCTCAGGAGGTTCCGGG<br>GGCAGCGGTCAAGTGCAGTTGCAGGAGAGCGGAGGCGGTCTGGTTCAGCCTGGC<br>GGTTCTCTTCGCCTGAGCTGCGCTGCCTCAGGCTTTACGTTCTCCTCTTACCCC<br>ATGTCCTGGGTGCGGCAAGCTCCGGGGAAGGGCCTGGAGTGGATCTCCACCATT<br>AGTGCAGGTGGCGACACCACTCTGTACGCTGACAGTGTAAAGGGCCGCTTCACA<br>TCCTCTCGGGACAACGCCAAAAATACACTCTATTTGCAGCTGAATAGCCTGAAA<br>ACCGAGGACACGGCCATTTACTATTGTGCAAAGAGAATTGATTGCAACAGCGGA<br>TACTGTTATCGCAGGAACTACTGGGGCCAGGGCACCCAGGTGACAGTGTCCTCT |
| DR594-hIL27Ra_VH H8 | 1113 | CAGGTGCAGCTCCAGGAGTCCGGCGGGGGCTCAGTGCAGGCCGGAGGCAGCTTG<br>AGGCTGAGTTGTGTGGCCAGTGCCTCCACATATTGCACCTACGACATGCACTGG<br>TATCGGCAAGCCCCTGGTAAGGGACGGGAATTTGTAAGTGCTATTGATTCTGAT<br>GGCACTACCCGTTACGCCGACAGCGTGAAAGGCCGCTTCACTATTTCACAGGGG<br>ACTGCCAAAAATACCGTGTACCTTCAGATGAACTCTCTTCAGCCCGAGGACACG<br>GCGATGTACTATTGCAAGACCGTTTGTGTTGTGGGTAGTCGCTGGTCCGACTAT<br>TGGGGCCAGGGTACTCAGGTGACTGTATCCAGCGGCGGAGGCAGCCAGGTGCAG<br>TTGCAGGAGTCCGGCGGTGGAAGCGTCCAGGTGGGTGGCAGTCTGCGCCTCTCA<br>TGTGCCGCATCCGGCTTCACCTTCTCTAGTTACCCTATGTCCTGGGTCCGTCAG<br>GCCCCTGGAAAGGGTCTTGAGTGGATTTCCACAATCTCTGCTGGGGGCGACACA<br>ACCCTGTATGCCGACTCCGTGAAAGGCCGCTTCACCTCCAGTCGCGACAATGCG<br>AAGAACACCCTTTATTTGCAGCTGAACTCACTGAAGACCGAGGACACCGCAATT<br>TACTATTGTGCTAAGCGCATTGATTGCAATAGCGGCTACTGTTACCGGCGCAAT<br>TATTGGGGCCAGGGTACTCAGGTGACTGTGTCCTCT |
| DR594-hIL27Ra_VH H8 | 1114 | CAGGTGCAACTGCAAGAGAGCGGCGGTGGCAGCGTACAGGCCGGTGGCTCTCTC<br>CGCCTTAGCTGCGTCGCCAGCGCTTCCACTTACTGTACTTACGACATGCACTGG<br>TACAGGCAAGCGCCCGGCAAGGGACGCGAGTTCGTCTCCGCCATCGACAGCGAC<br>GGCACCACTCGCTACGCCGATAGCGTTAAGGGTCGCTTCACCATTTCACAGGGC<br>ACCGCCAAGAACACCGTCTATCTTCAGATGAACAGCCTCCAGCCAGAGGATACA<br>GCCATGTACTATTGCAAGACCGTCTGCGTCGTGGGCTCTCGTTGGAGTGACTAT<br>TGGGGCCAGGGCACTCAAGTGACCGTGTCCTCTGGAGGCTCCGGGGGCAGCGGC<br>GGGTCCGGTCAGGTGCAACTCCAGGAGGTCCGGCGGAGGCTCTGTGCAGGTTGGT<br>GGAAGCCTGCGTCTCTCCTGCGCGGCCTCCGGCTTCACTTTCTCCTCTTACCCT<br>ATGAGCTGGGTCAGGCAGGCCCCCGGCAAGGGGCTGGAGTGGATCTCTACCATT<br>TCTGCCGGAGGGGACACTACCCTGTACGCAGATTCGTGAAAGGCCGCTTCACC<br>AGCTCTAGGGACAACGCCAAGAATACCTTGTATCTCCAGCTCAACTCCCTCAAG<br>ACCGAGGACACAGCTATCTATTACTGTGCTAAGAGGATCGACTGTAACTCTGGT<br>TATTGTTATCGCAGGAACTATTGGGACAGGGGACCCAAGTGACCGTCAGCTCT |

TABLE 1B-continued

| Name | SEQ ID NO: | Sequence |
|---|---|---|
| DR594-hIL27Ra_VH H9 | 1115 | CAGGTGCAGCTTCAGGAGTCTGGCGGTGGCAGCGTCCAAGCTGGCGGGAGCCTG<br>CGGCTGTCTTGTGTGGCCTCCGCCTCAACATACTGTACCTATGATATGCACTGG<br>TATAGACAAGCGCCCGGCAAGGGCAGGGAGTTCGTCTCCGCTATTGATAGCGAT<br>GGAACCACTCGTTACGCGGACTCCGTGAAGGGCCGCTTTACGATCAGCCAGGGC<br>ACCGCGAAGAACACCGTGTATCTTCAGATGAACTCTTTGCAGCCCGAGGACACT<br>GCCATGTATTACTGCAAGACTGTTTGTGTAGTGGGCAGCAGGTGGAGCGACTAC<br>TGGGGCCAGGGAACACAGGTCACAGTAAGCTCTGGTGAGGGTCTCAGGTGCAG<br>CTTCAAGAATCTGGTGGAGGCTCCGTGCAATCCGGTGGCAGCCTGAGGCTGTCC<br>TGCGCTGCCTCAGGATTCACTTACAGCACCTCTAACTCCTGGATGGCCTGGTTT<br>CGCCAAGCGCCCGGAAAAGAGAGGGAAGGCGTGGCCGCTATTTACACTGTCGGT<br>GGCTCCATCTTCTACGCGGATAGTGTAAGGGGCCGCTTCACCATCTCTCAGGAC<br>GCCACAAAAATATGTTCTACCTCCAGATGAATACCCTTAAACCGGAGGACACC<br>GCTATGTATTACTGTGCAGCGGCAAGTGGAAGGCTTCGCGGGAAGTGGTTCTGG<br>CCTTACGAATACAACTACTGGGGTCAGGGAACTCAGGTCACAGTTTCCTCC |
| DR594-hIL27Ra_VH H9 | 1116 | CAGGTCCAGTTGCAGGAATCTGGTGGCGGTTCCGTCCAGGCGGGAGGTTCCCTG<br>CGCCTCTCCTGCGTGGCCTCTGCCTCTACGTATTGTACCTACGACATGCACTGG<br>TATCGCCAGGCCCCAGGTAAGGGCCGCGAGTTCGTTTCCGCTATTGATTCCGAT<br>GGGACCACACGCTATGCTGATTCCGTGAAGGGCCGGTTCACCATCAGTCAAGGC<br>ACCGCCAAGAACACAGTGTACCTCCAGATGAACTCCCTCCAGCCTGAGGACACA<br>GCCATGTACTATTGTAAGACAGTTGTGTGTAGTCGGTTCCCGCTGGAGCGACTAT<br>TGGGGACAGGGAACCCAGGTGACGGTTTCATCCGGTGGCAGCGGAGGTAGCGGC<br>GGTAGCGGACAGGTGCAGTTGCAAGAATCCGGCGGTGGCTCCGTGCAGAGCGGA<br>GGCTCTCTGCGGCTCTCTTGTGCGGCCAGTGGCTTCACCTACTCCACCAGCAAC<br>TCTTGGATGGCTTGGTTCCGCCAAGCCCCTGGCAAAGAACGCGAAGGCGTCGCT<br>GCCATCTACACTGTTGGGGGAAGTATTTTTTACGCTGACTCCGTCCGTGGCCGT<br>TTTACCATCTCCCAGGATGCCACAAAAAATATGTTCTACCTCCAGATGAACACC<br>CTGAAGCCCGAGGATACCGCAATGTACTATTGTGCTGCCCATCTGGTCGTCTG<br>CGCGGCAAGTGGTTCTGGCCCTACGAATACAACTACTGGGGTCAAGGTACACAG<br>GTGACGGTGTCTTCC |
| DR594-hIL27Ra_VH H10 | 1117 | CAGGTGCAGCTTCAGGAATCCGGCGGAGGCTCTGTGCAGGCGGGCGGAAGCCTT<br>CGGCTGTCTTGTGTTGCCTCCGCGAGCACCTACTGCACCTACGATATGCACTGG<br>TATCGCCAGGCTCCTGGCAAGGGCCGTGAGTTTGTGAGCGCCATTGATTCCGAC<br>GGAACTACGAGATATGCCGACAGTGTGAAAGGTCGTTTCACTATTTCACAGGGC<br>ACCGCCAAGAATACCGTCTATCTCCAAATGAACAGTCTCCAGCCGGAGGACACC<br>GCCATGTATTACTGTAAGACGGTATGTGTTGTGGGGTCTCGCTGGTCAGACTAC<br>TGGGGCCAGGGGACACAGGTGACTGTCAGCTCCGGCGGGGGCTCACAGGTGCAG<br>CTGCAAGAGAGCGGCGGTGGCAGTGTTCAGGCGGGCGGTTCTCTCCGCCTGTCT<br>TGCAGGGCCTCCGGGAGCACTTACAGCAATTATTGTTTGGGGTGGTTTAGACAA<br>ATCACCGGCAAGGAGCGCGAGGGGGTGGCCGTGATAAATTGGGTGGCCGGTATG<br>CTCTACTTCGCTGACTCTGTGAAGGGCCGTTTCACAGTGTCCCAGGACCAGGCG<br>AAAAACACCCTTTACCTCCAGATGAACTCTCTCAAGCCCGAGGACACCGCCATG<br>TATTACTGTGCTGCCGAGTCCGTGTCCTCTTTCAGCTGCGGTGGCTGGCTGACC<br>CGCCCTGATAGGGTGCCGTATTGGGTCAAGGAACTCAGGTCACAGTGTCCAGC |
| DR594-hIL27Ra_VH H10 | 1118 | CAAGTGCAGCTCCAGGAGTCCGGCGGAGGTTCTGTCCAGGCCGGAGGCTCACTG<br>CGCCTGTCCTGTGTCGCTTCTGCGTCTACTTACTGTACTTATGATATGCACTGG<br>TATCGCCAGGCTCCAGGTAAGGGCAGGGAGTTCGTGTCTGCTATTGATTCCGAT<br>GGCACGACCCGCTATGCCGATTCAGTGAAAGGCCGTTTCACAATCTCTCAGGGA<br>ACAGCCAAGAACACGGTACTTGCAGATGAACTCTCTGCAACCCGAGGACACC<br>GCCATGTATTACTGTAAGACTGTCTGCGTGGTCGGCTCACGCTGGTCCGACTAT<br>TGGGGCCAGGGGACCCAAGTTACTGTTTCCAGCGGAGGCAGCGGTGGATCTGGG<br>GGCTCCGGCCAGGTGCAGCTCCAGGAATCTGGGGGCGGGTCCGTGCAGGCTGGG<br>GGATCTCTGCGCCTGAGTTGTCGCGCAAGTGGGAGTACCTACAGTAATTATTGC<br>CTGGGATGGTTCCGCCAGATCACAGGTAAGGAGCGCGAGGGCGTGGCCGTGATT<br>AACTGGGTGGTGGCATGTTGTACTTCGCTGATTCCGTCAAGGGACGTTTCACT<br>GTCTCTCAGGACCAGGCTAAGAATACCTTGTATCTTCAGATGAACTCCCTGAAG<br>CCTGAAGATACTGCTATGTATTACTGTGCGGCTGAGAGCGTCAGTTCCTTCTCC<br>TGTGGGGGCTGGCTGACTCGCCCGGACCGTGTGCCCTACTGGGGCCAGGGCACT<br>CAGGTGACCGTGAGCAGC |
| DR594-hIL27Ra_VH H11 | 1119 | CAGGTGCAGCTTCAGGAGAGCGGAGGCGGGTCCGTGCAGGCTGGTGGGTCACTG<br>AGACTGTCATGTGTGGCTTCAGCTTCAACGTACTGTACCTATGACATGCACTGG<br>TACAGGCAAGCTCCTGGGAAAGGCCGCGAGTTCGTGTCCGCTATTGACAGCGAC<br>GGTACTACCCGTTATGCCGACAGCGTCAAGGGCAGATTTACCATCTCCCAAGGC<br>ACGGCCAAAAACACCGTGTATCTCCAGATGAACAGCCTTCAGCCCGAGGACACC<br>GCAATGTATTACTGCAAGACCGTGTGTGTTGTGGGGAGCCGTTGGTCCGACTAC<br>TGGGGCCAGGGCACCCAAGTGACCGTCTCCTCTGGGGGTGGCTCCCAGGTCCAG<br>CTTCAGGAGTCCGGCGGAGGCAGTGTTCAGGCCGGAGGGAGCCTGAGACTGAGC<br>TGCCGTGCTTCTGGTAGTACTTACTCTAACTACTGTTTGGGCTGGTTTCGCCAA<br>TCCACCGGCAAAGAGCGTGAGGGGGTCGCGGTCATCAACTGGTCGGAGGTATG<br>CTGTACTTTGCCGATAGCGTCAAGGGAAGATTTACCGTCTCCCAAGACCACGCC<br>AAGAACACCGTGACCCTGCAAATGAACAGCCTGAAGCCAGAGGATACCGCCATG<br>TACTATTGCGCGGCAGAATCCGTCTCCAGCTTTTCTTGCGGAGGCTGGCTCACA<br>AGACCAGGGCGCGTGCCTTACTGGGGACAAGGCACCCAGGTGACAGTCAGCTCA |

TABLE 1B-continued

| Name | SEQ ID NO: | Sequence |
| --- | --- | --- |
| DR594-hIL27Ra_VH H11 | 1120 | CAGGTGCAGTTGCAGGAGTCTGGGGGCGGAAGTGTCCAGGCTGGAGGCTCCCTG<br>CGCCTGAGTTGTGTGGCCAGCGCCAGCACTTACTGCACTTATGACATGCACTGG<br>TACAGACAAGCCCCTGGCAAGGGTAGGGAGTTCGTGTCTGCTATTGACTCCGAC<br>GGGACCACACGTTATGCCGACTCTGTCAAGGGCCGTTTCACTATCTCCCAGGGA<br>ACGGCCAAGAACACAGTGTACTTGCAGATGAACTCTTTGCAACCCGAAGACACC<br>GCTATGTATTACTGTAAGACTGTGTGCGTCGTGGGTTCCAGGTGGTCAGACTAC<br>TGGGGTCAGGGTACTCAGGTCACTGTTAGCTCAGGGGGTTCTGGGGGCTCCGGG<br>GGTTCCGGCCAGGTGCAGCTTCAGGAGTCTGGAGGCGGTTCCGTCCAGGCGGGA<br>GGCTCTCTTAGACTGTCCTGCCGCGCCAGCGGCAGCACCTACTCCAACTACTGC<br>CTCGGATGGTTTCGTCAGTCCACAGGTAAGGAGCGCGAAGGCGTGGCTGTTATC<br>AACTGGGTGGGCGGAATGCTGTACTTTGCTGACTCCGTGAAAGGCCGCTTCACT<br>GTGTCACAAGACCATGCAAAGAACACCGTCACATTGCAGATGAACTCTCTGAAA<br>CCAGAGGATACTGCCATGTATTACTGCGCAGCTGAATCTGTGTCCTCTTTCTCT<br>TGCGGTGGCTGGCTGACCCGCCCTGGGAGAGTGCCGTACTGGGGCCAGGGCACC<br>CAAGTGACAGTCAGTTCT |
| DR594-hIL27Ra_VH H12 | 1121 | CAAGTACAGCTCCAGGAATCTGGAGGCGGTAGCGTGCAGGCCGGGGGCTCCTTG<br>CGCTTGTCCTGCGTTGCCTCAGCCAGCACCTACTGCACCTACGACGTGCACTGG<br>TATCGCCAAGCACCAGGGAAGGGCAGAGAGTTCGTGTCTGCCATCGACAGTGAT<br>GGCACTACCCGCTACGCCGACTCCGTTAAGGGGCGCTTTACCATTTCCCAGGGA<br>ACAGCCAAGAACACCGTGTACTTGCAGATGAACAGCTTGCAGCCTGAAGACACC<br>GCCATGTATTACTGCAAGACCGTGTGTGTAGTGGGTTCAAGGTGGTCCGACTAT<br>TGGGGACAGGGCACTCAGGTGACTGTGTCTTCCGGCGGAGGCAGCCAGGTACAG<br>CTCCAGGAATCCGTGGGGGCTCCGTTCAGGCTGGCGAGTCCCTGCGCCTGTCC<br>TGTAGGGCCTCCGGCTCCACGTATAGTAACTACTGTCTGGGCTGGTTCCGCCAG<br>ATCACCGGCAAGGAACGCGAGGGAGTGGCGGTAATAAATTGGGTTGGGGGAATG<br>CTGTATTTCGCCGACAGCGTGAAAGGCAGATTCACCGTGTCCCAGGACCAGGCG<br>AAGAACACCGTGTATTTGGAAATGAACTCTCTGAAGCCCGAGGATACCGCTATG<br>TATTACTGCGCTACCGAAAGCGTAAGCTCCTTCAGCTGTGGGGGTTGGCTGACA<br>CGCCCTGATCGGGTTCCCTACTGGGGCCAGGGTACGCAGGTCACCGTTTCCTCC |
| DR594-hIL27Ra_VH H12 | 1122 | CAGGTCCAGCTGCAAGAGTCCGGTGGAGGCAGTGTGCAGGCAGGCGGTAGCCTG<br>CGTTTGTCCTGTGTGGCATCCGCCAGTACCTACTGCACTTACGATATGCACTGG<br>TACAGACAAGCCCCCGGCAAAGGCCGGGAGTTCGTTTCAGCTATCGACTCTGAC<br>GGGACCACTAGGTATGCGGACTCTGTCAAGGGCCGCTTTACAATTAGCCAGGGC<br>ACGGCCAAAAACACCGTATATCTCCAGATGAACAGCCTCCAACCAGAAGACACA<br>GCCATGTATTACTGCAAGACTGTATGCGTGGTCGGCTCCCGTTGGTCTGACTAT<br>TGGGGCCAGGGAACTCAGGTCACCGTCTCATCCGGTGGCTCTGGTGGGAGCGGG<br>GGTTCCGGCCAGGTGCAGCTCCAGGAGTCAGGTGGCGGGAGCGTGCAGGCGGGG<br>GAGTCCCTCCGGCTGAGTTGTAGGGCTTCCGGTAGCACTTACTCCAACTACTGC<br>CTCGGCTGGTTTCGCCAGATCACGGGCAAGGAGCGCGAGGGCGTGGCCGTAATT<br>AACTGGGTCGGAGGGATGCTGTATTTCGCGGACAGCGTTAAGGGACGCTTCACC<br>GTGTCCCAGGATCAGGCCAAGAACACCGTCTATCTGGAGATGAACTCCCTGAAG<br>CCCGGAGGACACAGCCATGTATTACTGCGCAACGGAATCCGTGTCTAGCTTCAGC<br>TGCGGTGGGTGGCTCACCCGTCCCGACCGCGTGCCGTATTGGGGGCAGGGGACC<br>CAGGTGACTGTGTCCTCC |
| DR594-hIL27Ra_VH H13 | 1123 | CAGGTGCAACTCCAGGAGTCAGGCGGTGGCTCCGTCCAGGCGGGAGGTTCCCTG<br>CGCCTTTCTTGCGTTGCATCTGCGTCCACCTACTGTACCTATGACATGCACTGG<br>TATCGTCAGGCACCAGGCAAGGGGAGGGAGTTCGTGTCTGCGATTGATTCTGAT<br>GGCACAACTAGGTATGCTGACTCCGTCAAGGGACGGTTCACATCTCTCAAGGG<br>ACCGCCAAGAATACCGTGTATCTCCAGATGAACTCCCTTCAGCCCGAGGACACG<br>GCCATGTATTACTGCAAGACCGTTTGCGTCGTGGGTTCCAGGTGGTCTGACTAC<br>TGGGGCAAGGCACGCAGGTGACCGTTAGCTCTGGCGGGGTAGCCAGGTGCAG<br>TTGCAGGAATCTGGTGGAGGTTCTGTGCAAGCAGGAGGGTCTCGCGCTTGAGT<br>TGCGTAGCAAGTGGGTACGTGAGTTGTGATTACTTCCTGCCTTCTTGGTACAGG<br>CAGGCTCCGGGCAAGGAACGCGAGTTCGTGTCCATTATCGACGGGACCGGCTCC<br>ACCAGCTATGCCGCGAGCGTCAAGGGGCGCTTCACAGCCAGCCAGGATCGCGGG<br>AAGAACATCGCCTACTTGCAGATGAACAGCCTGAAACCGGAAGATACAGCTATG<br>TATTACTGTAAGGCCTCCTGCGTCCGTGGCCGTACTATTAGTGAATACTGGGGC<br>CAAGGCACGCAGGTGACCGTATCTTCC |
| DR594-hIL27Ra_VH H13 | 1124 | CAGGTTCAGCTCCAGGAGAGCGGAGGTGGCAGCGTTCAAGCCGGTGGCTCCCTG<br>CGCCTGTCTTGTGTCGCGTCTGCTTCCACGTACTGCACCTACGACATGCACTGG<br>TATCGGCAGGCTCCTGGAAAGGGCCGCGAGTTCGTCTCCGCTATCGACTCTGAC<br>GGAACCACTCGCTATGCCGATAGCGTGAAGGGCCGCTTCACCATTAGCCAAGGC<br>ACAGCCAAGAACACAGTGTACTTGCAGATGAACAGCCTCCAGCCGGAAGACACT<br>GCTATGTACTATTGCAAGACTGTGTGTGTTGTGGGGTCCCGTTGGTCTGATTAT<br>TGGGGCCAGGGCACCCAGGTGACCGTCAGTAGCGGGGCAGTGGCGGGTCAGGA<br>GGCTCCGGTCAGGTGCAGTTGCAGGAGAGCGGAGGGGGCAGTGTTCAGGCCGGG<br>GGCAGCCTGAGACTGTCTTGTGTCGCCTCCGGCTATGTGTCTTGTGACTACTTT<br>CTGCCATCCTGGTATCGGCAGGCCCCTGGGAAGAAAGAGAGTTCGTGTCCATT<br>ATCGACGGCACTGGAAGCACCCTTATGCTGCCTCGTGAAGGGTAGGTTTACT<br>GCCTCCCAAGACAGGGGGAAGAACATTGCTTATCTCCAGATGAACAGTCTGAAG<br>CCCGAGGACACTGCGATGTATTACTGTAAGGCCTCTTGCGTTCGCGGTCGCACA<br>ATTTCCGAGTACTGGGGCCAGGGAACACAGGTGACCGGTGAGTAGC |

TABLE 1B-continued

| Name | SEQ ID NO: | Sequence |
|---|---|---|
| DR594-hIL27Ra_VH H14 | 1125 | CAGGTACAGCTCCAGGAGTCTGGCGGAGGTTCAGTGCAGGCTGGCGGTTCTTTG<br>CGCCTGTCCTGTGTAGCCTCCGCCAGCACATATTGCACTTACGACATGCACTGG<br>TATCGCCAGGCTCCGGGTAAGGGCCGCGAGTTTGTTAGCGCCATCGACTCCGAT<br>GGAACAACCCGTTATGCTGACTCTGTGAAGGGCCGCTTTACAATTAGTCAGGGA<br>ACCGCAAAGAATACTGTTTATTTGCAGATGAATAGCCTGCAACCCGAGGACACC<br>GCTATGTATTACTGTAAGACAGTGTGCGTTGTGGGCTCCCGCTGGAGCGACTAT<br>TGGGGTCAGGGCACACAGGTTACCGTGTCCAGCGGAGGCGGGAGCCAGGTGCAG<br>CTCCAGGAGTCAGGTGGCGGATCTGTCCAAGCTGGAGGTTCCCTGCGTTGTCT<br>TGTGTGGCCTCTGGTTATGTGTCATGCGATTATTTCTTGCCCAGCTGGTATCGC<br>CAGGCTCCGGGCAAGGAGCGCGAATTTGTGTCTATCATTGACGGCACCGGCTCC<br>ACCTCCTACGCAGCCAGTGTCAAGGGGCGCTTCACGGCAAGCCAAGACAAGGGA<br>AAGAACATCGCCTATTTGCAGATGAACTCTTTGAAGCCAGAGGACACCGCCATG<br>TATTACTGTAAGGCATCTTGTGTGAGGGGCCGCGCGATCAGCGAGTACTGGGGC<br>CAGGGCACCCAGGTGACCGTGAGCAGC |
| DR594-hIL27Ra_VH H14 | 1126 | CAGGTGCAGCTTCAGGAGTCCGGCGGGGGCAGCGTGCAAGCCGGGGGATCTCTG<br>CGCCTCTCCTGTGTCGCGAGCGCAAGCACATACTGCACCTACGATATGCACTGG<br>TATCGCCAGGCCCCCGGCAAGGGCAGAGAGTTCGTGAGCGCGATTGATTCCGAT<br>GGCACTACCCGCTACGCTGATAGTGTGAAAGGACGGTTCACTATCTCCCAGGGC<br>ACTGCCAAAAACACAGTGTACCTCCAGATGAACTCCCTTCAGCCCGAGGACACC<br>GCCATGTATTACTGCAAAACTGTGTGCGTGGTAGGGTCTCGCTGGAGCGATTAT<br>TGGGGGCAGGGAACCCAGGTGACAGTTTCCTCTGGGGGCAGCGGAGGTTCTGGC<br>GGTTCCGGCCAGGTGCAGCTTCAGGAAAGCGGAGGTGGGAGCGTGCAGGCCGGA<br>GGCAGCCTCAGGCTGAGCTGCGTGGCCTCCGGTTACGTATCATGCGATTACTTC<br>CTCCCCTCCTGGTATCGGCAGGCTCCGGGCAAGGAGCGCGAGTTCGTGAGCATT<br>ATCGACGGTACAGGCTCCACCAGCTATGCCGCATCTGTGAAGGGACGTTTCACA<br>GCTTCCCAGGACAAGGGTAAAAACATTGCCTACTTGCAGATGAACGCTTGAAG<br>CCGGAAGATACCGCAATGTATTACTGCAAAGCCAGTTGTGTCCGTGGCCGCGCT<br>ATCTCCGAGTATTGGGGACAGGGCACACAGGTGACGGTGTCCTCC |
| DR594-hIL27Ra_VH H15 | 1127 | CAGGTCCAGCTCCAGGAGAGCGGCGGTGGAAGCGTCCAGGCTGGGGGCTCTCTG<br>CGTCTGTCTTGTGTAGCCTCTGCCTCTCCACTTACTGTACTTACGACATGCACTGG<br>TATCGCCAGGCCCCTGGCAAGGGCCGCGAGTTCGTTTCCGCCATTGATTCTGAC<br>GGTACTACCAGATACGCCGACTCCGTGAAAGGTAGGTTCACGATCAGCCAGGGC<br>ACTGCCAAAAACACAGTTTATCTCCAGATGAACTCCCTCCAGCCTGAGGACACT<br>GCCATGTATTACTGTAAAACCGTTTGTGTGGTCGGATCTCGGTGGTCTGACTAT<br>TGGGGGCAGGGCACCCAGGTGACCGTATCTTCCGGCGGAGGGTCCCAGGTCCAG<br>TTGCAGGAGTCTGGCGGAGGCTCCGTACAGGCAGGGGCTCCCTGCGCCTCTCT<br>TGCGTGGCCTCCGGCTACGTGTCTTGCGACTATTTCCTGCCATCTTGGTATAGA<br>CAGGCTCCCGGCAAGGAGCGCGAGTTTGTGTCTATTATCGACGGCACCGGCTCA<br>ACTTCCTACGCTGCCTCTGTGAAGGGCGCTTTACCGCCAGCCAGGACAAAGGC<br>AAGAACATCGCGTACCTCCAGATGAACACCCTGAAGCCCGAGGACACCGCCATG<br>TATTACTGTAAGGCCTCCTGTGTGCGTGGACGTGCCATCTCCGAATACTGGGGC<br>CAGGGCACCCAGGTGACCGTAAGCTCA |
| DR594-hIL27Ra_VH H15 | 1128 | CAGGTGCAGCTGCAAGAGAGCGGTGGGGGCAGCGTGCAAGCTGGGGGCAGCCTG<br>CGCCTCTCCTGCGTCGCGCTCGTCTTCCACTTACTGTACTTACGACATGCACTGG<br>TATCGCCAGGCCCCTGGCAAGGGCCGCGAGTTCGTGTCTGCCATTGACAGCGAT<br>GGAACGACCCGCTACGCGGACAGCGTTAAGGGTCGCTTCACTATCTCTCAGGGC<br>ACTGCTAAAAACACTGTGTACCTCCAGATGAACTCTTTGCAGCCCGAGGATACT<br>GCCATGTATTACTGTAAGACCGTTTGCGTTGTGGGTTCCCGTTGGTCCGATTAT<br>TGGGGCCAGGGCACCCAGGTGACCGTATCAAGCGGCGGGTCCGGGGGCAGCGGA<br>GGTCAGGTCAGGTGCAGTTGCAGGAAAGCGGAGGTGGCAGCGTACAGGCCGGG<br>GGCTCCCTGAGGCTGAGCTGCGTGGCGAGTGGCTACGTCAGTTGCGACTACTTC<br>TTGCCTTCTTGGTATCGGCAAGCCCCGGTAAGGAGCGCGAGTTCGTGAGTATT<br>ATCGACGGCACTGGTAGCACCTCCTATGCTGCCAGCGTGAAAGGTCGTTTTACC<br>GCCTCCCAGGACAAGGGTAAAAACATTGCCTATTTGCAAATGAACACCCTTAAA<br>CCTGAGGACACTGCCATGTATTACTGTAAGGCTTCATGTGTGAGAGGTCGTGCT<br>ATCTCAGAATACTGGGGCCAGGGCACCCAAGTCACTGTTTCTTCT |
| DR594-hIL27Ra_VH H16 | 1129 | CAGGTTCAGCTCCAGGAATCCGGCGGTGGCTCCGTTCAGGCAGGGGGCAGCCTG<br>CGTCTGTCCTGTGTCGCATCCGCCTCTACCTACTGCACTTACGATATGCACTGG<br>TATCGGCAGGCTCCTGGTAAGGGCCGCGAGTTCGTCAGTGCTATTGACTCCGAC<br>GGTACAACCCGGTATGCGGATTCTGTGAAAGGAAGATTTACGATCTCCCAAGGG<br>ACCGCAAAAAACACCGTGTACCTTCAGATGAACTCTCCAGCCCGAAGATACA<br>GCGATGTATTACTGCAAGACTGTATGCGTGGTAGGTTCTCGTTGGAGCGACTAC<br>TGGGGCCAGGGTACACAAGTCACCGTCTCCAGCGGCGGGGCAGCCAGGTCCAG<br>CTCCAGGAATCTGGCGGAGGTTCCGTGCAGGCCGGAGGTAGCCTTCGCCTCTCT<br>TGCCGCGCATCCGGCAGCACCTACTCCAACTACTGTCTGGGCTGGTTCAGGCAG<br>ATCACCGGCAAGGAGCGCGAGGGCGTAGCCGTAATAAATTGGGTAGGCGGTATG<br>CTGTACTTTGCTGACAGCGTTAAGGGTCGGTTTACGGTGTCCCAGGATCAGGCC<br>AAGAACACCGTGTATCTCCAGATGAACTCCCTGAAGCCGGAGGATACCGCTATG<br>TACTATTGCGCAGCCGAGTCAGCTAGTTCCTTCAGCTGCGGTGGCTGGCTCACG<br>AGACCAGATCGCGTCCCCTACTGGGGACAAGGCACACAGGTTACCGTGTCCTCC |

TABLE 1B-continued

| Name | SEQ ID NO: | Sequence |
|---|---|---|
| DR594-hIL27Ra_VH H16 | 1130 | CAGGTCCAGCTTCAGGAGAGCGGGGGAGGCTCCGTGCAAGCTGGAGGTTCCCTC<br>CGCTTGTCCTGCGTTGCGTCCGCAAGCACCTACTGCACTTATGACATGCACTGG<br>TATCGCCAGGCTCCTGGCAAAGGGAGAGAGTTCGTCTCCGCCATTGATAGCGAT<br>GGTACAACTAGGTACGCAGATTCCGTTAAAGGTAGGTTTACTATCAGCCAGGGC<br>ACGGCCAAAAACACCGTCTATCTGCAAATGAACTCTCTCCAGCCCGAGGATACC<br>GCGATGTACTATTGCAAGACCGTCTGTGTAGTGGGCAGCCGCTGGTCAGACTAT<br>TGGGGCCAGGGAACGCAGGTGACAGTGTCTAGCGGCGGGTCCGGCGGTTCCGGT<br>GGCTCCGGCCAGGTACAGCTCCAGGAGTCAGGCGGAGGCTCCGTGCAAGCCGGG<br>GGTTCTCTGCGGCTCTCCTGTCGCGCTTCTGGGTCCACCTATTCCAATTACTGC<br>CTGGGCTGGTTCCGTCAAATTACGGGCAAGGAGCGCGAAGGCGTGGCCGTGATA<br>AATTGGGTGGGCGGGATGTTGTACTTTGCTGACAGCGTTAAGGGACGTTTTACT<br>GTGTCCCAGGACCAGGCCAAGAACACCGTGTACTTGCAGATGAACTCCTTGAAG<br>CCAGAGGACACAGCAATGTATTACTGTGCCGCTGAAAGCGCCAGCTCTTTCAGT<br>TGTGGGGCTGGCTGACTAGACCAGACCGTGTCCCTTACTGGGGTCAGGGCACC<br>CAGGTTACCGTGTCCTCC |
| DR594-hIL27Ra_VH H17 | 1131 | CAAGTCCAGCTCCAGGAGTCCGGCGGTGGCTCCGTCCAGGCGGGCGGATCTCTG<br>CGCCTGTCCTGTGTCGCCTCCGCTTCCACATACTGCACCTATGACATGCACTGG<br>TATCGGCAGGCTCCTGGTAAGGGCCGCGAGTTCGTCAGCGCCATCGACTCCGAC<br>GGAACGACCCGGTACGCTGATAGCGTGAAAGGTAGGTTTACCATCTCACAGGGC<br>ACCGCCAAAAATACCGTCTACTTGCAGATGAACAGTTTGCAGCCTGAGGACACC<br>GCCATGTATTACTGCAAGACTGTGTGTGTAGTGGGGTCACGCTGGTCTGATTAT<br>TGGGGCCAGGGTACTCAGGTGACTGTGTCTAGTGGCGGTGGCAGCCAGGTGCAG<br>TTGCAGGAGAGTGGAGGCGGTCTCGTCAGCCAGGAGGCAGTCTGCGCCTGTCA<br>TGCGCTGCCTCCGGCTTTACTTTTTCCCTGTCTGGTATGTCATGGGTGCGGCAG<br>GCCCCCGGCAAGGGTCTGGAGTGGGTCAGTGCAATCAGCAGTGGAGGGGCCTCT<br>ACTTATTACACCGACAGCGTCAAAGGCAGATTCACCATCAGTAGGGATAATGCC<br>AAGAACATGCTGTACCTCCAGCTGAACTCTCTGAAGCAGAGGACACGGCTATG<br>TACTATTGTGCTAAAGGGGGCAGCGGTTACGGGGATGCTTCCAGAATGACTTCT<br>CCGGGATCTCAGGGTACTCAAGTCACCGTTAGTTCT |
| DR594-hIL27Ra_VH H17 | 1132 | CAAGTCCAGCTCCAGGAGAGCGGAGGGGGTTCCGTGCAGGCAGGGGGTTCACTT<br>CGCCTGTCCTGTGTGGCTTCTGCTTCCACCTATTGCACGTATGATATGCACTGG<br>TATCGCCAGGCTCCCGGCCAAGGGCCGCGAGTTCGTCTCAGCGATTGATTCTGAC<br>GGCACCACTCGCTACGCTGACTCTGTGAAGGGCGCTTTACCATCAGTCAAGGT<br>ACTGCGAAGAACACCGTGTACCTTCAGATGAACTCACTGCAACCGGAGGACACC<br>GCGATGTACTATTGCAAGACTGTTTGTGTGGTCGGTTCCCGCTGGTCCGATTAC<br>TGGGGGCAGGGCACTCAGGTGACGGTCAGTTCCGGCGGGAGTGGCGGGTCCGGG<br>GGCTCTGGCCAAGTGCAGTTGCAGGAGAGCGGGGGAGGCCTCGTGCAGCCAGGT<br>GGATCTCTGCGGCTGTCTTGTGCCGCTTCCGGCTTCACTTTTTCCCTGTCCGGC<br>ATGAGTTGGGTCCGCCAGGCCCCAGGGAAAGGCCTGGAGTGGGTGTCCGCCATC<br>TCTAGCGGCGGTGCCTCCACATATTACACTGACAGCGTCAAGGGTCGCTTTACG<br>ATTTCCCGCGATAACGCTAAGAACATGCTCTACCTCCAGCTGAACAGCCTGAAG<br>ACCGAGGATACTGCCATGTATTACTGTGCCAAAGGGGGTAGCGGCTATGGGGAC<br>GCCAGCAGGATGACCAGTCCCGGAAGTCAGGGAACTCAGGTCACCGTTTCTTCC |
| DR594-hIL27Ra_VH H18 | 1133 | CAGGTACAGCTTCAGGAGAGCGGGGGAGGCTCTGTGCAGGCCGGAGGCTCTCTG<br>CGCCTCTCTTGTGTCGCCTCCGCGTCTACCTATTGCACCTACGACATGCACTGG<br>TATCGCCAGGCCCCCGGAAAGGGTCGCGAGTTCGTGTCTGCTATCGACTCCGAC<br>GGGACCACTCGCTACGCTGACTCCGTAAAAGGACGTTTTACAATTAGTCAGGGT<br>ACAGCCAAGAATACAGTATACCTGCAAATGAACTCCTTGCAGCCAGAGGACACC<br>GCCATGTATTACTGCAAGACCGTGTGCGTGGTCGGCAGTCGCTGGTCCGACTAC<br>TGGGGCCAGGGAACCCAGGTCACGGTCTCAAGCGGAGGGGATCACAGGTCCAG<br>CTGCAAGAATCAGGAGGTGGAAGCGTGCAGGCAGGCGGAAGCCTGAGGCTGTCC<br>TGCGTGGCCAGCGGCTACGTGTCCTGCGATTACTTTCTCCCTAGCTGGTATCGC<br>CAGGCACCCGGAAAAGAGGGAGTTCGTCTCAATTATCGACGGAACTGGAAGC<br>ACCTCTTACGCCGCTTCCGTGAAGGGCCGCTTTACTGCATCACAGGATAAGGGC<br>AAGAATATCGCCTACCTCCAGATGAACTCACTGAAGCCTGAGGACACTGCTATG<br>TATTACTGCAAGGCTTCCTGTGTGCGGGTCGCGGAATCTCTGAGTACTGGGGT<br>CAGGGTACTCAGGTCACCGTCTCTTCT |
| DR594-hIL27Ra_VH H18 | 1134 | CAGGTGCAGTTGCAGGAGAGCGGAGGTGGGAGTGTCCAGGCTGGTGGCTCCTTG<br>CGCCTGAGCTGCGTGGCCTCCGCCTCCACTTATTGCACCTACGACATGCACTGG<br>TACAGGCAAGCCCCTGGTAAGGGTAGGAGTCGTCAGCGCCATTGATAGCGAT<br>GGCACAACCCGTTACGCGGATAGCGTGAAGGGCCGTTTCACAATCTCACAGGGC<br>ACCGCCAAGAACACCGTTTATTTGCAGATGAACAGCCTCCAGCCCGAAGATACA<br>GCTATGTATTACTGTAAGACCGTGTGTGTGGTTGGTAGCAGATGGTCCGACTAC<br>TGGGGTCAAGGCACTCAAGTCACCGTATCCAGCGGCGGATCAGGAGGCAGCGGG<br>GGTTCCGGGCAGGTGCAGCTCCAGGAATCAGGCGGTGGCAGCGTGCAGGCAGGG<br>GGTTCCTTGCGTCTGAGTTGTGTGGCAAGTGGCTATGTAAGCTGTGACTACTTC<br>CTCCCCAGTTGGTATCGCCAGGCTCCCGGCAAGGAGCGGGAGTTCGTGAGTATC<br>ATTGATGGCACTGGTAGCACCTCCTACGCAGCGAGCGTCAAGGGTCGTTTTACC<br>GCGTCTCAGGACAAGGGAAAAAACATCGCGTACCTCCAGATGAACAGCCTGAAG<br>CCTGAGGACACAGCCATGTATTACTGCAAGGCCTCCTGCGTGCGCGGTCGCGGA<br>ATTTCCGAGTATTGGGGCCAGGGCACCCAAGTAACAGTAAGCTCT |

TABLE 1B-continued

| Name | SEQ ID NO: | Sequence |
|---|---|---|
| DR594-hIL27Ra_VH H19 | 1135 | CAGGTCCAACTTCAAGAGTCTGGCGGTGGGTCCGTCCAGGCCGGGGGTTCCCTC AGACTGTCATGCGTGGCCTCCGCTTCCACCTATTGTACCTACGACATGCACTGG TATCGCCAGGCTCCTGGCAAGGGCCGCGAGTTCGTGTCTGCCATTGATTCAGAC GGGACAACCCGCTACGCAGACTCCGTGAAAGGTCGTTTTACCATCTCACAGGGC ACTGCAAAAAACACTGTCTATCTGCAAATGAACTCCTTGCAGCCAGAAGACACC GCCATGTATTACTGCAAGACCTATGTGTCGTGGGAAGCCGTTGGTCAGACTAC TGGGGGCAGGGCACCCAAGTTACGGTGTCCTCTGGCGGGGGCAGTCAGGTGCAG TTGCAGGAGAGCGGGGGCGGTTCTGTGCAAGCTGGCGGTTCCCTGCGCCTGAGC TGTCGCGCCTCTGGATCTACGTATAGCAACTACTGCCTGGGCTGGTTCCGCCAG ATCACCGGAAAGGAACGTGAGGGAGTGGCCGTCATCAACTGGGTGGGCGGAATG CTGTACTTCGCCGATTCTGTCAAGGGCCGGTTTACTGTCTCCCAGGATCAGGCG AAGAACACGGTATACCTTCAGATGAACAGCCTGAAACCAGAAGATACCGCTATG TATTACTGTGCCGCAGAGAGCGTCTCCAGCTTTTCCTGCGGAGGCTGGCTCACC CGCCCAGATCGTGTGCCTTACTGGGGCAGGGGACCCAGGTGACTGTTTCCTCC |
| DR594-hIL27Ra_VH H19 | 1136 | CAAGTCCAGCTCCAGGAGTCCGGCGGGGGTTCCGTCCAGGCTGGGGGCTCTTTG CGGTTGTCTTGTGTCGCATCAGCCTCCACTTATTGTACCTATGATATGCACTGG TATCGCCAGGCTCCGGGGAAGGGCAGGGAATTTGTGTCAGCTATTGATTCCGAC GGAACCACACGGTATGCAGATTCTGTGAAAGGCCGCTTCACTATCTCACAGGGT ACTGCCAAGAACACCGTCTACTTGCAGATGAACTCCCTCCAGCCAGAGGACACT GCCATGTATTACTGCAAGACCGTCTGTGTGGTTGGGAGTAGGTGGAGTGACTAC TGGGGCCAGGGCACACAGGTCACGGTATCTTCCGGCGGAAGCGGCGGAAGTGGT GGCTCTGGACAAGTGCAGTTGCAGGAGAGCGGCGGGGGTTCCGTGCAGGCAGGC GGAAGCCTGAGGCTGAGCTGTCGTGCTTCTGGCTCCACCTATTCCAACTATTGC TTGGGTTGGTTTCGCCAAATTACCGGCAAGGAGCGTGAAGGCGTTGCTGTCATC AACTGGGTTGGGGGTATGCTCTACTTTGCTGACTCCGTGAAGGGTCGCTTCACA GTCAGCCAAGACCAGGCTAAGAACACAGTGTATCTCCAGATGAACTCTCTTAAA CCGGAAGACACTGCTATGTATTACTGCGCCGCAGAAAGCGTCAGCTCCTTCAGT TGCGGTGGCTGGCTGACCAGGCCAGATCGCGTACCATATTGGGGACAGGGAACC CAGGTCACCGTGTCCTCC |
| DR594-hIL27Ra_VH H20 | 1137 | CAAGTGCAGCTGCAAGAGAGCGGCGGTGGCTCCGTGCAGGCCGGGGGCTCCCTG CGCCTGAGCTGTGTGGCAAGCGCCTCAACATACTGCACCTATGACATGCACTGG TATCGTCAGGCTCCCGGAAAGGGCAGAGAGTTCGTGTCCGCCATCGACAGCGAT GGGACAACCCGCTACGCAGACAGCGTGAAGGCCGCTTCACTATCTCTCAGGGC ACAGCTAAGAACACCGTGTACCTTCAGATGAACCTTGCAGCCTGAGGATACT GCCATGTACTATTGCAAGACCGTGTGTGTAGTGGGCTCCAGATGGTCTGACTAC TGGGGGCAGGGAACACAGGTTACCGTCTCTAGCGGGGGCGGAAGCCAAGTGCAG TTGCAGGAAAGCGGGGGCGGGCTGGTCCAGCCAGGGGATCTCTGAGGCTGTCT TGCGCCGCATCAGGTTTTACTTTCTCAAGCTACCCCATGTCCTGGGTCAGACAA GCGCCGGGGAAGGGCTTGGAATGGGTGAGCACCATCTCCAGCGGTGGAGACACG ACCCTGTACGCCGACAGCGTCAAAGGGCGCTTCACATCTAGCCGCGACAATGCA AAAAACACCCTGTACCTCCAGCTTAATTCCCTGAAGACAGAGGACACCGCAATG TACTATTGCGCGAAACGGATTGACTGCAACTCCGGTTATTGTTACAAGCGCAGT TACTGGGGCCAGGGGACCCAGGTGACCGTGTCTAGC |
| DR594-hIL27Ra_VH H20 | 1138 | CAGGTTCAGCTTCAGGAATCTGGAGGGGGATCTGTGCAGGCTGGTGGAAGCCTG CGTCTCAGCTGCGTGGCCTCTGCCTCCACGTATTGTACCTACGACATGCACTGG TACAGGCAGGCTCCAGGGAAGGGCCGGGAGTTTGTGAGCGCTATTGATTCAGAC GGCACTACACGGTACGCTGACAGTGTCAAGGGGAGGTTCACCATCAGCCAGGGG ACAGCTAAGAATACCGTCTACCTCCAGATGAACTCCCTTCAGCCGGAGGATACC GCTATGTATTACTGCAAGACGGTGTGCGTGGTCGGCTCCCGTTGGAGCGACTAC TGGGGCAGGGCACCCAAGTTACCGTGTCCAGCGGAGGTTCAGGCGGTTCTGGT GGCTCTGGCCAGGTCAGCTCCAGGAGAGCGGAGGCGGTCTGGTGCAGCGGGT GGCTCCCTGAGACTTTCCTGCGCAGCTTCCGGCTTTACCTTCTCTAGCTATCCA ATGTCTTGGGTGAGACAGGCCCCTGGAAAGGGTCTGGAGTGGGTGTCTACTATT TCCTCTGGTGGCGATACAACCCTGTACGCGGATTCTGTCAAAGGTCGTTTCACC AGCTCACGCGACAACGCTAAGAACACCTTGTATCTTCAGTTGAACAGCCTGAAG ACAGAGGACACTGCGATGTATTACTGTGCAAAGCATTGATTGTAATAGCGGC TACTGTTACAAGCGTAGCTACTGGGGCCAAGGCACCCAGGTCACGGTCAGCAGC |
| DR594-hIL27Ra_VH H21 | 1139 | CAGGTGCAGCTTCAGGAGTCTGGTGGCGGTTCCGTCCAGGCTGGCGGTTCTCTG AGGCTGTCATGCGTGGCATCTGCGAGCACCTACTGTACTTACGACATGCACTGG TATCGTCAGGCCCCCGGTAAGGGTCGGGAGTTCGTGTCCGCCATTGATAGCGAT GGGACAACCCGGTACGCCGACTCCGTGAAGGGTCGCTTCACTATCTCACAGGGA ACCGCTAAGAACACAGTCTACCTTCAGATGAACTCTTTGCAGCCAGAGGACACC GCCATGTATTACTGTAAGACAGTGTGTGTAGTTGGAAGCCGCTGGAGCGACTAC TGGGGCCAAGGCACTCAGGTCACCGTCAGCTCTGGCGGAGGCAGCCAGGTGCAG TTGCAGGAGAGCGGCGGAGGCTTGGTACAGCCCGGAGGCTCCCTCCAGGCTCAGC TGTGCTGCCTCCGGTTTCACCTTTTCCCTGTCTTCCATGTCTGGGTGCGTCAG GCACCAGGCAAGGGTCTGGAGTGGGTGTCTGCTATCAGCTCCGGCGGAGCTTCC ACGTACTATACGGATTCCGTTAAGGGACGGTTCACTATCTCCCGTGACAACGCG AAGAATATGCTGTACCTTCAGCTCAACTCACTGAAGACTGAGGACACCGCCATG TATTACTGCGCCAAAGGGGCTCCGGCTATGGCGACGCGAGCCGTATGACTAGC CCTGGAAGCCAAGGCACACAGGTCACCGTTAGCTCC |

TABLE 1B-continued

| Name | SEQ ID NO: | Sequence |
|---|---|---|
| DR594-hIL27Ra_VH H21 | 1140 | CAGGTTCAGCTTCAGGAGAGCGGGGGAGGCAGCGTCCAGGCCGGAGGCTCACTG CGCCTGTCTTGTGTCGCCTCTGCATCTACCTACTGCACTTATGACATGCACTGG TATCGCCAAGCGCCGGGTAAAGGACGCGAGTTCGTCTCTGCCATCGACTCCGAC GGCACAACTCGCTACGCCGACTCTGTGAAGGGCAGGTTTACCATCAGCCAGGGA ACCGCTAAGAACACCGTTTACCTCCAGATGAACTCCCTCCAGCCTGAGGACACC GCCATGTATTACTGTAAGACCGTTTGTGTCGTGGGCTCCAGGTGGTCCGACTAC TGGGGACAGGGCACCCAGGTGACAGTCTCCAGCGGTGGAAGTGGTGGCTCCGGC GGTTCAGGCCAGGTCCAGTTGCAGGAGTCTGGCGGTGGACTCGTGCAACCTGGG GGCTCTCTGAGACTGAGCTGTGCGGCTTCTGGGTTCACCTTCAGTCTGAGCAGT ATGAGCTGGGTCCGCCAAGCCCCAGGAAAGGGACTGGAATGGGTGTCCGCCATC TCCTCTGGCGGAGCGAGCACATACTATACAGATAGCGTGAAAGGGAGGTTTACT ATCTCTAGGGATAACGCGAAGAACATGCTTTATCTCCAGCTTAATTCCTTGAAG ACTGAGGACACTGCCATGTACTATTGCGCCAAAGGTGGCAGCGGTTATGGAGAC GCCAGTAGAATGACCAGCCCAGGTTCCCAGGGGACTCAAGTGACCGTCAGTTCT |
| DR594-hIL27Ra_VH H22 | 1141 | CAGGTGCAGCTTCAGGAAAGCGGAGGCGGTAGCGTACAGGCCGGGGGTAGCCTG CGTTTGTCCTGCGTGGCGAGCGCTTCCACGTACTGTACCTACGACATGCACTGG TATCGCCAAGCGCCGGGAAAGGGACGCGAGTTCGTTTCCGCTATTGATTCCGAT GGGACCACACGCTACGCAGATTCCGTGAAGGGCCGCTTCACAATTTCCCAGGGC ACAGCCAAGAACACCGTGTACCTCCAGATGAACTCCTTGCAGCCTGAGGATACC GCCATGTATTACTGCAAAACAGTCTGCGTCGTGGGTTCTCGTTGGTCTGACTAT TGGGGCCAGGGAACTCAGGTTACCGTTTCCTCTGGGGGTGGGTCCCAGGTCCAG CTCCAGGAGTCAGGTGGCGGGTCCGTCCAAGCAGGTGGCTCCCTGCGCCTGTCT TGTCGGGCGAGCGGCAGTACTTATAGCAATTACTGTCTGGGCTGGTTCCGGCAG ACAACCGGCAAAGAGAGAGAGGGCGTTGCCGTTATTAACTGGGTGGGTGGAATG CTGTACTTCGCCGACTCCGTAAAGGGACGCTTCACCGTTAGCCAGGATCAGGCT AAAAATACAGTATACCTGCAAATGAACAGTTTGAAGCCTGAAGACACAGCCATG TACTATTGCGCCGCTGAGTCTGTCAGCTCTTTTTCTTGCGGGGATGGCTGACT CGCCCGGATCGCGTACCTTATTGGGGCCAGGGAACCCAAGTCACGGTCTCTAGT |
| DR594-hIL27Ra_VH H22 | 1142 | CAAGTGCAGCTTCAGGAAAGCGGAGGTGGAAGTGTGCAGGCTGGGGGTAGCCTG AGGCTGTCCTGCGTGGCGAGCGCGTCCACTTACTGTACCTACGACATGCACTGG TATCGCCAAGCACCAGGCAAGGGTCGCGAGTTCGTTTCCGCCATTGATAGCGAT GGCACCACTCGTTACGCTGACAGTGTGAAGGGTCGCTTTACCATTTCCCAGGGC ACAGCCGAAGAACACCGTTTACCTCCAGATGAACAGCCTTCAGCCAGAGGATACA GCCATGTACTATTGCAAAACCGTGTGCGTTGTGGGCAGCCGTTGGTCTGACTAT TGGGGACAAGGCACTCAGGTTACTGTCAGCTCCGGTGGGTCCGGGGGATCTGGG GGCAGCGGCCAGGTCCAGCTGCAAGAGTCTGGTGGCGGTTCCGTCCAGGCGGGC GGGAGTTTGCGGCTCAGCTGCCGCGCCTCAGGCTCAACTTACAGTAACTATTGC CTGGGCTGGTTCAGGCAGACCACAGGCAAGGAGAGAGAGGGTGTCGCCGTCATC AACTGGGTAGCCGGTATGCTGTACTTCGCCGACTCCGTTAAAGGGCGTTTCACG GTTTCCCAAGACCAGGCAAAGAACACTGTGTATCTCCAGATGAACAGCCTCAAA CCCGAAGATACCGCGATGTATTACTGTGCTGCCGAGAGCGTGTCTTCCTTCAGC TGTGGCGGTTGGCTTACACGCCCCGGATCGGGTTCCTTACTGGGGCCAGGGCACA CAGGTGACAGTCTCCAGC |
| DR594-hIL27Ra_VH H23 | 1143 | CAGGTGCAGCTCCAGGAGAGCGGTGGAGGCTCTGTGCAGGCCGGTGGCTCACTT CGCCTGTCCTGCGTGGCTTCAGCCAGCACTTACTGTACCTATGATATGCACTGG TATCGCCAGGCCCCTGGCAAAGGACGCGAGTTCGTGTCTGCCATTGATAGTGAT GGCACCACACGCTACGCCGACTCAGTTAAGGGTAGGTTTACCATTTCCCAAGGC ACGGCCAAGAACACCGTGTACCTGCAAATGAACTCCCTCCAGCCCGAGGACACA GCGATGTATTACTGCAAGACCGTGTGTGTTGTGGGTTCCCGCTGGTCCGACTAT TGGGGTCAGGGCACGCAGGTGACCGTTAGTTCCGGTGGAGGCAGCCAGGTCCAG CTTCAGGAGTCAGGCGGGGCTCAGTCCAGGCTGGCGGATCTCTCCGCTTGTCC TGTAGGGCCTCCCGTAGCCCCTACGGCAACTATTGTTTGGGTTGGTTCCGCCAG TCCACTGGCAAGGAGCGGGAGGGAGTTGCGGTCATCAACTGGGTGGGCGGGATG CTCTACTTTGCGGACTCCGTGAAAGGCCGCTTCACCGTTAGCCAGGATCACGCT AAGAACACTGTGACACTCCAGATGAACAGCCTGAAGCCTGAGGATACTGCCATG TACTATTGCGCCGCAGAGAGCGTGTCTAGCTTCTCCTGCGGCGGTTGGCTGACC AGACCCGACAGGGTTCCGTATTGGGGTCAAGGCACCCAGGTGACTGTCTCTAGT |
| DR594-hIL27Ra_VH H23 | 1144 | CAGGTTCAGCTTCAGGAGAGCGGGGGCGGTTCTGTTCAGGCAGGTGGGTCCCTG AGACTGTCTTGCGTTGCCAGCGCCTCCACGTATTGCACCTATGACATGCACTGG TATCGCCAGGCCCCTGGCAAGGGCAGAGAGTTCGTTTCTGCCATTGATTCTGAT GGCACAACCCGCTACGCCGATTCTGTCAAGGGACGCTTCACGATTTCCCAGGGG ACCGCCAAGAACACGGTATATCTGCAAATGAACTCTCCAGCCTGAAGACACA GCGATGTACTATTGTAAAACCGTGTGCGTCGTAGGCAGTCGTTGGTCCGATTAC TGGGGCCAGGGCACTCAAGTGACTGTCAGCTCCGGGGGCTCTGGAGGGAGCGGT GGCTCTGGTCAGGTCCAACTGCAAGAGTCAGGCGGGGCTCCGTGCAGGCCGGA GGCTCCCTGCGCCTTTCCTGTCGCGCAAGCCGTTCTCCATACGGGAACTATTGT CTGGGCTGGTTCAGACAGAGTACTGGGAAGGAGAGGGGGGCTGGCCGTCATC AACTGGGTCGGTGGAATGCTGTACTTCGCTGACAGTGTGAAGGGCCGTTTCACT GTGTCCCAGGATCACGCCAAAAACACTGTTACACTCCAGATGAACAGCCTGAAG CCAGAAGATACAGCAATGTATTACTGTGCGGCTGAATCTGTTTCCAGCTTTTCT TGCGGCGGTTGGCTGACGCGCCCTGATCGCGTCCCTATTGGGGCCAGGGTACT CAGGTTACTGTGTCATCT |

TABLE 1B-continued

| Name | SEQ ID NO: | Sequence |
|---|---|---|
| DR594-hIL27Ra_VH H24 | 1145 | CAGGTTCAGCTGCAAGAGTCTGGCGGAGGCTCTGTGCAGGCAGGAGGCTCTCTC CGGCTGAGCTGCGTGGCCTCCGCCTCCACTTACTGTACTTACGATATGCACTGG TATCGCCAAGCGCCGGGGAAGGGCCGTGAGTTTGTTAGCGCCATCGACTCCGAC GGTACGACTCGCTACGCCGATTCTGTGAAAGGGCGCTTCACTATTTCCCAAGGC ACCGCCAAAAACACCGTGTACCTTCAGATGAACTCTCTTCAGCCAGAGGACACC GCCATGTATTACTGCAAGACAGTCTGTGTTGTGGGCAGTCGTTGGAGCGATTAC TGGGGTCAGGGTACTCAGGTTACTGTCAGCTCCGGCGGGGAAGCCAGGTCCAG CTCCAGGAGAGCGGCGGGGCCTGGTGCAACCTGGCGGTTCTCTGCGCCTTTCC TGCGCTGCGTCTGGCTTCACATTCTCCCACTCCGGCATGAGCTGGGTCCGTCAG GCTCCGGGGAAGGGCCTTGAGTGGGTGTCCACGATCAATAGTGGCGGAGCCAGC ACCTATTACACCGACTCTGTCAAGGGCCGGTTCACTATCAGCCGGGATAACGCC AAGAACATGCTGTATTTGCAGCTGAACTCTCTGAAGACGGAGGACACCGCGATG TATTACTGTGCCAAGGGAGGCTCCGGCTATGGGATGCCTCCAGGATGACTTCT CCGGGTAGCCAGGGAACACAGGTGACAGTCTCAAGC |
| DR594-hIL27Ra_VH H24 | 1146 | CAGGTCCAACTGCAAGAGTCTGGAGGCGGTAGCGTCCAGGCCGGGGGTTCCCTG CGGCTGTCCTGTGTCGCCTCTGCGAGCACATACTGTACCTATGATATGCACTGG TATCGCCAAGCGCCGGGGAAGGGACGCGAGTTCGTCAGCGCCATTGATTCAGAC GGAACGACTCGGTACGCGGACTCTGTCAAGGGACGGTTCACCATCTCACAGGGT ACAGCCAAGAATACAGTCTACTTGCAGATGAACTCCTTGCAGCCCGAGGACACA GCCATGTATTACTGTAAAACCGTTTGCGTAGTGGGCTCCAGGTGGAGCGATTAC TGGGGCCAGGGCACTCAGGTCACCGTCAGCTCCGGCGGTTCCGGCGGGAGCGGA GGCAGCGGTCAGGTACAGCTGCAAGAAAGCGGAGGTGGGCTGGTTCAGCGGGA GGCAGCCTGCGCCTGTCCTGCGCCGCGTCAGGTTTCACGTTCTCTCACTCTGGG ATGAGCTGGGTGCGGCAAGCGCCGGGCAAGGGCCTCGAATGGGTCTCTACCATC AATTCTGGCGGGGCCTCCACCTATTACACCGATAGCGTTAAAGGCAGATTCACT ATCTCACGTGACAATGCCAAGAATATGCTGTACTTGCAGCTCAACAGTCTGAAG ACCGAAGATACTGCTATGTATTACTGTGCCAAGGGCGGGAGCGGATATGGTGAC GCATCCCGTATGACCAGCCCTGGCTCCCAGGGCACCCAGGTGACCGTCTCTAGC |
| DR595-hIL27Ra_VH H1 | 1147 | CAAGTCCAGCTCCAGGAGAGCGGGGGAGGCTCTGTTCAGGCTGGGGGCAGTCTG ACATTGTCCTGCGCTGCCAGCGAGTACGCCTATTCCACCTGTAACATGGGCTGG TATCGGCAAGCCCCAGGTAAGGAACGCGAACTCGTCTCAGCTTTCATCAGCGAT GGCAGCACTTATTACGCCGACTCTGTGAAGGGCCGCTTTACCATCACAAGGGAT AATGCAAAGAATACAGTGTATCTGCAAATGAACTCCCTCAAGCCGGAGGACACA GCTATCTATTACTGTTCCGCGAACTGCTACAGGCGTCTGAGGAACTACTGGGGG CAGGGCACTCAGGTTACCGTTAGCTCCGGCGGTGGAAGCCAGGTGCAGCTCCAG GAGTCTGGAGGCGGGCTGGTGCAGCCTGGGGGCAGCCTTCGCCTGTCTTGCGCG GCCAGCGGATTCACCTTCTCTAGCTACCCAATGTCTTGGGTGAGGCAGGCTCCT GGCAAAGGCCTTGAGTGGATCTCCACAATCAGCGCCGGAGGTGATACCACTCTG TACGCAGACAGTGTGAAGGGCCGCTTCACATCTTCCCGCGACAATGCCAAGAAC ACCCTGTACCTCCAGCTGAACTCACTGAAGACCGAGGACGCAGCGATCTACTAT TGTGCTAAACGTATTGACTGCAACAGTGGGTATTGCTACCGCCGTAACTACTGG GGGCAAGGGACGCAGGTCACCGTCTCTTCC |
| DR595-hIL27Ra_VH H1 | 1148 | CAGGTGCAGCTCCAGGAGTCTGGTGGCGGTTCTGTGCAGGCAGGGGGCTCCCTT ACACTGAGCTGCGCCGCGTCAGAGTATGCGTACAGCACCTGCAACATGGGCTGG TATCGCCAAGCCCCAGGTAAGGAGCGTGAGCTGGTGTCCGCGTTCATCTCCGAT GGCTCTACTTATTACGCTGACTCCGTCAAGGGACGCTTCACAATCACACGTGAC AACGCGAAGAACACCGTGTACCTTCAGATGAACTCTCTGAAACCAGAAGACACA GCGATCTACTATTGCTCTGCTAACTGCTACCGCAGGCTGCGCAACTACTGGGGT CAAGGCACCCAGGTCACCGTCAGCTCCGGTGGGAGTGGTGGCAGCGGTGGCTCC GGCCAGGTGCAGCTCCAGGAGTCTGGGGGCGGGCTGGTGCAGCCAGGTGGCTCC CTTAGATTGTCTTGCGCAGCTAGTGGATTTACCTTTTCTTCCTACCCAATGTCC TGGGTTCGCCAAGCTCCCGGCAAGGGGCTGGAATGGATTAGTACCATCTCTGCG GGAGGCGATACTACACTGTATGCCGATTCCGTCAAAGGCCGGTTCACCTCTTCC AGAGACAACGCCAAGAACACCCTGTATTTGCAGCTGAACAGCCTGAAGACCGAG GATGCTGCCATCTACTATTGCGCTAAGCGTATTGATTGCAACAGCGGCTACTGT TATCGGCGCAACTACTGGGGCCAGGGCACCCAGGTTACTGTTAGCAGT |
| DR595-hIL27Ra_VH H2 | 1149 | CAGGTTCAGCTCCAGGAAAGCGGTGGCGGGAGCGTGCAGGCCGGAGGCTCTCTG ACTCTGTCCTGTGCTGCGAGCGAATACGCCTACTCAACTTGCAACATGGGCTGG TATCGCCAGGCACCCGGCAAAGAGCGCGAGTTGGTGAGTGCCTTCATCTCCGAT GGCAGCACCTATTACGCAGATTCCGTTAAGGGGCGCTTCACAATCACCCGCGAC AACGCGAAGAACACCGTGTACCTCCAGATGAACTCTCTGAAGCCCGAGGATACC GCCATTTATTACTGTTCTGCTAACTGTTACAGACGCCTTCGTAATTATTGGGGC CAGGGCACCCAGGTAACCGTTAGCTCTGGCGGGGGCAGCCAGGTGCAGTTGCAG GAGTCCGGCGGGGACTGGTGCAGCCTGGAGGGTCTCTTAGGCTGTCTTGTGCC GCGTCCGGGTTCACCTTTTCCCTCTCCGGCATGTCATGGGTTAGACAGGCACCA GGCAAGGGCCTTGAGTGGGTATCTGCCATCTCATCCGGCGGGCCTCTACCTAC TATACCGATTCCGTTAAAGGCCGCTTCACCATTTCTAGGGACAATGCAAAGAAT ATCCTGTACCTCCAGTTGAACAGTCTGAAGACCGAGGATACAGCCATGTACTAT TGTGCAAAAGGGGGCTCCGGCTACGGCGACGCCAGCCGCATGACATCTCCAGGG TCTCAAGGCACCCAAGTGACCGTATCTAGC |

TABLE 1B-continued

| Name | SEQ ID NO: | Sequence |
|---|---|---|
| DR595-hIL27Ra_VH H2 | 1150 | CAGGTCCAGCTGCAAGAAAGCGGTGGGGGCAGCGTACAGGCTGGGGGATCTCTG<br>ACCCTGAGCTGTGCTGCCTCAGAGTACGCATATTCAACCTGCAATATGGGCTGG<br>TATCGCCAAGCCCCCGGAAGGAGCGCGAACTCGTGTCCGCTTTCATCAGTGAC<br>GGGTCCACGTACTATGCCGATTCCGTCAAAGGCCGTTTTACTATCACACGCGAC<br>AACGCCAAGAATACCGTCTACCTCCAGATGAACAGCCTGAAGCCAGAAGATACA<br>GCCATCTATTACTGTAGTGCGAACTGCTACAGACGCCTGCGCAACTACTGGGGA<br>CAGGGCACCCAAGTGACTGTGTCCTCTGGAGGCAGCGGCGGATCTGGAGGGAGT<br>GGACAGGTTCAGCTTCAGGAGAGCGGGGGCGGACTGGTGCAGCCAGGAGGCTCC<br>CTGAGGTTGTCATGCGCGGCCAGCGGTTTCACCTTCAGTTTGTCCGGCATGTCA<br>TGGGTACGCCAAGCGCCCGGTAAGGGTCTGGAATGGGTGTCCGCTATTTCTAGC<br>GGAGGCGCGAGTACCTATTACACCGACAGCGTGAAGGGGCGCTTTACTATCTCT<br>CGTGATAACGCCAAGAACATTCTCTATCTCCAACTTAATTCTCTGAAGACCGAG<br>GACACCGCGATGTATTACTGCGCCAAGGGCGGTTCTGGTTATGGCGACGCTTCC<br>CGCATGACATCTCCGGGTAGTCAGGGCACACAGGTGACTGTGTCTAGC |
| DR595-hIL27Ra_VH H3 | 1151 | CAGGTGCAGCTCCAGGAGTCCGGCGGAGGCAGCGTGCAAGCCGGTGGCTCCCTC<br>ACCCTGTCATGCGCGGCCAGCGAGTACGCCTATAGCACCTGTAACATGGGCTGG<br>TACAGGCAAGCGCCGGGTAAGGAGCGTGAACTCGTCTCTGCCTTTATCTCCGAT<br>GGGTCCACCTATTACGCAGACAGCGTGAAGGGCCGGTTTACGATCACCCGCGAC<br>AACGCCAAAAACACAGTCTATCTCCAGATGAACAGTCTGAAACCCGAGGATACG<br>GCAATTTACTATTGTAGCGCTAACTGCTACCGTAGACTCAGAAACTACTGGGGC<br>CAGGGCACACAGGTGACCGTGAGTTCCGGGGGTGGGTCTCAGGTGCAACTCCAA<br>GAGTCCGGCGGGGGCTCCGTCCAGGCTGGCGGTAGCCTGCGCTTGTCTTGTGTG<br>GCATCTGGATACGTATCTTGCGACTATTTCCTCCCCTCCTGGTATCGTCAAGCT<br>CCGGGAAAAGAGCGGGAGTTCGTGTCCATTATCGACGGGACCGGCTCCACGAGC<br>TATGCTGCCTCTGTGAAGGGAAGATTTACTGCCAGTGAGGACAAGGGTAAGAAT<br>ATCGCTTATCTGCAAATGAATAGTCTGAAGCCGGAAGACACTGCGATGTATTAC<br>TGCAAGGCGAGTTGCGTCAGAGGACGCGCCGTATCCGAATACTGGGGGCAGGGT<br>ACGCAGGTGACGGTCTCATCT |
| DR595-hIL27Ra_VH H3 | 1152 | CAAGTCCAGCTTCAAGAGAGTGGCGGAGGCTCCGTTCAGGCCGGTGGCTCTCTG<br>ACTTTGTCCTGCGCCCGCAAGCGAGTACGCATACTCTACCTGCAATATGGGCTGG<br>TATAGACAAGCGCCTGGCAAGGAGCGCGAGCTGGTATCAGCCTTCATCAGCGAC<br>GGATCTACCTACTATGCGGATTCAGTGAAGGGGAGGTTCACCATCACACGCGAC<br>AACGCGAAGAATACTGTGTACCTTCAGATGAACAGCCTGAAACCCGAGGACACC<br>GCAATCTATTACTGCTCTGCCAACTGTTACAGGCGGCTGCGCAATTACTGGGGC<br>CAAGGAACGCAAGTGACAGTATCCAGCGGCGGGAGTGGCGGTAGTGGCGGATCT<br>GGCCAGGTGCAGCTCCAGGAGAGCGGCGGAGGCTCCGTACAGGCGGGTGGCAGT<br>TTGCGCCTGTCCTGTGTCGCTAGTGGTTACGTGTCCTGCGACTATTTTTTGCCC<br>TCTTGGTATCGGCAGGCTCCTGGGAAGGAACGTGAGTTCGTAAGCATCATTGAT<br>GGGACCGGCTCCACCTCCTACGCTGCCAGCGTCAAGGGGAGATTTACTGCATCC<br>GAAGATAAAGGCAAAAACATTGCTTACCTCCAGATGAACTCCCTCAAACCAGAG<br>GATACCGCCATGTATTACTGCAAGGCCTCCTGTGTGAGGGGCCGCGCCGTGTCT<br>GAGTACTGGGGTCAGGGCACTCAGGTGACTGTCCTCC |
| DR595-hIL27Ra_VH H4 | 1153 | CAGGTGCAGCTTCAGGAATCCGGCGGAGGCAGCGTCCAAGCGGGAGGCAGCCTG<br>ACCCTGTCTTGCGCTGCCAGTGAGTATGCTTACTCCACTTGTAACATGGGCTGG<br>TATCGTCAAGCGCCAGGGAAGGAGCGTGAGCTGGTCTCTGCCTTCATCTCAGAT<br>GGTTCCACCTATTACGCTGACAGTGTCAAGGGCAGGTTCACCATCACTCGGGAT<br>AATGCCAAGAACACCGTGTACCTCCAGATGAACTCCCTGAAGCCTGAAGACACT<br>GCCATCTATTACTGCTCCGCCAACTGCTACCGTCGCCTGAGAAATTACTGGGGT<br>CAGGGAACCCAGGTCACCGTGTCTTCCGGCGGAGGCTCCCAGGTCCAGCTGCAA<br>GAGTCTGGTGGCGGTTTGGTGCAGCCTGGCGAGTCCCTGCGCCTGTCTTGCACC<br>GCGAGCGGCTTCACCTTCAGCAATTACGCTATGAGCTGGGTCCGTCAGGCTCCT<br>GGGAAGGGCCTGGAGTGGGTAAGTGGAATCAACGTGGCCTACGGTATCACGTCC<br>TATGCTGATAGCGTGAAGGGCAGATTTACCATCTCTCGGGACAACACCAAGAAC<br>ACACTGTACCTCCAACTCAACAGCCTGAAGACCGAAGACACGGCTATCTATTAC<br>TGTGTCAAGCACAGTGGCACCACGATCCCCAGAGGCTTTATTAGTTATACTAAA<br>CGGGGTCAGGGGACCCAGGTGACCGTCAGCTCC |
| DR595-hIL27Ra_VH H4 | 1154 | CAAGTTCAGCTTCAGGAAAGCGGCGGAGGCAGCGTCCAGGCCGGTGGAAGTTTG<br>ACGCTGAGCTGTGCGGCTAGTGAATACGCATATTCCACCTGCAATATGGGGTGG<br>TACAGGCAGGCCCCCGGCAAGGAACGCGAACTGGTGAGTGCTTTTATCAGCGAC<br>GGCTCCACGTATTACGCAGATTCCGTGAAAGGAAGGTTTACCATTACCCGCGAT<br>AACGCCAAGAACACTGTGTACCTTCAGATGAACTCTCTCAAACCCGAGGACACT<br>GCCATCTACTATTGCTCAGCCAACTGTTACCGCAGGTTGCGTAACTACTGGGGC<br>CAGGGCACCCAGGTCACAGTCAGCTCCGGCGGGAGTGGTGGATCTGGCGGTTCC<br>GGGCAAGTGCAACTTCAGGAATCCGGCGGGGGCCTGGTGCAGCCTGGGGAGTCC<br>CTGCGCCTTAGCTGTACTGCTTCCGGCTTCACCTTTTCCAACTACGCCATGAGT<br>TGGGTGCGCCAGGCTCCTGGCAAGGGCTTGGAGTGGGTGTCTGGGATTAACGTG<br>GCTTACGGGATTACCTCTTATGCCGACTCAGTCAAGGGTCGTTTCACAATCAGT<br>CGCGACAACACCAAAAACACTCTGTATCTGCAACTGAATAGTCTGAAGACCGAG<br>GATACCGCTATCTATTACTGCGTCAAGCACTCCGGTACTACCATCCCCAGGGGC<br>TTTATTAGTTACACGAAACGGGGTCAGGGGACTCAGGTGACAGTGTCCTCC |

TABLE 1B-continued

| Name | SEQ ID NO: | Sequence |
|---|---|---|
| DR595-hIL27Ra_VH H5 | 1155 | CAGGTGCAGCTGCAAGAATCCGGCGGAGGCTCCGTGCAGGCAGGTGGCAGTCTG<br>ACACTGAGCTGCGCCGCTTCCGAGTATGCCTATTCCACCTGCAACATGGGTTGG<br>TACAGGCAGGCTCCTGGTAAGGAACGCGAATTGGTGTCCGCCTTCATTTCCGAT<br>GGTAGCACCTACTATGCCGACAGTGTAAAGGGGCGGTTCACCATCACTCGGGAC<br>AACGCAAAAAATACCGTGTACCTGCAAATGAACTCCTTGAAGCCAGAGGACACC<br>GCTATCTATTACTGCTCCGCAAACTGCTATCGCAGGCTGAGGAACTATTGGGGC<br>CAGGGCACCCAGGTGACGGTCTCCTCTGGGGGTGGCTCCCAAGTCCAGCTCCAG<br>GAGTCAGGAGGTGGGAGTGTGCAAGCCGGGGAAGCCTGCGTCTCTCCTGTACC<br>GCCAGCGGCTACGTGAGCTGTGACTATTTCCTCCCCTCATGGTATAGACAGGCC<br>CCTGGGAAGGAGAGAGAATTTGTTAGCGTGATCGACGGCACCGGGTCCACCAGT<br>TACGCTGCCAGCGTCAAAGGGCGCTTTACCGCTTCTCAGGACAAGGGGAAGAAC<br>ATTGCCTACCTGCAAATGAACAGCCTGAAACCCGAGGACACTGCAATGTATTAC<br>TGTAAGGCCAGTTGTGTGCGTGGCCGTGCCATTAGCGAATATTGGGGCCAGGGC<br>ACCCAGGTGACCGTGTCTAGT |
| DR595-hIL27Ra_VH H5 | 1156 | CAGGTCCAGCTCCAGGAGAGCGGAGGTGGCAGTGTGCAGGCTGGTGGCTCCCTG<br>ACCCTTAGTTGTGCAGCCAGCGAATATGCTTACTCCACCTGTAACATGGGATGG<br>TATCGTCAGGCTCCGGGCAAGGAGCGGGAGCTTGTGAGCGCATTTATCAGCGAC<br>GGGTCAACCTATTACGCAGATTCCGTGAAAGGGCGCTTCACCATCACCCGTGAC<br>AACGCTAAGAACACCGTCTACCTCCAGATGAACTCACTGAAGCCCGAGGACACT<br>GCTATCTATTACTGTTCTGCCAACTGCTACAGACGCCTCAGGAATTACTGGGGA<br>CAGGGCACGCAGGTCACTGTTAGCTCCGGTGGCAGTGGTGGCAGCGGGGGCAGT<br>GGACAGGTGCAGTTGCAGGAATCCGGTGGCGGGAGTGTTCAGGCAGGCGGATCT<br>CTGCGCCTGAGCTGCACCGCCTCTGGATATGTGAGCTGTGATTACTTCCTGCCT<br>AGCTGGTATCGGCAGGCCCCCGGCAAGGAACGTGAGTTCGTGAGCGTCATCGAC<br>GGCACCGGCTCCACCTCTTACGCAGCCTCTGTGAAGGGCCGCTTCACAGCCAGC<br>CAAGACAAGGGGAAGAATATCGCCTATCTCCAGATGAACAGCCTGAAACCCGAG<br>GATACAGCCATGTATTACTGTAAAGCCAGCTGTGTGCGCGGCAGAGCTATCTCC<br>GAGTACTGGGGCCAGGGCACCCAGGTTACCGTCTCCTCC |
| DR595-hIL27Ra_VH H6 | 1157 | CAGGTCCAACTCCAGGAGAGCGGAGGGGGCTCTGTTCAGGCCGGAGGCTCCCTG<br>ACCCTCTCCTGCGCAGCCAGTGAATATGCTTACTCCACTTGTAACATGGGATGG<br>TATCGTCAAGCCCCTGGTAAAGAACGTGAGCTGGTCTCCGCCTTTATCTCCGAC<br>GGTTCCACTTATTACGCCGATAGTGTCAAGGGCCGCTTTACCATCACGAGGGAC<br>AATGCCAAGAATACCGTCTACCTCCAGATGAACTCTCTGAAGCCTGAGGATACT<br>GCCATCTACTATTGTAGTGCAAACTGCTACCGGAGATTGAGAAATTATTGGGGT<br>CAGGGCACCCAGGTGACAGTGTCCAGCGGTGGCGGGAGTCAAGTGCAGTTGCAG<br>GAGTCTGGTGGCGGACTGGTGCAGCCGGGCGGAAGTCTGCGTTTGTCTTGCGCC<br>GCGAGCGGTTTCAGTTTTAGCAGTTACGCCATGAAATGGGTGCGTCAGGCCCCT<br>GGGAAGGGCCTGGAGTGGGTGAGTACCATCTCCAGCGGTGGCAGCAGTACTAAC<br>TACGCCGACTCTGTGAAAGGCCGCTTCACAATCTCACGTGATAACGCCAAAAAT<br>ACCCTCTACCTTCAGCTCAACTCCCTGAAAATCGAGGACACTGCCATGTACTAT<br>TGTGCTAAGGCCATTGTGCCGACTGGTGCCACTATGGAACGTGGGCAGGGCACT<br>CAGGTGACCGTTTCTTCC |
| DR595-hIL27Ra_VH H6 | 1158 | CAGGTGCAGCTCCAGGAAAGCGGTGGAGGCTCCGTGCAGGCTGGCGGTTCCCTG<br>ACGCTGTCTTGTGCAGCCTCCGAGTACGCCTATAGCACCTGCAACATGGGCTGG<br>TATCGCCAGGCCCCCGGCAAGGAACGTGAACTGGTATCCGCGTTCATCTCTGAT<br>GGCAGTACCTACTATGCGGATTCTGTGAAGGGCCGCTTCACCATCACAAGAGAC<br>AACGCTAAGAACACCGTGTATCTCCAAATGAACTCCCTCAAGCCCGAGGATACA<br>GCAATCTACTATTGCAGCGCTAACTGCTACAGACGCCTGAGGAACTATTGGGGA<br>CAGGGGACCCAGGTGACAGTTTCTAGTGGAGGCAGCGGAGGCAGCGGAGGGTCT<br>GGCCAGGTTCAGTTGCAGGAGAGTGGGGGCGGTTTGGTGCAGCCGGGGGCTCC<br>CTGAGGCTCAGTTGCGCTGCCTCTGGATTCTCCTTCTCCTCTTATGCCATGAAG<br>TGGGTGCGCCAAGCGCCCGGCAAGGGCCTGGAGTGGGTATCTACCATCAGCTCT<br>GGGGGGCTCCAGCACGAATTACGCAGACAGCGTGAAGGGACGCTTTACTATTTCA<br>AGAGATAATGCCAAGAACACTCTGTATCTTCAGCTCAACTCCCTGAAGATCGAG<br>GATACCGCTATGTACTATTGCGCCAAAGCCATCGTCCCACTGGGCAACAATG<br>GAACGCGGCCAAGGAACACAGGTCACCGTCAGTTCT |
| DR595-hIL27Ra_VH H7 | 1159 | CAGGTGCAGTTGCAGGAGAGCGGCGGTGGCTCCGTACAGGCAGGGGGCTCACTG<br>ACCCTGAGCTGTGCAGCTAGTGAGTATGCCTATAGCACTTGCAACATGGGGTGG<br>TATCGTCAGGCCCCTGGCAAGGAGCGCGAGCTTGTGAGCGCGTTCATTAGCGAT<br>GGCTCCACCTACTATGCAGACAGCGTTAAGGGCCGCTTTACCATCACCCGCGAT<br>AACGCTAAAAACACCGTTTACCTCCAGATGAACTCCCTGAAGCCTGAGGATACG<br>GCTATCTATTACTGCTCCGCTAATTGTTATCGCAGGCTGCGTAACTACTGGGGT<br>CAAGGCACCCAGGTGACCGTGTCTTCCGGCGGTGGCTCCCAGGTCCAGCTGCAA<br>GAGTCCGGCGGTGGCCTTGTGCAACCTGGAGGCTCCCTGAGACTTTCCTGCGCT<br>GCCTCCGGCTTCACGTTCAGCTCTTATCCCATGAGCTGGGTGAGACAGGCTCCT<br>GGTAAGGGCCTGGAATGGATTTCCACCATCTCTGCGGGCGGTGACACGACACTC<br>TACGCTGATAGTGTTAAGGGACGTTTCACCTCCTCTCGCGATAACGCGAAGAAC<br>ACCCTGTACCTTCAGCTTAATTCCCTGAAACCGAAGACACCGCTATCTACTAT<br>TGCGCCAAGAGAATTGACTGCAACTCCGGTTACTGTTATCGTCGCAACTACTGG<br>GGCCAGGGCACCCAGGTGACAGTCTCTTCT |

TABLE 1B-continued

| Name | SEQ ID NO: | Sequence |
|---|---|---|
| DR595-hIL27Ra_VH H7 | 1160 | CAGGTCCAGTTGCAGGAGTCTGGCGGGGGCTCAGTGCAAGCCGGGGGCTCCCTG<br>ACTCTGAGCTGCGCTGCCTCTGAGTATGCTTACTCCACGTGCAACATGGGGTGG<br>TATCGCCAGGCCCCCGGAAAGGAACGCGAGCTGGTGTCTGCCTTCATCTCTGAC<br>GGCAGCACATATTACGCTGACTCCGTAAAAGGTAGATTTACCATCACCCGCGAC<br>AATGCGAAAAACACAGTTTATCTCCAGATGAACTCCCTGAAACCGGAGGACACC<br>GCGATCTACTATTGCAGCGCGAATTGTTACCGCCGTCTTCGTAATTACTGGGGG<br>CAGGGAACCCAGGTGACAGTCTCCAGCGGGGGCTCCGGTGGCTCCGGTGGCTCC<br>GGCCAGGTGCAGCTCCAGGAGTCTGGTGGCGGGTTGGTGCAGCCCGGAGGTAGC<br>CTGAGGCTGTCCTGTGCTGCATCTGGTTTTACCTTCAGCAGTTATCCAATGTCT<br>TGGGTACGCCAAGCGCCCGGTAAGGGCTTGGAGTGGATTTCTACAATTAGCGCC<br>GGAGGCGATACTACCCTGTACGCTGACTCTGTGAAGGGTCGTTTCACATCCTCT<br>AGGGATAACGCGAAAAATACACTGTACCTTCAGCTCAATAGTCTGAAGACCGAG<br>GACACCGCAATCTATTACTGTGCAAAACGCATCGACTGTAATAGCGGATACTGC<br>TACAGGCGTAACTACTGGGGCCAGGGAACCCAGGTGACCGTCAGTAGC |
| DR595-hIL27Ra_VH H8 | 1161 | CAGGTACAGTTGCAGGAAAGTGGGGGCGGGTCTGTGCAGGCTGGCGGGTCCTTG<br>ACCCTGTCATGTGCCGCTTCTGAGTACGCCTACTCCACCTGTAACATGGGCTGG<br>TATCGTCAGGCTCCCGGCAAGGAGCGCGAGCTGGTATCCGCCTTCATCTCTGAT<br>GGCAGCACCTATTACGCCGATAGCGTGAAGGGTCGTTTCACTATCACACGGGAC<br>AACGCGAAGAACACAGTGTATTTGCAAATGAACAGCTTGAAGCCCGAAGATACC<br>GCTATCTATTACTGCTCTGCTAACTGTTATCGTCGCCTGCGGAACTACTGGGGG<br>CAGGGGACTCAGGTAACTGTTTCCAGCGGAGGCGGTAGCCAGGTCCAGCTTCAG<br>GAGAGCGGCGGAGGCTCCGTGCAGGTCGGTGGCTCTCCGCCTCTCATGTGCT<br>GCCAGCGGATTTACTTTCAGCTCCTACCCCATGTCATGGGTGCGGCAGGCTCCC<br>GGAAAGGGCCTTGAATGGATTAGCACGATTAGCGCCGGTGGCGACACAACCCTG<br>TACGCCGACTCTGTCAAGGGTCGTTTCACGTCCTCAAGAGACAACGCGAAGAAC<br>ACTCTGTACTTGCAGCTCAATTCTCTGAAGACAGAGGACACCGCCATCTATTAC<br>TGTGCAAAGAGGATTGACTGCAACAGCGGCTATTGCTACAGACGTAACTATTGG<br>GGTCAGGGCACTCAGGTGACTGTGTCCAGT |
| DR595-hIL27Ra_VH H8 | 1162 | CAGGTGCAGCTGCAAGAGTCTGGGGGCGGGTCCGTGCAGGCCGGAGGTAGTCTG<br>ACTCTTTCCTGCGCTGCGTCTGAGTACGCCTACTCCACCTGTAACATGGGATGG<br>TACAGACAGGCCCCTGGCAAAGAGAGAACTGGTGTCCGCTTTTATCAGCGAC<br>GGCAGCACTTACTATGCTGACAGTGTGAAGGGCAGGTTCACCATCACCCGTGAT<br>AACGCCAAGAACACTGTCTACCTTCAGATGAACTCTTTGAAACCAGAGGACACA<br>GCTATCTACTATTGCAGCGCTAACTGCTACAGACGCCTCAGGAACTATTGGGGG<br>CAGGGCACCCAGGTGACCGTTTCTAGTGGAGGTAGCGGAGGCAGCGGTGGAAGC<br>GGCCAGGTGCAGCTCCAGGAGTCCGGTGGCGGGTCCGTCCAGGTCGGCGGGTCT<br>CTCCGCCTGTCCTGCGCTGCCAGCGGGTTCACCTTCTCCAGCTACCCCATGAGC<br>TGGGTCAGGCAGGCCCCTGGCAAGGGCCTCGAATGGATCAGCACTATTTCCGCC<br>GGTGGCGACACAACCCTCTACGCCGACAGCGTCAAGGGACGGTTCACCAGCAGT<br>CGTGACAACGCTAAAAATACCCTGTACCTCCAGCTTAATAGCCTGAAGACCGAA<br>GATACAGCAATCTATTACTGCGCCAAGAGGATCGACTGCAACTCAGGGTACTGT<br>TACCGTCGCAACTACTGGGGACAGGGAACTCAAGTGACTGTGTCTTCC |
| DR595-hIL27Ra_VH H9 | 1163 | CAGGTCCAGTTGCAGGAGTCCGGCGGTGGAAGTGTGCAGGCTGGTGGCAGCCTG<br>ACCTTGTCTTGTGCCGCTAGTGAGTACGCTTATTCAACCTGCAACATGGGCTGG<br>TACAGACAGGCTCCGGGAAAGGAGCGCGAGCTGGTGTCTGCCTTCATCTCCGAT<br>GGTTCAACATACTATGCTGACTCCGTGAAGGGGCGCTTCACCATCACGCGCGAT<br>AATGCAAAGAATACCGTGTACCTTCAAATGAATAGTCTGAAACCCGAGGATACC<br>GCTATCTATTACTGCTCCGCCAACTGCTATCGTCGCCTGCGTAATTACTGGGGC<br>CAGGGCACCCAGGTCACTGTTAGTTCAGGAGGCGGAAGCCAGGTCCAGTTGCAG<br>GAGTCCGGGGGTGGCTCCGTCCAGAGCGGCGGTAGCCTGAGATTGAGTTGCGCG<br>GCCTCAGGCTTCACCTACAGCACCAGCAATAGCTGGATGGCCTGGTTCCGTCAG<br>GCTCCGGGCAAAGAGAGGGAGGGCGTGGCGGCCATCTACACTGTGGGCGGTAGC<br>ATCTTCTACGCGGACAGCGTTCGGGTCGCTTCACTATCAGCAAGACGCTACC<br>AAGAATATGTTCTACCTCCAGATGAACACTCTGAAGCCCGAGGACACCGCCATG<br>TACTATTGCGCTGCCGCTTCTGGCCGCCTGCGCGGTAAGTGGTTTTGGCCCTAT<br>GAGTACAACTATTGGGGTCAAGGAACCCAGGTGACCGTGTCTTCC |
| DR595-hIL27Ra_VH H9 | 1164 | CAGGTCCAGTTGCAGGAGAGCGGTGGCGGATCTGTCCAAGCCGGAGGTAGTCTC<br>ACGCTCAGCTGTGCCGCGAGCGAATACGCCTACTCCACCTGTAATATGGGGTGG<br>TATCGTCAGGCACCAGGCAAAGAGCGCGAACTGGTGTCCGCGTTCATCTCCGAC<br>GGCTCAACGTATTACGCCGATAGCGTAAAGGGCCGGTTTACAATCACCCGCGAC<br>AACGCCAAGAATACCGTCTACCTTCAGATGAACTCCCTGAAGCCAGAGGACACT<br>GCAATTTACTATTGCAGCGCTAACTGTTACCGCCGTCTGCGCAACTACTGGGGA<br>CAAGGAACCCAAGTTACCGTGAGTTCTGGTGGCTCTGGTGGCAGCGGAGGCAGC<br>GGACAAGTTCAGCTTCAGGAGTCTGGAGGTGGCTCAGTACAGTCTGGTGGCTCC<br>CTCCGCCTCAGCTGTGCAGCTTCAGGTTTCACCTACTCCACGTCCAACAGTTGG<br>ATGGCCTGGTTTCGGCAAGCTCCGGGAAAAGAGCGTGAGGGAGTGGCTGCGATC<br>TATACAGTCGGGGGATCTATCTTCTACGCGGACTCCGTCAGAGGCAGGTTCACC<br>ATTTCTCAGGATGCTACTAAAAATATGTTCTATCTTCAGATGAACACGCTGAAG<br>CCAGAGGACACAGCCATGTACTATTGCGCCGCAGCCTCAGGCAGGCTGCGCGGT<br>AAATGGTTTTGGCCTTACGAGTACAACTATTGGGGTCAGGGCACCCAGGTGACC<br>GTGAGTTCT |

TABLE 1B-continued

| Name | SEQ ID NO: | Sequence |
|---|---|---|
| DR595-hIL27Ra_VH H10 | 1165 | CAGGTGCAGTTGCAGGAGTCCGGCGGGGGCTCCGTGCAGGCGGGCGGTAGCCTG<br>ACTCTGTCATGTGCCGCGTCCGAGTACGCTTACTCTACCTGCAACATGGGCTGG<br>TATCGCCAGGCTCCTGGAAAAGAACGCGAACTGGTGAGTGCCTTTATCTCTGAC<br>GGTTCCACTTATTACGCCGATTCCGTGAAGGGGCGCTTTACAATCACTCGCGAT<br>AATGCCAAGAACACAGTGTACCTCCAGATGAACAGCCTGAAACCAGAGGACACC<br>GCTATTTACTATTGCAGCGCGAACTGCTACAGACGCCTCAGGAACTATTGGGGA<br>CAGGGCACCCAGGTGACAGTTTCCAGTGGAGGTGGCTCCCAGGTCCAGTTGCAG<br>GAAAGTGGGGGAGGGTCCGTCCAAGCTGGCGGTTCTCTGCGGCTCTCATGCAGG<br>GCCTCCGGTTCCACTTATAGTAACTATTGCTTGGGCTGGTTCAGGCAGATCACC<br>GGCAAGGAGCGCGAGGGAGTGGCTGTCATCAACTGGGTGGGCGGTATGCTTTAT<br>TTCGCCGACTCCGTGAAGGGCCGTTTTACAGTGTCACAAGACCAGGCCAAAAAT<br>ACTCTGTACCTGCAAATGAACGTTTGAAGCCTGAGGATACCGCGATGTACTAT<br>TGTGCCGCTGAGTCCGTAAGTAGCTTTAGCTGCGGCGGTTGGTTGACCAGACCT<br>GACCGCGTGCCATATTGGGGTCAGGGCACACAGGTGACAGTGAGCAGC |
| DR595-hIL27Ra_VH H10 | 1166 | CAAGTGCAGTTGCAGGAAAGCGGAGGCGGGTCTGTTCAGGCCGGAGGCAGCCTT<br>ACGCTGTCCTGCGCTGCCTCAGAATACGCATACAGTACCTGTAACATGGGCTGG<br>TATCGCCAGGCCCCTGGGAAGGAGAGAGCTGGTGAGTGCCTTCATTTCTGAC<br>GGCTCTACCTACTATGCTGATAGCGTGAAGGGTAGGTTTACAATCACCCGCGAC<br>AACGCCAAAAATACCGTTTACCTTCAGATGAACAGCCTGAAGCCGGAAGACACC<br>GCCATCTATTACTGCTCTGCCAACTGCTATCGCCGTCTGCGCAATTACTGGGC<br>CAGGGCACCCAGGTCACCGTGTCCAGCGGCGGTTCTGGTGGGTCTGGAGGGTCC<br>GGGCAGGTGCAGCTGCAAGAGTCTGGAGGTGGCTCCGTCCAGGCCGGGGGCAGT<br>CTGCGCTTGTCATGTCGGGCCTCTGGTTCCACTTACTCCAACTACTGCTTGGGA<br>TGGTTCCGGCAGATTACAGGCAAGGAACGCGAGGGAGTCGCAGTCATCAACTGG<br>GTGGGCGGAATGCTTTACTTTGCCGATTCCGTCAAGGGCAGGTTCACTGTGAGC<br>CAGGATCAGGCTAAGAACACACTGTACCTTCAGATGAATAGCCTGAAGCCCGAG<br>GACACTGCTATGTATTACTGTGCTGCCGAAAGCGTGTCCTCATTCTCCTGCGGA<br>GGCTGGCTGACCCGCCCTGATCGGGTGCCGTACTGGGGTCAAGGCACTCAAGTG<br>ACTGTCTCATCT |
| DR595-hIL27Ra_VH H11 | 1167 | CAAGTACAGTTGCAGGAGAGCGGTGGCGGTTCAGTGCAGGCCGGGGGAAGTCTG<br>ACCCTGAGTTGCGCGGCCAGCGAGTATGCCTACAGTACCTGTAACATGGGCTGG<br>TATCGCCAAGCACCTGGCAAGGAACGTGAGCTGGTTTCAGCGTTCATCTCCGAC<br>GGCTCCACCTATTACGCTGACAGCGTGAAGGGTAGGTTCACTATTACTCGGGAC<br>AACGCGAAGAATACCGTATACTTGCAGATGAACTCACTGAAGCCTGAGGACACC<br>GCCATCTATTACTGCTCCGCCAACTGCTACCGTCGCCTTCGTAATTATTGGGGG<br>CAGGGAACCCAGGTCACTGTCAGCTCTGGAGGCGGTTCACAAGTACAGTTGCAG<br>GAGTCTGGTGGGGGTAGCGTCCAGGCCGGGGAAGCCTTCGCCTTTCTTGCCGC<br>GCCAGCGGCTCCACCTACTCAAATTACTGCCTCGGATGGTTTCGCCAGTCTACC<br>GGAAAGGAACGCGAGGGTGTCGCAGTGATAAATTGGGTCGGCGGTATGCTGTAC<br>TTCGCGGATTCTGTGAAGGGCAGGTTCACAGTTTCCCAGGATCACGCCAAGAAC<br>ACCGTGACCCTCCAGATGAACTCCCTGAAGCCGGAAGATACCGCAATGTATTAC<br>TGTGCCGCTGAGTCTGTGTCATCTTTTTCTTGCGGTGGATGGTTGACTCGCCCC<br>GGTCGCGTGCCTTATTGGGGCCAAGGCACACAAGTGACAGTGTCTAGC |
| DR595-hIL27Ra_VH H11 | 1168 | CAGGTGCAGTTGCAGGAAAGCGGTGGAGGGTCCGTGCAGGCCGGGGGCTCTCTG<br>ACACTGTCTTGTGCCGCTAGTGAGTACGCATACAGCACATGCAACATGGGCTGG<br>TATCGTCAAGCTCCGGGTAAGGAGCGTGAGCTTGTCTCCGCATTCATCAGTGAC<br>GGCTCAACCTATTACGCGGACAGCGTGAAGGGAAGATTTACCATCACCCGCGAT<br>AACGCCAAGAACACTGTCTACCTCCAGATGAACAGCCTGAAACCTGAGGATACT<br>GCTATTTACTATTGCAGTGCAAACTGTTACCGTCGCCTTCGCAACTATTGGGC<br>CAGGGCACACAAGTGACTGTGAGTTCAGGTGGCTCCGGTGGCTCAGGTGGCTCC<br>GGTCAGGTCCAGCTCCAGGAGTCCGGCGGAGGCTCCGTGCAGGCAGGGGCTCT<br>CTGAGGCTGTCCTGTAGGGCATCCGGTTCCACCTATAGTAACTACTGCCTGGGC<br>TGGTTCCGCCAGAGCACCGGAAAGGAACGCGAGGGCGTGGCCGTCATCAACTGG<br>GTCGGGGGCATGTTGTACTTCGCGGACTCTGTGAAGGGCCGCTTCACCGTGTCC<br>CAAGATCACGCCAAAAACACTGTGACTCTCCAGATGAATAGCCTCAAGCCCGAA<br>GATACGGCGATGTACTATTGCGCAGCCGAGTCCGTGAGTTCCTTCTCATGCGGT<br>GGCTGGCTGACCCGCCCCGGTCGCGTGCCTTACTGGGGCCAGGGTACTCAGGTG<br>ACCGTCTCCTCC |
| DR595-hIL27Ra_VH H12 | 1169 | CAGGTGCAGTTGCAGGAGTCCGGCGGTGGGAGCGTACAGGCTGGCGGTTCTCTG<br>ACACTTTCCTGCGCAGCCAGCGAGTACGCCTACTCCACCTGCAACATGGGGTGG<br>TATCGCCAAGCGCCTGGAAAGGAGCGCGAGCTGGTTAGCGCCTTCATCAGTGAT<br>GGCTCCACATATTACGCGGACAGCGTGAAGGGACGCTTCACCATCACCCGTGAC<br>AACGCGAAAAACACAGTCTACTTGCAGATGAACTCCCTCAAGCCTGAGGATACA<br>GCCATCTACTATTGCTCCGCCAACTGCTATAGGAGATTGCGCAACTACTGGGGG<br>CAAGGAACGCAGGTCACCGTCTCCTCTGGGGGAGGCAGCCAAGTGCAACTCCAG<br>GAGAGCGGGGTGGCAGCGTGCAGGCGGGTGAGTCTCTCAGACTGTCTTGCCGC<br>GCGTCTGGCTCTACATATTCTAACTATTGCCTGGGTTGGTTCCGGCAGATTACT<br>GGCAAGGAGCGCGAGGGTGTTGCTGTGATTAACTGGGTGGGCGGTATGCTGTAC<br>TTCGCCGATTCCGTCAAGGGACGTTTCACCGTTAGCCAGGACCAGGCCAAAAAC<br>ACCGTCTACCTGGAGATGAATAGCTTGAAGCCCGAAGATACCGCGATGTATTAC<br>TGCGCCACCGAGAGTGTCTCATCTTTTTCCTGTGGGGTTGGCTTACTCGCCCA<br>GACAGGGTGCCATACTGGGGACAGGGCACTCAGGTGACTGTAAGCAGC |

TABLE 1B-continued

| Name | SEQ ID NO: | Sequence |
|---|---|---|
| DR595-hIL27Ra_VH H12 | 1170 | CAGGTTCAGTTGCAGGAGAGTGGCGGAGGCAGCGTTCAGGCCGGAGGCTCTCTG<br>ACCCTGTCATGCGCGGCCAGCGAGTACGCCTACAGCACCTGCAACATGGGATGG<br>TATCGCCAGGCACCCGGTAAGGAGAGAGAACTGGTGTCCGCCTTCATCTCTGAC<br>GGCTCCACTTACTATGCTGATAGCGTGAAGGGTCGCTTTACCATCACGCGCGAT<br>AACGCAAAAAATACCGTGTATTTGCAGATGAACTCTCTCAAGCCCGAGGATACC<br>GCCATTTATTACTGTAGCGCTAACTGTTACCGTCGCCTGCGCAACTATTGGGGC<br>CAGGGCACCCAGGTTACTGTCAGCTCCGGTGGCTCCGGCGGTTCTGGGGGCTCC<br>GGCCAGGTGCAGCTCCAGGAGTCTGGTGGAGGCTCCGTGCAGGCAGGTGAGTCC<br>TTGCGTCTGTCCTGCCGGGCCAGCGGTTCAACATATTCTAACTACTGCCTGGGG<br>TGGTTCCGCCAGATTACCGGCAAAGAGCGCGAGGGTGTCGCAGTCATCAACTGG<br>GTCGGAGGTATGCTGTACTTCGCCGATTCTGTGAAGGGACGTTTCACCGTGTCC<br>CAGGACCAGGCCAAGAACACAGTATATCTGGAGATGAACTCCCTGAAGCCTGAA<br>GATACAGCCATGTATTACTGCGCCACGGAGTCCGTCAGCTCCTTCTCCTGTGGC<br>GGATGGTTGACCAGGCCCGACAGGGTGCCTTATTGGGGTCAGGGCACCCAAGTC<br>ACCGTGAGCAGC |
| DR595-hIL27Ra_VH H13 | 1171 | CAGGTGCAGCTCCAGGAGTCCGGCGGTGGCTCTGTGCAGGCGGGCGGTAGCCTT<br>ACTCTCAGCTGTGCTGCGTCTGAATACGCTTATTCTACCTGTAATATGGGCTGG<br>TATCGGCAGGCCCCTGGCAAGGAGAGAGAACTCGTGAGCGCCTTCATCTCCGAC<br>GGCTCTACCTACTATGCCGACAGTGTGAAGGGCCGCTTCACTATTACTCGCGAT<br>AACGCTAAGAACACGGTGTACCTCCAGATGAACTCTCTGAAGCCGGAGGACACG<br>GCCATTTATTACTGCTCCGTAACTGCTACAGACGGCTGCGTAACTACTGGGGC<br>CAGGGCACCCAGGTAACCGTCAGCTCCGGCGGAGGTTCTCAGGTTCAGCTCCAA<br>GAGTCTGGGGGCGGGAGCGTCCAGGCCGGAGGGTCCCTCAGGTTGTCCTGCGTG<br>GCCAGCGGATATGTGTCTTGTGACTACTTCCTGCCCAGCTGGATCGCCAGGCT<br>CCAGGGAAGGAACGTGAGTTTGTTTCCATCATTGATGGTACAGGCAGCACATCC<br>TACGCCGCATCTGTGAAGGGCCGGTTCACTGCCAGCCAGGACCGTGGCAAAAAC<br>ATCGCTTACTTGCAGATGAACTCCCTGAAGCCCGAGGATACCGCAATGTACTAT<br>TGCAAGGCGAGCTGTGTGCGTGGCAGAACCATTAGCGAATACTGGGGACAGGGC<br>ACGCAGGTGACCGTCTCCTCC |
| DR595-hIL27Ra_VH H13 | 1172 | CAGGTCCAACTCCAGGAGTCTGGCGGAGGTTCCGTTCAGGCCGGTGGGTCCCTT<br>ACCCTGAGTTGCGCCGCTTCAGAATACGCCTACTCAACCTGTAACATGGGCTGG<br>TATCGCCAAGCTCCTGGTAAGGAAAGAGAGTTGGTGTCCGCCTTCATCTCTGAT<br>GGTTCCTACCTATTACGCGGACTCTGTGAAGGGCAGATTTACCATCACAAGAGAC<br>AACGCCAAGAATACCGTGTACCTCCAGATGAACTCTCTGAAGCCTGAGGATACT<br>GCCATCTATTACTGTTCAGCAAACTGCTACCGTCGCCTGCGCAATTACTGGGGG<br>CAGGGCACCCAGGTGACAGTATCCAGCGGTGGCAGTGGAGGCTCCGGTGGCTCT<br>GGCCAAGTGCAGCTCCAGGAGTCCGGGGGCGGTTCAGTGCAGGCCGGGGGCTCC<br>CTGCGGCTGTCCTGTGTCGCGTCTGGATACGTGAGTTGCGACTACTTTCTCCCC<br>TCCTGGTATCGCCAGGCTCCAGGAAAGGAGCGCGAGTTTGTCAGCATCATTGAT<br>GGCACCGGGAGTACCAGTTATGCGGCTTCTGTTAAGGGCCGTTTCACCGCTTCT<br>CAGGATCGCGGAAAGAACATCGCCTATTTGCAGATGAACTCTCTGAAGCCGGAA<br>GACACAGCCATGTATTACTGCAAAGCCAGTTGTGTCAGGGGACGGACCATCTCT<br>GAGTATTGGGGACAGGGTACGCAGGTCACTGTGAGTTCC |
| DR595-hIL27Ra_VH H14 | 1173 | CAGGTGCAGCTTCAGGAGTCTGGAGGCGGATCTGTCCAGGCCGGGGGCAGTCTG<br>ACCCTGTCCTGCGCCGCTTCTGAGTATGCCTATAGTACTTGCAACATGGGTTGG<br>TATCGGCAGGCTCCGGGCAAGGAGCGCGAACTGGTTTCAGCGTTCATCTCTGAC<br>GGTAGCACCTACTATGCCGACAGCGTGAAGGGCCGCTTTACTATCACCAGGGAT<br>AACGCAAAGAACACCGTTTACCTCCAGATGAATAGCCTCAAGCCTGAGGATACC<br>GCTATCTATTACTGCTCAGCTAACTGTTATCGTCGGCTGCGTAACTACTGGGGC<br>CAGGGAACTCAAGTTACCGTCAGCAGTGGGGAGGCAGTCAGGTGCAGTTGCAG<br>GAAAGCGGCGGGGCAGCGTCCAGGCTGGTGGAAGCCTTCGTCTCTCTTGTGTC<br>GCCAGTGGCTATGTCTCCTGTGATTATTTTCTGCCGTCCTGGTATCGTCAAGCG<br>CCTGGCAAGGAAAGGGAGTTCGTATCCATTATCGACGAACTGGTAGTACCAGC<br>TACGCTGCCTCCGTGAAGGGAAGGTTCACAGCCTCCCAGGATAAGGGTAAGAAC<br>ATTGCCTACCTCCAGATGAACTCCCTGAAGCCTGAAGATACGGCCATGTACTAT<br>TGCAAAGCCTCTTGTGTCAGGGGCAGAGCCATCAGCGAATACTGGGGCAAGGC<br>ACTCAGGTCACCGTGAGCAGC |
| DR595-hIL27Ra_VH H14 | 1174 | CAGGTTCAGCTCCAGGAGTCTGGGGCGGTTCTGTCCAGGCCGGAGGCAGCCTT<br>ACACTGTCTTGCGCTGCCAGCGAGTATGCTTACTCTACCTGCAACATGGGTTGG<br>TATCGGCAAGCGCCGGGCAAGGAACGGGAACTCGTCTCTGCTTTCATCTCCGAT<br>GGCAGCACATATTACGCTGATAGCGTAAAGGGCCGGTTCACCATCACAAGAGAC<br>AACGCAAAGAACACAGTTTACCTCCAGATGAACTCCCTCAAACCTGAGGATACC<br>GCCATCTATTACTGCTCCGCTAACTGCTACCGCCGTCTGCGCAACTACTGGGGT<br>CAAGGCACCCAGGTTACCGTGTCTAGCGGGGGCTCTGGTGGCAGTGGTGGGTCA<br>GGGCAGGTCCAGCTCCAGGAGAGCGGCGGAGGTAGCGTACAGGCCGGGGGTTCA<br>CTGAGACTGTCTTGTGTGGCCTCTGGATACGTCTCTTGCGATTACTTCCTTCCC<br>AGTTGGTATAGGCAAGCGCCCGGTAAGGAGAGAGAGTTCGTTAGCATCATTGAT<br>GGCACAGGTTCAACAAGTTATGCGGCTTCCGTAAAGGGACGCTTTACTGCGTCT<br>CAGGACAAGGGCAAAAACATCGCCTATCTTCAAATGAACAGTCTGAAGCCTGAA<br>GATACCGCTATGTATTACTGCAAAGCCTCCTGCGTGCGGGTCGCGCTATCAGC<br>GAATACTGGGGCCAGGGTACGCAAGTGACTGTCAGTTCT |

TABLE 1B-continued

| Name | SEQ ID NO: | Sequence |
|---|---|---|
| DR595-hIL27Ra_VH H15 | 1175 | CAGGTTCAACTCCAGGAATCAGGAGGCGGTTCAGTGCAGGCTGGCGGTAGCCTG ACCCTCAGCTGCGCTGCGAGTGAGTATGCTTATTCCACCTGCAACATGGGGTGG TATCGCCAAGCGCCTGGCAAGGAGAGAGAGCTGGTCAGTGCATTTATTTCCGAT GGCTCCACCTACTATGCTGACTCAGTGAAGGGGCGCTTCACCATCACTCGCGAC AACGCCAAGAATACTGTCTATCTCCAGATGAACAGCCTCAAACCAGAGGATACA GCCATCTACTATTGCAGTGCGAATTGTTATCGTAGGCTGCGCAACTACTGGGGC CAAGGCACACAGGTGACCGTGTCTAGTGGAGGTGGCTCTCAGGTCCAGCTCCAG GAATCTGGTGGAGGCTCCGTCCAGGCTGGCGGTTCCCTTCGTCTGTCCTGCGTG GCCAGCGGCTACGTGAGCTGTGATTATTTCCTCCCTAGCTGGTATCGGCAGGCT CCCGGCAAGGAACGCGAGTTCGTTTCTATCATTGATGGAACGGGTTCTACTAGC TACGCGGCCTCCGTGAAGGGGCGCTTCACAGCAAGCCAGGACAAAGGGAAGAAC ATCGCTTACCTGCAAATGAATACCTTGAAGCCTGAGGACACCGCAATGTATTAC TGCAAGGCTTCCTGCGTGAGGGGCCGCGCCATCTCCGAATACTGGGGGCAGGGT ACTCAGGTGACCGTTAGCAGT |
| DR595-hIL27Ra_VH H15 | 1176 | CAGGTCCAGCTCCAGGAGTCCGGGGGCGGATCAGTCCAGGCTGGCGGGAGTCTG ACACTGTCCTGTGCTGCCTCTGAGTATGCTTACAGCACCTGTAACATGGGCTGG TACAGACAAGCCCCTGGGAAGGAGCGCGAACTCGTGTCCGCGTTTATTAGTGAC GGTTCCACCTACTATGCTGACTCCGTGAAGGGTCGCTTCACGATCACCCGCGAC AACGCCAAAATACCGTGTACTTGCAGATGAACTCCCTGAAGCCGGAGGACACA GCCATCTATTACTGTAGCGCAAATTGCTACCGTCGCCTGCGTAACTATTGGGGT CAGGGCACTCAGGTCACAGTCAGTAGCGGCGGTAGCGGTGGCTCCGGCGGTAGT GGACAGGTGCAGTTGCAGGAATCCGGCGGTGGAAGTGTTCAAGCAGGGGGCTCT CTGCGCCTGTCATGTGTTGCATCAGGCTATGTCTCTTGCGACTACTTCCTGCCA TCTTGGTATCGTCAGGCCCCAGGGAAGGAAAGGGAGTTCGTCTCCATCATTGAT GGCACCGGCTCAACCTCTTACGCTGCCAGCGTAAAGGGGCGCTTCACCGCCTCC CAGGATAAGGGCAAGAACATCGCTTACCTCCAGATGAACACACTCAAGCCTGAG GATACCGCGATGTATTACTGTAAGGCGAGTTGCGTTCGTGGCCGTGCGATCAGC GAGTATTGGGGGCAGGGAACCCAGGTAACAGTCAGCTCC |
| DR595-hIL27Ra_VH H16 | 1177 | CAAGTGCAGCTCCAGGAGTCCGGGGGCGGTAGCGTGCAGGCCGGTGGCTCCCTC ACTCTGTCCTGCGCTGCCAGCGAGTATGCGTACTCCACCTGCAACATGGGGATGG TACAGGCAAGCGCCTGGCAAGGAAAGAGAGCTTGTGAGCGCCTTCATCTCCGAT GGTTCCTACCTACTATGCTGACTCCGTTAAGGGCCGGTTCACCATTACTCGCGAT AACGCCAAGAACACCGTGTATCTCCAGATGAACTCCCTCAAGCCAGAGGACACA GCTATCTACTATTGCTCAGCTAACTGTTACCGTCGCCTCCGCAACTATTGGGGC CAGGGCACTCAGGTGACTGTCTCTTCCGGGGGTGGCTCCCAAGTGCAGCTCCAG GAGTCAGGAGGCGGGTCTGTCCAGGCGGTGGCTCCCTGCGCCTCAGCTGCCGT GCGTCTGGCCAGCACCTACAGCAACTACTGTTTGGGCTGGTTCAGACAGATTACT GGAAAAGAACGCGAGGGCGTTGCGGTCATCAACTGGGTGGGCGGGATGCTTTAC TTTGCAGACAGTGTGAAGGGTCGCTTTACCGTCAGCCAGGACCAGGCCAAGAAC ACAGTGTATTTGCAGATGAATAGCCTGAAGCCAGAGGACACTGCCATGTATTAC TGCGCGGCTGAGTCAGCCAGCTCTTTCAGTTGCGGTGGCTGGTTGACGCGCCCT GACCGCGTTCCTTACTGGGGGCAGGGGACTCAGGTTACCGTGAGCAGC |
| DR595-hIL27Ra_VH H16 | 1178 | CAGGTGCAGCTTCAGGAATCAGGGGGTGGAAGCGTGCAGGCAGGAGGCTCTCTG ACTTTGTCATGTGCCGCTAGTGAGTATGCGTATTCTACGTGCAACATGGGCTGG TATCGTCAAGCCCCCGGAAAAGAGCGTGAACTCGTGTCAGCTTTCATTTCCGAC GGTAGCACATATTACGCCGACAGCGTGAAGGGGCGCTTTACTATCACTCGCGAT AATGCCAAGAATACAGTTTACCTCCAGATGAACTCACTGAAGCCCAAGACACC GCCATCTACTATTGTAGCGCCAACTGTTATAGGAGACTGCGGAACTACTGGGGT CAAGGCACCCAGGTGACCGTGTCCTCTGGAGGCTCTGGAGGCTCCGGCGGTAGC GGACAGGTGCAGTTGCAGGAGTCCGGTGGCGGGTCAGTGCAGGCCGGGGGCTCA CTCAGGCTTTCCTGCCGCGCCAGTGGTTCCACTTATTCCAACTATTGCCTGGGC TGGTTCAGGCAGATCACAGGTAAGGAACGTGAGGGGGTGGCTGTGATTAACTGG GTCGGCGGGATGCTGTATTTTGCCGACAGTGTGAAAGGGAGATTCACCGTCAGC CAGGATCAGGCCAAAAACACCGTGTACCTGCAAATGAACAGTCTGAAGCCAGAG GATACCGCCATGTATTACTGTGCAGCGGAGAGCGCCTCCAGCTTTTCCTGCGGA GGTTGGCTCACTCGGCCTGACCGCGTTCCCTACTGGGGTCAAGGGACCCAGGTG ACAGTCTCCTCC |
| DR595-hIL27Ra_VH H17 | 1179 | CAGGTCCAACTCCAAGAAAGCGGTGGCGGTTCCGTCCAGGCCGGAGGCTCCCTG ACCCTGTCCTGTGCTGCAAGTGAGTACGCCTATTCCACCTGTAATATGGGTTGG TATAGGCAGGCACCAGGAAAAGAGCGCGAACTGGTGTCCGCGTTCATCTCCGAC GGCTCCACTTACTATGCTGATAGTGTTAAAGGCCGCTTCACCATCACCCGTGAT AACGCGAAGAACACTGTGTACTTGCAGATGAACAGCCTGAAGCCCGAGGATACA GCCATCTACTATTGCTCTGCCAACTGCTATAGAAGGCTGCGGAACTACTGGGGT CAGGGAACCCAGGTGACCGTGAGTTCCGGCGGGGTTCCCAGGTCCAGCTCCAG GAATCTGGCGGGGTCTGGTGCAGCCTGGAGGTTCACTCAGATTGTCTTGCGCC GCGTCTGGCTTCACATTCTCCCTCTCCGGGATGAGTTGGGTCCGCCAAGCCCCC GGCAAGGGTCTGGAGTGGGTATCCGCCATCAGTTCCGGCGGAGCCTCAACCTAC TATACGGACTCCGTGAAGGGACGTTTTACCATCAGCCGGGACAACGCTAAGAAC ATGCTGTACCTCCAGCTGAACTCTCTGAAGACTGAAGACACCGCCATGTATTAC TGTGCCAAGGGTGCTCCGGGTACGGGGATGCCAGCCGCATGACCTCTCCTGGT AGCCAGGGCACGCAGGTCACAGTGTCTTCT |

TABLE 1B-continued

| Name | SEQ ID NO: | Sequence |
| --- | --- | --- |
| DR595-hIL27Ra_VH H17 | 1180 | CAGGTACAGCTTCAGGAATCTGGAGGCGGAAGCGTGCAGGCTGGTGGCTCTCTG<br>ACACTGTCTTGCGCCGCGAGCGAATACGCATACAGTACGTGTAATATGGGTTGG<br>TACAGGCAAGCTCCGGGCAAGGAAAGAGAACTCGTAAGCGCCTTCATCAGCGAT<br>GGCTCCACTTATTACGCAGACAGCGTGAAGGGCCGCTTCACTATCACGAGGGAT<br>AACGCCAAGAACACTGTCTATCTCCAGATGAACTCCCTCAAACCTGAAGACACC<br>GCCATTTATTACTGCTGCTAATTGTTACCGCCGTCTGCGCAATTATTGGGGA<br>CAGGGCACCCAGGTAACAGTGTCCTCTGGAGGGAGCGGTGGATCTGGAGGCTCC<br>GGCCAAGTCCAGTTGCAGGAAAGCGGAGGCGGGTTGGTGCAGCCTGGTGGCAGC<br>CTGCGCCTGTCTTGCGCGGCCTCTGGCTTCACATTCTCCCTGTCTGGAATGTCT<br>TGGGTTCCGGCAGGCCCCAGGTAAGGGCCTGGAGTGGGTGAGCGCAATTTCCTCT<br>GGCGGGGCATCCACCTATTACACCGACTCCGTGAAGGGCAGGTTCACTATTAGC<br>CGGGATAATGCGAAGAACATGCTGTACCTTCAGCTGAACTCCTTGAAGACTGAG<br>GACACCGCTATGTATTACTGTGCCAAGGGCGGTAGCGGCTACGGTGACGCTTCC<br>CGCATGACCTCTCCGGGTTCCCAGGGCACCCAGGTGACCGTGTCTTCC |
| DR595-hIL27Ra_VH H18 | 1181 | CAGGTCCAGTTGCAGGAATCCGGCGGGGGTTCCGTCCAAGCAGGCGGTTCCCTT<br>ACACTCAGCTGCGCTGCCAGCGAGTACGCCTATTCTACGTGTAACATGGGCTGG<br>TATCGCCAGGCTCCTGGGAAGGAACGCGAGCTGGTGAGCGCATTTATCTCAGAT<br>GGGTCCACATACTATGCTGACTCTGTTAAGGGTCGTTTCACTATCACCAGGGAC<br>AACGCTAAGAACACTGTCTATCTGCAAATGAACTCCCTGAAACCAGAGGACACC<br>GCTATCTATTACTGCTCTGCCAACTGTTATCGTCGGTTGCGCAATTATTGGGGG<br>CAGGGGACACAGGTGACCGTGTCCTCAGGTGGAGGCTCCCAGGTGCAGTTGCAG<br>GAATCTGGGGGAGGCTCCGTGCAGGCTGGCGGTTCACTGAGGCTGAGTTGTGTT<br>GCATCTGGCTATGTAAGTTGTGATTACTTCTTGCCAAGCTGGTATCGTCAGGCC<br>CCAGGGAAGGAACGCGAGTTCGTCTCTATTATCGACGGCACGGGTTCTACCAGC<br>TACGCTGCCAGCGTTAAGGGGCGGTTTACGGCATCCCAGGACAAGGGAAAGAAC<br>ATCGCTTATTTGCAGATGAACTCCCTGAAACCCGAGGATACTGCGATGTATTAC<br>TGCAAGGCCAGCTGTGTAAGGGGGCGCGGCATCAGCGAATATTGGGGCCAGGGA<br>ACTCAGGTGACCGTGTCCTCT |
| DR595-hIL27Ra_VH H18 | 1182 | CAGGTGCAGCTCCAGGAAAGCGGCGGGGGCTCCGTGCAGGCTGGGGGCAGCTTG<br>ACACTGTCCTGTGCAGCTTCCGAGTACGCCTACTCAACCTGCAACATGGGCTGG<br>TACAGGCAGGCTCCCGGTAAGGAGCGCGAACTGGTGTCCGCCTTCATTTCTGAC<br>AACGCCAAGAACACTGTCTACTTGCAGATGAACAGTTTGAAGCCCGAAGACACT<br>GCTATCTACTATTGCAGCGCCAACTGTTACAGGCGTCTGCGCAACTATTGGGGT<br>CAGGGCACCCAAGTGACTGTGTCTTCCGGTGGGTCCGGTGGCTCCGGGGGCTCC<br>GGCCAGGTGCAGCTGCAAGAGTCCGGCGGTGGCTCCGTACAGGCCGGGGGCAGC<br>CTCAGACTGTCTTGCGTAGCCTCCGGCTACGTTTCTTGCGACTACTTTCTTCCT<br>TCTTGGTACAGACAAGCTCCAGGGAAGGAACGGGAGTTCGTGAGCATTATCGAC<br>GGCACCGGGTCAACCTCTTACGCGGCCTCCGTGAAGGGCCGTTTTACCGCCAGC<br>CAAGACAAGGGCAAAAACATCGCGTATCTTCAGATGAACTCCCTTAAACCTGAG<br>GACACCGCGATGTACTATTGCAAGGCTTCTTGCGTTCGCGGGCGCGGGATCAGC<br>GAGTATTGGGGCCAGGGCACCCAGGTGACCGTGTCTTCT |
| DR595-hIL27Ra_VH H19 | 1183 | CAGGTGCAGTTGCAGGAGTCTGGCGGGGGCTCCGTTCAAGCGGGCGGATCTCTC<br>ACCCTGTCATGTGCCGCTTCTGAGTATGCCTATTCCACTTGCAACATGGGGTGG<br>TATCGCCAGGCACCGGGCAAGGAACGCGAACTCGTGTCTGCCTTCATCTCTGAT<br>GGCTCCACCTATTACGCAGATTCCGTCAAGGGCAGATTTACCATTACCAGAGAC<br>AACGCTAAGAACACCGTTTACCTCCAGATGAACTCCCTGAAACCTGAGGATACA<br>GCCATTTATTACTGTTCCGCCAACTGCTATAGACGCCTGCGGAACTATTGGGGA<br>CAAGGCACGCAGGTTACTGTGTCCTCTGGGGGCGGATCTCAGGTGCAGCTTCAG<br>GAGAGCGGTGGCGGGTCTGTCCAGGCTGGAGGGAGCTTGAGACTGTCCTGTCGT<br>GCGTCCGGGTCAACCTATTCCAACTATTGCCTGGGTTGGTTTCGCCAGATCACT<br>GGTAAGGAGCGTGAGGGGGTCGCTGTTATCAACTGGGTGGTGGGATGCTGTAT<br>TTCGCTGATTCAGTAAAGGGCCGCTTCACCGTCTCCCAGGACCAGGCGAAGAAC<br>ACCGTGTATCTTCAGATGAACAGCCTCAAGCCTGAGGACACCGCAATGTATTAC<br>TGCGCAGCTGAGTCTGTTTCCAGCTTCAGTTGCGGTGGATGGCTTACACGCCCA<br>GATCGCGTGCCATACTGGGGTCAGGGTACGCAAGTTACCGTCTCCTCC |
| DR595-hIL27Ra_VH H19 | 1184 | CAGGTGCAGCTCCAGGAGTCCGGTGGCGGTTCCGTCCAGGCTGGTGGCTCTCTG<br>ACGTTGAGTTGCGCGGCCAGCGAGTACGCTTACTCAACGTGCAACATGGGGTGG<br>TATCGCCAAGCGCCAGGGAAAGAGCGCGAACTCGTAAGTGCCTTTATTTCCGAT<br>GGAAGCACCTATTACGCAGACAGTGTGAAGGGCGCTTTACTATTACCCGTGAC<br>AACGCCAAAAACACCGTCTACCTGCAAATGAACTCCCTGAAACCGGAGGACACC<br>GCCATTTATTACTGTTCCGCCAACTGCTATCGCCGTCTGCGCAATTATTGGGGC<br>CAGGGGACCCAGGTGACAGTGAGTTCTGGCGGGAGCGGCGGGAGCGGAGGGAGC<br>GGGCAGGTCCAGCTTCAGGAGAGCGGGGAGGCAGCGTGCAGGCTGGGGGTAGC<br>CTGCGCTTGTCTTGCAGAGCTCCGGTTCCACATACAGTAACTATTGCCTGGGA<br>TGGTTCCGCCAGATTACCGGCAAGGAACGGGAAGGAGTCGCGGTCATCAACTGG<br>GTCGGTGGAATGCTGTATTTTGCTGACTCTGTCAAAGGCCGCTTTACAGTGTCC<br>CAGGATCAGGCTAAGAATACTGTCTATCTCCAGATGAACAGCCTGAAGCCTGAA<br>GACACAGCCATGTATTACTGTGCCGCAGAGTCCGTCAGCTCCTTCTCCTGCGGT<br>GGGTGGCTTACCAGGCCTGATCGCGTTCCTTACTGGGGTCAGGGTACACAGGTG<br>ACGGTGTCCAGT |

TABLE 1B-continued

| Name | SEQ ID NO: | Sequence |
|---|---|---|
| DR595-hIL27Ra_VH H20 | 1185 | CAGGTACAGCTCCAGGAGAGCGGCGGAGGTTCCGTGCAGGCCGGTGGCAGTCTC<br>ACCCTGTCCTGCGCTGCCTCTGAGTATGCGTATTCTACCTGTAATATGGGCTGG<br>TACAGGCAGGCTCCAGGCAAAGAGAGAGAACTCGTGTCTGCTTTCATCTCTGAC<br>GGTAGTACCTATTACGCGGACAGCGTTAAAGGCAGGTTCACCATCACCAGAGAC<br>AACGCCAAAAACACAGTTTACCTCCAGATGAACTCCCTCAAGCCCGAGGACACC<br>GCAATTTACTATTGTTCCGCTAACTGCTATCGCAGACTGCGTAACTATTGGGGT<br>CAGGGTACTCAGGTTACCGTGTCTAGCGGCGGGGGCAGTCAGGTTCAGCTTCAG<br>GAAAGTGGCGGTGGACTTGTGCAGCCCGGAGGGTCTCTTCGCCTTTCATGTGCT<br>GCCAGCGGCTTCACCTTTTCCAGTTACCCAATGTCCTGGGTCAGACAGGCCCCT<br>GGCAAGGGGCTGGAGTGGGTCAGCACCATCTCTTCCGGCGGTGATACAACCTTG<br>TACGCAGACTCTGTTAAGGGCAGGTTCACATCCAGCCGGGACAATGCTAAGAAT<br>ACCCTCTATCTGCAACTCAACAGCCTGAAGACCGAGGACACCGCAATGTACTAT<br>TGCGCCAAACGCATTGATTGCAACAGCGGCTACTGTTACAAACGCTCTTACTGG<br>GGCCAGGGCACCCAGGTGACAGTCTCCTCC |
| DR595-hIL27Ra_VH H20 | 1186 | CAGGTCCAGTTGCAGGAATCTGGCGGTGGCTCCGTACAGGCGGGCGGGTCCCTC<br>ACGCTGTCTTGTGCCGCATCCGAATATGCTTATTCCACCTGCAACATGGGCTGG<br>TATCGCCAGGCCCCTGGAAAGGAACGCGAACTTGTGAGCGCCTTTATTAGCGAT<br>GGTTCTACTTATTACGCTGATAGCGTGAAAGGAAGATTTACTATCACACGCGAT<br>AATGCTAAAAATACTGTGTACTTGCAGATGAACTCTTTGAAGCCTGAGGATACG<br>GCCATCTATTACTGCTCTGCAAATTGCTACCGCCGTCTGCGTAATTACTGGGGC<br>CAGGGCACTCAGGTCACAGTGTCAAGCGGCGGGTCAGGAGGCTCCGGCGGAAGC<br>GGCCAGGTCCAGCTCCAGGAGTCTGGAGGTGGCTTGGTGCAGCCTGGTGGCTCT<br>CTTCGTCTGTCTTGCGCTGCCTCCGGTTTCACCTTTAGTTCTTACCCTATGTCC<br>TGGGTGCGTCAGGCCCCCGGAAAAGGGCTGGAATGGGTGTCCACCATTTCCTCT<br>GGCGGTGACACTACACTGTATGCAGACAGTGTGAAGGGGAGATTCACCTCTTCC<br>CGTGACAACGCCAAGAACACCCTGTATCTCCAGCTCAATAGCCTGAAGACTGAG<br>GATACCGCAATGTACTATTGCGCCAAACGGATCGACTGTAACAGTGGATATTGT<br>TACAAGCGTTCCTATTGGGGCCAGGGGACCCAGGTGACTGTGAGTTCT |
| DR595-hIL27Ra_VH H21 | 1187 | CAGGTGCAGCTTCAGGAGTCCGGTGGCGGTTCCGTACAGGCAGGAGGGTCCTTG<br>ACCCTGAGTTGTGCGGCTTCCGAATACGCCTATAGTACATGCAACATGGGCTGG<br>TATCGCCAGGCCCCCGGTAAGGAACGCGAGTTGGTAAGCGCCTTCATCTCCGAT<br>GGAAGTACCTACTATGCCGATTCAGTCAAGGGTCGCTTTACGATCACACGTGAC<br>AACGCTAAGAACACAGTCTATCTCCAGATGAATAGTCTGAAGCCCGAAGATACA<br>GCAATCTATTACTGTTCAGCCAACTGTTATCGGCGTTTGCGTAACTACTGGGGA<br>CAGGGCACCCAAGTCACCGTCTCCAGTGGTGGCGGTTCCCAGGTCCAGCTTCAG<br>GAATCCGGCGGTGGCTTGGTTCAGCCTGGGGGCTCCCTGCGCCTGAGCTGCGCT<br>GCCTCTGGATTTACCTTCTCATTGTCCAGCATGTCATGGGTCCGTCAGGCTCCC<br>GGCAAGGGCCTGGAGTGGGTCAGTGCCATCTCTTCCGGTGGGGCCTCAACGTAC<br>TATACCGATAGCGTGAAGGGACGCTTTACCATCAGCCGGGACAACGCAAAAAAT<br>ATGCTGTATCTCCAGTTGAACAGCCTGAAGACGGAGGACACTGCAATGTACTAT<br>TGCGCAAAGGGAGGGTCCGGGTACGGTGACGCCTCCAGGATGACCTCTCCTGGC<br>TCCCAGGGGACCCAGGTGACTGTCTCCAGC |
| DR595-hIL27Ra_VH H21 | 1188 | CAGGTACAGCTTCAGGAGTCAGGGGGCGGTAGCGTCCAGGCGGGCGGTTCTTTG<br>ACACTCTCCTGCGCCGCGAGCGAGTACGCATACTCTACATGCAACATGGGCTGG<br>TACAGGCAGGCCCCAGGCAAGGAAAGGGAGCTGGTGTCCGCCTTCATTAGCGAC<br>GGAAGCACCTACTATGCTGATTCCGTGAAGGGCCGGTTCACCATCACACGCGAT<br>AACGCTAAGAACACGGTGTACTTGCAGATGAACTCTCTGAAGCCCGAAGACACC<br>GCCATCTATTACTGCTCCGCTAACTGCTATCGCAGACTGCGCAATTATTGGGGG<br>CAGGGCACCCAGGTGACCGTTAGCTCCGGCGGTAGCGGTGGCAGTGGCGGTTCC<br>GGTCAGGTGCAGCTGCAAGAGTCAGGCGGGGTCTGGTGCAGCCGGGAGGTTCC<br>CTGCGCCTCTCCTGCGCCGCTTCTGGGTTTACCTTCAGCCTCTCTTCCATGTCC<br>TGGGTGCGCCAAGCGCCGGGCAAGGGTCTTGAGTGGGTTTCTGCGATCTCTTCC<br>GGTGGAGCCTCTACATACTATACAGATTCTGTGAAGGGGAGGTTCACTATCAGC<br>CGCGACAACGCCAAAAACATGCTGTACCTTCAGCTCAATTCCCTCAAGACTGAG<br>GACACAGCTATGTATTACTGTGCAAAGGGTGGCAGCGGATATGGGACGCCTCT<br>CGCATGACTAGCCCTGGTTCCCAGGGGACCCAGGTGACCGTGTCCAGC |
| DR595-hIL27Ra_VH H22 | 1189 | CAGGTGCAGCTGCAAGAGAGCGGCGGGGGTTCCGTACAGGCTGGTGGCTCTCTG<br>ACCTTGTCTTGCGCGGCTTCAGAGTATGCCTATAGTACCTGTAATATGGGTTGG<br>TATCGCCAGGCACCGGGAAAGGAGCGGGAGCTGGTGTCGCTTTCATCTCCGAC<br>GGTTCTACCTACTATGCCGATTCTGTAAAGGGGAGGTTTACTATCACTCGGGAT<br>AACGCGAAGAACACCGTCTACCTCCAGATGAACAGCCTGAAACCCGAGGATACT<br>GCGATTTACTATTGCAGCGCTAACTGTTACCGGCGCTTGCGCAACTACTGGGGC<br>CAGGGAACTCAAGTCACTGTCAGTTCTGGCGGAGGCAGCCAGGTCCAGCTCCAG<br>GAGAGCGGGGGCGGATCTGTCCAAGCTGGCGGTTCCCTCCGCCTCAGCTGTCG<br>GCATCTGGTAGCACTTACTCTAACTACTGTCTCGGCTGGTTTCGTCAGACAACC<br>GGAAAAGAGCGCGAGGGCGTGGCTGTCATCAACTGGGTGGCGGGATGCTGTAC<br>TTTGCGGATAGCGTCAAGGGCCGCTTTACTGTCTCCCAGGACCAGGCAAAAAAC<br>ACCGTCTACCTCCAGATGAACTCTCTGAAGCCGGAGGACACCGCGATGTACTAT<br>TGTGCTGCCGAGAGCGTCTCCTCATTCTCTTGCGGCGGATGGCTGACCCGCCCA<br>GACCGGGGTTCCATACTGGGGCCAGGGCACCCAGGTGACCGTTTCTTCC |

TABLE 1B-continued

| Name | SEQ ID NO: | Sequence |
|---|---|---|
| DR595-hIL27Ra_VH H22 | 1190 | CAGGTGCAGCTCCAGGAGTCTGGAGGGGGTAGCGTGCAGGCCGGAGGCTCCCTT<br>ACCCTGTCCTGTGCGGCCTCCGAGTACGCTTACTCTACCTGTAACATGGGCTGG<br>TATCGGCAAGCGCCCGGCAAAGAACGCGAACTCGTGTCCGCTTTCATCAGTGAC<br>GGTTCCACTTATTACGCTGATTCCGTTAAAGGCCGGTTTACTATCACAAGGGAT<br>AACGCGAAGAACACGGTGTATTTGCAGATGAACTCTTTGAAGCCAGAAGATACA<br>GCTATCTACTATTGCTCCGCCAACTGTTACAGGCGTCTGCGTAACTATTGGGGT<br>CAGGGCACCCAGGTAACAGTGTCATCTGGTGGGAGCGGCGGTTCTGGCGGGTCT<br>GGTCAGGTCCAGTTGCAAGAGAGCGGTGGAGGTAGCGTCCAGGCTGGTGGCTCT<br>CTGCGCCTGTCTTGCCGTGCCTCCGGCAGCACCTACTCCAACTATTGCTTGGGT<br>TGGTTCCGGCAGACAACCGGCAAAGAACGCGAGGGTGTGGCTGTGTTATCAACTGG<br>GTGGGCGGAATGCTGTACTTTGCAGATAGCGTAAAAGGCCGGTTTACCGTGAGC<br>CAAGACCAGGCTAAGAACACCGTGTACCTCCAGATGAATAGCTTGAAGCCCGAG<br>GACACGGCGATGTATTACTGTGCTGCCAATCTGTGTCATCTTTCAGCTGCGGA<br>GGGTGGCTGACCAGACCGCGTCCCTTATTGGGACAGGGCACCCAGGTC<br>ACCGTCTCATCT |
| DR595-hIL27Ra_VH H23 | 1191 | CAGGTGCAGTTGCAGGAGAGCGGCGGGGGAAGTGTTCAGGCTGGCGGGTCCCTT<br>ACACTTAGCTGCGCAGCCAGCGAGTACGCATATTCTACCTGCAACATGGGTTGG<br>TATCGCCAGGCCCCTGGAAAAGAGCGCGAACTGGTGTCCGCATTCATCTCTGAT<br>GGCTCCACCTATTACGCTGACTCCGTGAAGGGCAGGTTCACTATCACTCGGGAT<br>AACGCAAAAAATACAGTGTACCTCCAAATGAACTCCTTGAAACCCGAGGATACT<br>GCGATTTATTACTGTAGCGCCAACTGTTACCAGACTGAGAACTACTGGGGG<br>CAGGGCACACAGGTGACCGTAAGCTCCGGCGGGGGCAGTCAGGTGCAGCTCCAG<br>GAGAGTGGCGGAGGTTCCGTGCAGGCTGGAGGCTCACTGAGGTTGTCTTGCCGT<br>GCCTCCCGCAGTCCCTACGGTAATTACTGCCTCGGGTGGTTCCGCCAGTCCACG<br>GGTAAGGAGAGAGAGGGTGTGGCCGTTATCAACTGGGTCGGCGGTATGCTGTAT<br>TTTGCCGACAGCGTCAAGGGACGCTTCACCGTAAGCCAGGACCACGCTAAGAAT<br>ACCGTCACTCTGCAAATGAACTCCCTGAAGCCTGAGGATACGGCTATGTACTAT<br>TGTGCAGCGGAGAGCGTGAGTTCCTTCTCTTGTGGCGGGTGGCTGACCAGACCA<br>GACCGGGTGCCCTACTGGGGCCAGGGCACTCAAGTTACCGTCTCATCC |
| DR595-hIL27Ra_VH H23 | 1192 | CAGGTGCAACTTCAGGAATCCGGCGGTGGCAGCGTTCAGGCCGGTGGCTCCCTG<br>ACCCTGTCCTGTGCAGCGAGCGAATATGCGTACTCTACGTGCAATATGGGCTGG<br>TATCGTCAGGCTCCAGGCAAGGAGCGCGAATTGGTGAGTGCGTTCATCTCCGAT<br>GGGTCAACATACTATGCGGACTCTGTGAAGGGCCGCTTTACCATCACCAGAGAC<br>AACGCCAAGAACACGGTCTACCTGCAAATGAACAGCCTGAAGCCCGAGGACACC<br>GCAATCTACTATTGTAGTGCTAATTGTTACCGCAGGCTGAGGAATTACTGGGGT<br>CAAGGCACCCAAGTCACCGTGTCCAGCGGGGGTTCCGCGGTAGCGGAGGCTCC<br>GGCCAGGTGCAGCTCCAGGAGAGTGGGGGAGGGAGCGTGCAAGCGGGAGGGAGT<br>CTCAGGCTTTCATGCCGTGCTTCTCGCAGCCCTTATGGCAACTATTGTCTGGGC<br>TGGTTCAGGCAGAGTACAGGCAAGGAACGCGAGGGCGTGGCAGTCATCAACTGG<br>GTCGGCGGGATGTTGTACTTCGCTGACTCCGTGAAGGGCCGCTTTACAGTCTCC<br>CAAGACCACGCCAAGAACACCGTCACGCTCCAGATGAACAGTCTCAAGCCCGAA<br>GATACTGCCATGTATTACTGCGCTGCGGAGTCAGTGTCCTCTTTCAGCTGTGGG<br>GGTTGGCTGACTCGCCCAGACCGGGTGCCATATTGGGGCCAGGGTACACAAGTC<br>ACCGTCAGCAGC |
| DR595-hIL27Ra_VH H24 | 1193 | CAAGTCCAGTTGCAGGAGAGCGGGGGCGGAAGCGTGCAGGCTGGAGGGGAGCCTC<br>ACCCTGTCCTGCGCCGCTTCCGAGTACGCCTACTCTACTTGTAACATGGGGTGG<br>TATAGGCAGGCTCCCGGCAAAGAACGCGAGCTGGTCTCCGCGTTTATTTCTGAC<br>GGATCTACCTATTACGCGGACAGTGTGAAGGGCAGATTTACAATCACTAGGGAT<br>AACGCAAAAAACACTGTCTATCTCCAGATGAACTCTTTGAAGCCTGAGGACACA<br>GCTATCTATTACTGTTCCGCGAACTGCTACAGACGCCTCCGTAACTATTGGGGT<br>CAGGGTACTCAGGTGACTGTTAGTTCAGGTGGGGGCTCCCAGGTCCAGCTTCAA<br>GAATCTGGGGGTGGATTGGTCCAGCCTGGCGGTTCTCTGCGCCTGTCTTGTGCT<br>GCCAGTGGCTTCACTTTTTCCCACAGCGGCATGTCCTGGGTGCGCCAGGCTCCA<br>GGCAAGGGCCTCGAATGGGTTAGTACCATCAACAGCGGAGGTGCCAGCACCTAC<br>TATACAGATTCTGTGAAGGGCAGATTCACTATTAGTCGCGACAATGCGAAGAAC<br>ATGCTTTACTTGCAGCTGAACTCCCTGAAGACCGAAGACACTGCAATGTATTAC<br>TGCGCCAAGGGCGGTTCTGGCTACGGTGATGCGTCTCGCATGACATCCCCAGGG<br>AGTCAGGGAACCCAGGTGACCGTGAGTTCA |
| DR595-hIL27Ra_VH H24 | 1194 | CAGGTCCAGCTCCAGGAATCTGGAGGCGGTAGCGTACAAGCTGGCGGTTCTCTG<br>ACTCTGAGCTGCGCTGCCTCCGAGTACGCCTACTCAACTTGCAATATGGGCTGG<br>TATAGGCAAGCACCAGGGAGGAAAGAAGAATTGGTTTCCGCCTTCATCTCCGAC<br>GGAAGTACTTATTACGCCGATTCCGTGAAGGGACGCTTCACGATTACACGGGAC<br>AACGCAAAGAACACCGTGTATCTCCAGATGAACAGCCTGAAGCCTGAGGACACC<br>GCAATTTATTACTGTTCCGCCAACTGCTACAGACGCTTGCGCAACTACTGGGGT<br>CAAGGCACCCAGGTGACCGTCTCTAGTGGAGGCTCCGGTGGCTCCGGGGGCTCT<br>GGACAGGTGCAGCTTCAGGAGAGTGGTGGCGGGCTGGTGCAGCCTGGCGGTTCC<br>CTTCGTCTCTCTTGTGCAGCCAGCGGATTCACATTTAGTCACAGCGGCATGAGT<br>TGGGTTCGGCAAGCACCTGGGAAGGGGCTGGAGTGGGTATCCACAATCAACAGC<br>GGAGGTGCCAGCACGTACTATACCGACTCAGTTAAAGGGCGCTTCACCATTAGT<br>CGCGACAACGCGAAGAATATGCTGTACTTGCAGCTGAACAGCCTGAAGACCGAG<br>GACACTGCCATGTACTATTGCGCCAAAGGGGGCAGCGGCTACGGAGATGCGAGC<br>CGTATGACTTCACCTGGGAGCCAGGGCACCCAGGTGACCGTCTCCTCT |

TABLE 1B-continued

| Name | SEQ ID NO: | Sequence |
|---|---|---|
| DR596-hIL27Ra_VH H1 | 1195 | CAGGTGCAGCTTCAGGAGTCTGGGGGAGGCCTGGTACAACCCGGTGGCAGTCTC<br>AGGCTCAGCTGCACAGCCTCCGGCCTGACCTTCGACGATTCCGTGATGGGCTGG<br>TTTAGGCAGGCCCCAGGTAAAGGCCGGGAGGCTGTAAGCTGCATTAGCTCCTCT<br>GGAGCCAACGCCTTCTACGCTGATTCTGTGAAGGGCGTTTTACCATTTCTCGC<br>GACAACGCCAAGAACACCTTGTATTTGCAGATGAACTCCCTGAAACCCGAGGAC<br>ACCGCCACCTACTATTGTAAGCGTGGCCACGCTTGTGCGGGTTATTACCCCATT<br>CCCTACGATGACTATTGGGGTCAGGGTACGCAAGTCACCGTATCTTCCGGCGGA<br>GGCTCCCAGGTGCAGCTCCAGGAGTCAGGGGGCGGACTGGTGCAGCCCGGAGGT<br>TCCCTGCGGCTGTCTTGTGCGGCATCCGGCTTTACTTTCTCTTCCTACCCCATG<br>AGCTGGGTCCGCCAAGCGCCAGGGAAGGGTCTGGAGTGGATTTCTACAATCTCA<br>GCTGGAGGCGACACTACCCTCTACGCTGACTCTGTTAAAGGCCGCTTCACTAGC<br>AGTCGGGATAACGCCAAGAACACGCTGTACCTCCAGCTTAATAGCTTGAAAACC<br>GAGGACGCGGCCATCTATTACTGCGCCAAGCGTATTGACTGTAACTCTGGATAC<br>TGCTATCGTCGCAACTATTGGGGTCAGGGGACCCAAGTTACAGTGAGTTCT |
| DR596-hIL27Ra_VH H1 | 1196 | CAGGTTCAGCTTCAGGAGAGTGGCGGGGGCCTGGTTCAGCCCGGCGGTTCCCTT<br>CGCCTGAGCTGTACGGCAAGCGGTCTGACATTTGACGATTCCGTGATGGGCTGG<br>TTTCGTCAGGCTCCTGGCAAGGGTAGGAGGCGGTGAGTTGCATCAGCTCCAGC<br>GGAGCCAACGCCTTTTACGCGGATAGCGTCAAGGGAAGGTTTACCATCAGCCGG<br>GACAATGCTAAGAACACCCTGTACTTGCAGATGAACAGTCTGAAACCAGAGGAC<br>ACCGCAACTTATTACTGCAAGCGCGGCCACGCTTGCGCGGGCTATTACCCGATT<br>CCCTATGACGATTACTGGGGCCAGGGCACTCAGGTGACAGTCAGCTCTGGCGGA<br>AGTGGCGGAAGCGGCGGTTCTGGCCAGGTTCAGTTGCAGGAGAGCGGAGGTGGC<br>CTGGTCCAGCCCGGTGGCTCTCTGCGCCTGAGCTGCGCCGCTTCCGGTTTCACT<br>TTCTCTAGCTATCCCATGAGTTGGGTGCGTCAGGCTCCAGGCAAGGGACTGGAG<br>TGGATCAGTACCATCTCAGCTGGGGGCGACACCACATTGTACGCCGATTCTGTG<br>AAGGGCAGATTTACCTCCTCTCGCGATAATGCCAAGAACACCCTGTATCTCCAG<br>TTGAACTCTCTGAAGACCGAGGACGCTGCCATCTACTATTGCGCCAAGCGTATC<br>GACTGTAATTCCGGCTACTGTTACCGTCGGAACTACTGGGGACAAGGCACCCAG<br>GTTACCGTTAGCTCC |
| DR596-hIL27Ra_VH H2 | 1197 | CAGGTCCAACTGCAAGAATCCGGTGGGGGTCTGGTTCAGCCCGGTGGCTCACTG<br>CGCCTGTCATGTACCGCCAGCGGCCTGACTTTCGATGACAGTGTCATGGGATGG<br>TTTCGCCAGGCCCCTGGAAAGGGAAGGGAAGCGGTCAGCTGTATTTCTTCCAGC<br>GGGGCTAATGCCTTCTACGCTGACTCCGTGAAAGGTCGGTTTACCATCAGTAGG<br>GATAATGCCAAGAACACCTTGTACTTGCAGATGAACTCCCTGAAACCTGAGGAC<br>ACCGCCACCTATTACTGTAAGCGTGGCCACGCCTGCGCTGGCTACTATCCCATC<br>CCATACGATGACTACTGGGGCCAGGGTACTCAGGTAACTGTTAGCTCTGGAGGG<br>GGCTCCCAGGTGCAGCTTCAGGAATCTGGTGGCGGACTGGTCCAGCCTGGGGGT<br>TCCCTTCGTCTGAGCTGCGCAGCCTCTGGTTTCACTTTTAGCCTGAGCGGTATG<br>AGCTGGGTGAGGCAGGCCCCTGGCAAGGGTCTGGAGTGGGTCAGCGCGATCTCC<br>AGCGGCGGTGCCTCTACCTACTATACAGATTCCGTGAAGGGCAGATTCACTATC<br>TCCAGAGATAACGCTAAAAACATCCTCTACCTGCAACTGAACTCCCTCAAGACC<br>GAGGATACTGCCATGTATTACTGTGCAAAGGGAGGCTCTGGTTATGGTGATGCC<br>AGTCGGATGACCTCCCCTGGCTCCCAGGGAACACAGGTTACGGTCTCATCC |
| DR596-hIL27Ra_VH H2 | 1198 | CAGGTCCAGCTTCAGGAGAGTGGCGGGGGACTGGTACAGCCCGGAGGCTCCCTG<br>AGACTGAGTTGCACCGCCAGTGGTCTGACATTCGATGACAGCGTGATGGGCTGG<br>TTCAGACAGGCCCCCGGCAAAGGCCGCGAGGCCGTTAGCTGTATCTCTAGTAGC<br>GGGGCCAACGCTTTTTACGCTGACTCTGTTAAGGGCAGGTTCACCATTTCCCGC<br>GACAATGCGAAGAACACCCTGTACTTGCAGATGAACAGTCTGAAACCCGAAGAC<br>ACGGCTACTTACTATTGTAAGAGGGGTCACGCCTGCGCCGGTTATTACCCCATT<br>CCCTACGATGACTATTGGGGGCAAGGGACCCAGGTCACAGTCTCCAGCGGCGGG<br>TCCGGCGGTAGCGGGGGCTCCGGCCAGGTGCAGCTGCAAGAGTCCGGGGGCGGT<br>CTTGTTCAGCCAGGTGGCTCTCTGCGGCTGTCCTGCGCGGCCTCTGGATTCACA<br>TTCTCTCTCAGTGGCATGTCTTGGGTGCGCCAGGCTCCGGGCAAGGGCCTCGAA<br>TGGGTGTCCGCCATCTCCAGCGGTGGCGCTTCCACTTATTACACCGATTCTGTG<br>AAGGGACGCTTCACCATCTCTAGGGACAACGCGAAGAACATTTTGTATCTCCAA<br>CTGAACAGTCTTAAAACCGAGGACACTGCCATGTATTACTGTGCTAAGGGTGGG<br>TCTGGCTACGGAGATGCGTCCAGGATGACGAGCCCAGGCTCCCAGGGCACCCAG<br>GTGACCGTGTCCTCT |
| DR596-hIL27Ra_VH H3 | 1199 | CAGGTCCAGCTCCAGGAGTCCGGTGGGGGCCTCGTTCAGCCCGGCGGATCTCTG<br>AGGCTGAGCTGTACCGCCTCTGGCCTGACCTTCGACGATTCCGTGATGGGCTGG<br>TTCAGACAGGCTCCCGGCAAGGGCCGCGAAGCTGTCTCCTGCATCTCCTTCC<br>GGCGCAAATGCGTTCTACGCCGACTCAGTGAAGGGCCGTTTTACCATTTCTCGG<br>GATAACGCTAAAAACACGCTGTATCTGCAAATGAACTCCTTGAAACCGGAGGAT<br>ACCGCCACCTATTACTGCAAACGCGGTCATGCCTGTGCTGGGTATTACCCAATC<br>CCTTACGATGACTATTGGGGCCAAGGCACCCAGGTCACCGTCAGTAGCGGCGGT<br>GGCTCCCAGGTTCAGTTGCAGGAATCAGGCGGGGGCTCCGTCCAAGCCGGAGGC<br>TCTCTGCGTCTGTCATGTGTAGCCAGTGGCTACGTGTCATGCGATTACTTCCTG<br>CCTTCCTGGTATAGACAGGCTCCCGGCAAGGAGCGCGAGTTCGTGAGCATTATC<br>GACGGCACGGGTTCCACGTCCTACGCTGCCTCCGTTAAGGGTCGCTTTACAGCT<br>AGTGAGGACAAGGGCAAGAACATTGCGTACCTCCAGATGAACTCCCTGAAGCCT<br>GAAGATACAGCCATGTACTATTGCAAGGCCAGCTGTGTGAGGGGCCGCGCTGTT<br>TCAGAATACTGGGGCCAGGGCACCCAGGTCACTGTTTCTTCT |

TABLE 1B-continued

| Name | SEQ ID NO: | Sequence |
|---|---|---|
| DR596-hIL27Ra_VH H3 | 1200 | CAGGTTCAGTTGCAGGAATCCGGGGGCGGATTGGTCCAGCCAGGAGGCTCCCTT CGCCTGAGCTGCACTGCCTCTGGACTGACATTTGACGATTCTGTTATGGGCTGG TTCCGCCAAGCACCAGGAAAGGGCAGAGAGGCAGTGTCTTGTATCTCTTCCAGC GGAGCCAATGCGTTTTATGCTGACAGCGTGAAGGGCAGGTTCACCATCTCACGC GACAACGCTAAGAACACCCTCTATCTTCAGATGAACTCTCTCAAACCTGAGGAT ACCGCCACCTATTACTGTAAACGCGGACATGCTTGCGCCGGTTACTATCCTATC CCCTATGATGACTACTGGGGGCAGGGCACCCAGGTGACCGTGTCAAGCGGGGGA TCAGGAGGCAGCGGAGGCAGCGGCCAGGTCCAACTTCAGGAGTCAGGAGGCGGT TCTGTGCAGGCCGGAGGCTCACTGCGGCTGTCCTGTGTGGCGAGTGGCTACGTA AGCTGCGACTACTTCCTGCCTTCTTGGTACAGGCAGGCCCCTGGCAAAGAGAGG GAATTTGTGTCCATCATTGATGGTACAGGCAGCACCTCCTATGCGGCCTCCGTT AAGGGCAGATTTACTGCCTCCGAGGACAAGGGCAAGAATATCGCCTATCTCCAG ATGAACTCCCTGAAGCCGGAAGATACCGCAATGTACTATTGCAAAGCCAGTTGT GTGAGAGGGAGAGCGGTAAGTGAGTATTGGGGTCAGGGCACTCAGGTGACGGTT TCCAGC |
| DR596-hIL27Ra_VH H4 | 1201 | CAGGTGCAACTTCAGGAGTCTGGAGGCGGACTGGTCCAGCCTGGGGGCTCTCTG CGTCTGTCTTGCACCGCCTCCGGCTGACGTTTGATGACTCAGTCATGGGGTGG TTCCGCCAAGCCCCTGGGAAGGGCAGGGAGGCCGTCAGCTGCATCTCTAGCTCC GGGGCCAACGCTTTCTACGCGGATAGCGTCAAGGGCCGCTTCACCATCAGTAGA GATAACGCAAAAACACTTTGTATCTCCAGATGAACAGCCTGAAACCCGAGGAT ACCGCAACGTATTACTGTAAGCGCGGACACGCTTGTGCGGGCTATTACCCTATT CCCTATGATGACTACTGGGGTCAGGGCACTCAAGTCACCGTCAGTTCTGGCGGA GGTTCTCAGGTACAGCTCCAGGAGTCTGGCGGGGGCCTGGTGCAGCCCGGCGAA TCTCTGAGACTGTCATGCACCGCATCCGGCTTTACCTTCTCTAATTACGCCATG AGCTGGGTCAGACAGGCCCCTGGTAAGGGGCTGGAGTGGGTCAGTGGAATCAAC GTTGGCCTATGGGATCACCTCCTACGCGGACTCCGTCAAGGGTAGATTTACAATC TCTCGCGACAACACCAAGAACACCCTGTACCTTCAGCTGAACTCACTCAAAACC GAAGACACCGCGATCTATTACTGTGTGAAACACTCAGGTACAACCATCCCCAGA GGATTCATCTCATACACAAAACGCGGCCAGGGTACTCAGGTAACCGTGTCCTCA |
| DR596-hIL27Ra_VH H4 | 1202 | CAGGTCCAGCTCCAGGAGAGCGGCGGGGGCCTGGTGCAGCCTGGCGGTTCCCTG CGGCTCAGCTGTACCGCCTCCGGGCTGACGTTCGACGATTCTGTGATGGGCTGG TTTCGCCAGGCCCCCGGCAAGGGACGCGAAGCTGTAAGCTGCATTAGTTCCTCT GGAGCGAATGCCTTCTACGCGGACTCTGTGAAGGGCCGCTTCACAATCTCCCGC GACAACGCTAAGAACACGCTGTACCTTCAGATGAACTCTCTGAAACCCGAGGAT ACTGCCACCTACTATTGCAAGCGCGGCCATGCCTGTCTGGGTACTATCCAATC CCGTATGACGATTACTGGGGCCAAGGGACCCAGGTCACCGTAAGTCAGGAGGT AGCGGTGGCTCTGGGGGCTCTGGTCAAGTACAGTTGCAGGAAAGTGGCGGGGT CTGGTTCAGCCAGGCGAGTCATTGAGATTGTCTTGTACGGCTAGTGGATTCACA TTTAGTAACTACGCCATGAGCTGGGTCCGTCAAGCACCTGGCAAGGGCCTGGAG TGGGTATCCGGTATTAACGTGGCCTACGGAATTACAAGTTATGCAGACTCTGTG AAGGGCAGGTTCACAATCTCTCGGGACAACACCAAGAACACGCTGTACCTTCAG CTGAACTCTCTGAAAACCGAAGATACTGCTATCTATTACTGCGTGAAGCACAGC GGCACAACCATCCCACGCGGTTTCATCTCTTATACCAAGAGAGGCCAGGGCACC CAAGTCACCGTGTCATCC |
| DR596-hIL27Ra_VH H5 | 1203 | CAGGTGCAACTCCAGGAGTCCGGCGGTGGCCTCGTGCAACCGGGTGGCTCCTTG AGACTGTCTTGTACCGCCAGCGGACTTACCTTCGACGATTCTGTGATGGGCTGG TTCCGGCAAGCGCCGGGCAAGGGCAGAGAGGCCGTGAGCTGCATCTCTAGTTCT GGTGCTAACGCTTTTTACGCCGACTCCGTGAAAGGCCGGATTCCAAGA GATAACGCCAAAAACACTCTCTACCTCCAGATGAACTCCCTCAAGCCTGAGGAC ACTGCCACCTATTACTGTAAGCGGGGCACGCTTGCGCAGGCTATTACCCTATT CCCTATGACGATTACTGGGGCCAGGGTACACAGGTGACGGTGTCCAGTGGCGGA GGGTCACAAGTTCAACTTCAGGAGAGCGGCGGAGGGTCTGCAGGCTGGTGGC TCCCTGCGTCTCTCCTGTACCGCCTCCGGCTACGTGTCATGTGATTACTTTCTG CCTTCCTGGTACAGGCAAGCACCCGGTAAGGAGCGCGAATTTGTCAGCGTTATT GACGGCACGGGTAGTACGTCCTATGCTGCCTCCGTGAAGGGCCGCTTCACGGCA TCCCAGGACAAGGGGAAAAATATCGCATACCTCCAAATGAACAGTCTGAAGCCG GAGGATACAGCTATGTATTACTGCAAGGCTTCATGTGTGCGCGGAAGAGCTATT AGTGAGTATTGGGGCCAGGGTACACAGGTAACGGTCAGCTCC |
| DR596-hIL27Ra_VH H5 | 1204 | CAGGTCCAGTTGCAGGAGCGGCCGGTGGCTTGGTGCAGCCCGGTGGGTCACTG AGACTGTCCTGCACTGCAAGCGGCCTTACGTTCGATGACAGCGTGATTGGGGTGG TTCCGCCAGGCACCCGGCAAGGGACGTGAGGCCGTGTCCTGCATTAGCTCATCC GGCGCTAATGCCTTTTATGCCGACAGCGTCAAGGGCAGATTTACCATCTCTCGC GACAATGCCAAAAATACCCTGTATCTTCAAATGAATAGCCTGAAGCCAGAGGAT ACCGCTACTTACTATTGTAAGCGCGGCCACGCCTGCGGGCTATTACCCTATC CCCTACGATGACTATTGGGGCCAGGGTACTCAAGTGACTGTGAGTTCCGGTGGC TCCGGCGGTCTGGAGGCTCAGGTCAAGTCCAGTTGCAGGAGTCCGGGGGCGGT AGCGTGCAGGCGGGCGGTTCCCTGCGCCTGTCTTGTACCGCATCTGGGTACGTC TCCTGCGATTACTTCCTTCCTGGTACAGGCAGGCCCCTGGCAAGGAGCGT GAGTTTGTGTCCGTGATCGACGGGACAGGTTCCACCTCCTACGCTGCATCCGTT AAGGGTCGCTTTACAGCCAGCCAGGACAAAGGAAAGAACATCGCTTACCTGCAA ATGAACTCCCTGAAACCTGAGGATACCGCTATGTATTACTGCAAGGCCTCCTGC GTCCGTGGCCGTGCGATCTCCGAATACTGGGGCCAGGGCACCCAGGTGACTGTT AGCAGC |

TABLE 1B-continued

| Name | SEQ ID NO: | Sequence |
|---|---|---|
| DR596-hIL27Ra_VH H6 | 1205 | CAGGTGCAGTTGCAGGAGTCTGGGGGAGGTCTCGTGCAGCCAGGAGGGTCACTC<br>CGCCTGAGTTGTACTGCCAGCGGTTTGACATTCGACGATTCTGTCATGGGCTGG<br>TTTCGCCAAGCTCCAGGGAAGGGCCGCGAGGCTGTGTCCTGCATCTCATCCTCT<br>GGGGCCAACGCTTTTTACGCTGATTCTGTCAAAGGCCGCTTCACAATCAGCCGG<br>GACAACGCCAAGAACACTTTGTATCTCCAAATGAACAGCCTGAAGCCTGAGGAC<br>ACTGCAACCTATTACTGTAAGCGCGGACACGCCTGCGCTGGCTATTACCCCATC<br>CCTTACGACGATTATTGGGGTCAAGGAACTCAGGTTACTGTTAGCTCCGGCGGG<br>GGCAGCCAGGTGCAGCTTCAGGAGTCAGGTGGAGGTCTGGTGCAACCTGGAGGC<br>TCCCTGCGCCTGTCCTGTGCCGCATCCGGCTTTAGTTTCTCTAGCTACGCAATG<br>AAATGGGTGCGTCAAGCCCCAGGCAAAGGTCTGGAGTGGGTGTCCACCATCAGT<br>AGCGGTGGCTCCAGCACGAACTACGCCGACTCCGTGAAAGGCCGGTTCACCATC<br>AGCCGTGATAACGCTAAGAACACGCTGTACCTCCAGCTGAACTCTCTGAAGATC<br>GAGGACACGGCAATGTATTACTGTCAAAGGCAATCGTTCCAACTGGTGCCACT<br>ATGGAGAGGGGGCAGGGAACCCAAGTCACCGTTAGCTCC |
| DR596-hIL27Ra_VH H6 | 1206 | CAAGTGCAGCTCCAAGAAAGCGGCGGAGGCCTGGTGCAGCCTGGCGGTTCTCTG<br>AGACTGAGCTGTACTGCCTCAGGTCTGACTTTTGACGATTCTGTCATGGGATGG<br>TTTAGACAAGCTCCAGGCAAGGGTCGTGAGGCGGTGAGCTGTATTAGCTCCTCT<br>GGCGCGAACGCATTTTATGCCGATTCCGTTAAGGGTCGCTTCACAATCTCACGG<br>GACAACGCGAAGAATACACTGTACCTGCAAATGAACTCCCTGAAGCCCGAGGAC<br>ACAGCTACCTATTACTGCAAGCGCGGCCACGCCTGTCAGGTTATTACCCTATT<br>CCCTATGATGACTACTGGGGACAAGGGACTCAGGTTACCGTCAGCTCCGGTGCC<br>AGCGGCGGATCTGGTGGCTCCGGCCAGGTGCAGCTTCAGGAGTCGGGGGAGGC<br>CTGGTGCAGCCGGGCGGTTCATTGCGCCTTTCTTGCGCCGCGAGTGGCTTCTCC<br>TTTTCCAGCTATGCCATGAAGTGGGTCCGCCAGGCTCCTGGGAAGGGCCTGGAG<br>TGGGTGTCCACCATCTCCTCTGGGGGCTCCAGTACCAACTACGCCGACAGCGTG<br>AAGGGTCGCTTCACTATCAGCAGAGATAACGCTAAGAACACACTGTACCTCCAG<br>CTGAATAGCCTGAAGATCGAGGATACGGCTATGTATTACTGTGCCAAGGCGATT<br>GTGCCTACAGGAGCCACTATGGAACGCGGCCAAGGCACCCAGGTGACGGTGTCA<br>AGC |
| DR596-hIL27Ra_VH H7 | 1207 | CAGGTGCAACTTCAAGAATCTGGAGGTGGACTGGTCCAGCCTGGCGGTTCTCTG<br>CGCCTCTCTTGTACTGCTTCCGCCTCACATTTGACGATTCTGTTATGGGATGG<br>TTCAGACAGGCCCCAGGTAAGGGTCGCGAGGCCGTGAGTTGTATCAGCTCCAGC<br>GGCGCTAACGCATTCTATGCCGACAGTGTCAAGGGACGCTTTACAATCTCCAGG<br>GACAACGCCAAAAACACGCTCTACCTTCAGATGAACTCACTGAAGCCCGAGGAT<br>ACTGCTACCTATTACTGCAAACGCGGTCATGCTTGTGCCGGTTATTACCCCATC<br>CCATACGATGACTACTGGGGCCAGGGGACCCAGGTAACCGTCAGCTCCGGCGGT<br>GGATCACAGGTGCAGCTTCAGGAGAGTGGTGGAGGTCTCGTGCAACCTGGAGGT<br>AGTCTCCGCTTGTCTTGTGCTGCCTCCGGTTTCACCTTTTCCAGCTACCCCATG<br>AGTTGGGTGCGCAAGCGCCGGGAAGGGCCTGGAGTGGATTTCAACTATCAGC<br>GCTGGAGGCGATACCACACTGTACGCCGATAGTGTTAAGGGAAGGTTCACTTCC<br>TCTAGGGATAACGCCAAGAACACCCTGTATCTTTCAGCTGAACAGTCTGAAGACG<br>GAGGACACTGCTATCTATTACTGCGCAAAACGCATTGATTGCAACTCCGGCTAT<br>GCTACCGCCGGAACTACTGGGGCCAGGGGACCCAGGTGACAGTCAGTTCC |
| DR596-hIL27Ra_VH H7 | 1208 | CAGGTACAGCTCCAGGAGAGCGGCGGTGGCCTGGTACAGCCAGGGGGTTCATTG<br>CGTCTGAGCTGCACTGCTTCTGGTCTGACGTTTGATGACTCTGTTATGGGCTGG<br>TTCCGCCAAGCGCCCGGCAAGGGACGGGAAGCTGTTAGCTGTATCTCCAGTTCT<br>GGGGCCAACGCCTTCTACGCCGATTCTGTGAAGGGTCGCTTCACTATCTCACGC<br>GACAACGCCAAGAACACCCTGTACCTTCAGATGAACAGTCTGAAGCCTGAGGAT<br>ACCGCCACCTACTATTGCAAGCGCGGCCATGCGTGCGCGGGCTATTACCCTATC<br>CCTTACGATGACTATTGGGGGCAGGGCACCCAGGTGACTGTGTCCAGTGGAGGC<br>TCCGGTGGCAGTGGAGGGTCCGGCCAGGTCCAACTCCAGGAGTCTGGTGGGGGC<br>TTGGTCCAGCCTGGGGGTAGCTTGCGCCTGTCTTGCGCTGCCTCCGGGTTCACC<br>TTCTCTAGTTATCCTATGTCTTGGGTGCGGCAAGCGCCGGGTAAGGGCCTGGAG<br>TGGATTTCTACTATCTCTGCTGGCGGTGACACCACGTTGTACGCAGATTCCGTG<br>AAGGGGCGTTTCACCTCCTCAAGAGACAATGCGAAGAACACCTTGTACCTCCAG<br>CTGAACAGCCTGAAGACCGAGGACACCGCTATTTACTATTGTGCCAAGCGTATT<br>GATTGTAATAGCCGTTATTGCTACCGCAGGAACTACTGGGGCCAGGGCACACAG<br>GTCACCGTGAGCAGT |
| DR596-hIL27Ra_VH H8 | 1209 | CAGGTGCAACTCCAGGAAAGCGGTGGCGGGCTTGTGCAGCCCGGCGGTAGCCTG<br>CGGCTGAGTTGTACTGCAAGCGGTCTCACCTTCGACGATAGTGTAATGGGTTGG<br>TTTCGTCAAGCACCCGGAAAGGGAAGGGAGGCGGTGTCTTGCATCTCCAGCAGT<br>GGGCGCGAATGCGTTTTATGCCGATTCCGTCAAGGGGCGGTTTACGATCTCCAGG<br>GATAACGCCAAGAACACGCTGTACCTCCAGATGAACAGTCTGAAGCCCGAGGAT<br>ACGGCCACATATTACTGTAAGCGCGGGCACGCCTGTGCCGGATACTATCCCATC<br>CCTTATGACGATTATTGGGGTCAAGGTACGCAGGTCACAGTTAGCTCTGGCGGA<br>GGTTCCCAGGTCCAACTTCAGGAGTCCGGTGGAGGGTCCGTTCAGGTGGGCGGA<br>TCTCTTCGCCTGAGCTGCGCGGCCAGCGGATTTACCTTCAGCTCCTACCCAATG<br>AGTTGGGTGCGTCAGGCTCCGGGTAAGGGCCTGGAGTGGATCTCTACCATTAGT<br>GCTGGCGAGACACCACGCTGTACGCCGACAGCGTGAAGGGGCGCTTCACCTCC<br>TCTCGCGATAACGCAAAGAATACCCTGTACCTCCAGCTCAATTCCTTGAAGACC<br>GAAGATACGGCCATTTATTACTGCGCCAAGCGCATTGATTGCAATAGCGGCTAT<br>TGCTATCGGAGGAACTACTGGGGACAGGGAACCCAAGTCACTGTTTCATCC |

TABLE 1B-continued

| Name | SEQ ID NO: | Sequence |
|---|---|---|
| DR596-hIL27Ra_VH H8 | 1210 | CAGGTCCAGCTCCAAGAGTCAGGAGGCGGACTCGTGCAACCGGGTGGCTCCCTG<br>AGGCTGTCTTGTACCGCAAGCGGCCTGACCTTCGATGACAGTGTCATGGGCTGG<br>TTCAGGCAGGCCCCCGGCAAAGGCCGTGAGGCCGTCAGCTGTATCAGTTCTAGT<br>GGAGCCAACGCCTTTTACGCCGATTCCGTAAAGGGCCGTTTCACCATTTCAAGG<br>GACAATGCCAAGAATACCCTGTATCTGCAAATGAACTCCCTCAAGCCCGAAGAT<br>ACCGCCACCTACTATTGCAAGCGCGGACATGCCTGTGCCGGTTATTACCCCATT<br>CCCTATGACGATTATTGGGGTCAGGGAACCCAGGTGACCGTGTCCAGTGGAGGG<br>TCCGGGGGCTCTGGCGGGTCCGGCCAGGTGCAGTTGCAGGAGTCAGGGGGTGGG<br>AGCGTCCAGGTTGGGGGTAGTCTGCGCCTGTCTTGTGCAGCCTCTGGGTTCACC<br>TTCAGCTCCTACCCCATGAGCTGGGTGCGCCAGGCTCCGGGAAAAGGTCTTGAG<br>TGGATCTCTACAATCTCCGCCGGTGGCGACACTACCCTGTACGCTGACAGCGTG<br>AAGGGCCGGTTTACAAGTTCTCGCGACAACGCCAAGAACACCTTGTACCTCCAG<br>CTCAACTCCCTGAAGACCGAGGATACCGCCATTTATTACTGTGCAAAAAGGATT<br>GATTGTAACTCCGGCTACTGTTATCGCAGAAATTACTGGGGCCAGGGGACCCAG<br>GTTACAGTGTCTAGC |
| DR596-hIL27Ra_VH H9 | 1211 | CAGGTTCAGCTGCAAGAGAGCGGAGGGGGTCTCGTGCAGCCGGGTGGGAGCCTG<br>CGCCTTTCCTGTACTGCTTCTGGACTGCAGTTCGATGACTCCGGTGATGGGTTGG<br>TTCCGGCAGGCCCCTGGAAAGGGCCGTGAAGCTGTGTCCTGTATCAGCTCTTCC<br>GGGGCGAATGCTTTCTACGCCGATAGCGTTAAGGGCCGCTTTACCATCTCCCGC<br>GACAACGCAAAGAATACTCTGTACTTGCAGATGAACAGCCTCAAGCCCGAAGAC<br>ACCGCCACTTATTACTGTAAGCGCGGCCACGCTTGCGCGGGTTACTATCCCATC<br>CCTTACGATGACTACTGGGGACAGGGAACCCAGGTAACCGTGTCATCTGGCGGG<br>GGCAGTCAGGTCCAGTTGCAGGAAAGCGGAGGTGGCAGCGTTCAGAGTGGCGGT<br>TCCCTGCGTCTTAGCTGTGCAGCCTCCGGCTTTACATACAGCACTTCTAATTCC<br>TGGATGGCCTGGTTCAGACAGGCCCCAGGCAAGGAACGCGAAGGCGTGGCTGCC<br>ATTTACACGGTCGGAGGGTCCATCTTTTACGCCGATTCCGTGCGTGGCCGCTTT<br>ACCATCTCCCAGGACGCTACTAAGAATATGTTCTACCTGCAAATGAATACCCTG<br>AAACCGGAGGACACCGCCATGTACTATTGTGCCGCAGCGTCCGGTCGCCTGAGG<br>GGGAAGTGGTTCTGGCCCTATGAATACAATTACTGGGGACAGGGCACCCAGGTT<br>ACCGTGTCTTCA |
| DR596-hIL27Ra_VH H9 | 1212 | CAGGTACAGCTGCAAGAGAGCGGAGGCGGATTGGTGCAGCCCGGAGGCAGTTTG<br>AGGTTGAGCTGTACCGCTTCCGGCCTCACTTTCGATGACTCCGTCATGGGCTGG<br>TTCCGCCAAGCACCTGGAAAGGGACAGGAAGCTGTCTCCTGCATCAGCAGTAGC<br>GGAGCCAACGCCATTCTACGCTGACAGCGTCAAAGGCAGGTTCACAATTAGCCGT<br>GATAATGCAAAGAACACTCTGTACCTGCAAATGAACTCTTTGAAGCCCGAGGAC<br>ACCGCGACGTATTACTGCAAGAGAGGACATGCCTGTGCCGGTTATTACCCCATC<br>CCTTACGATGACTATTGGGGACAGGGTACTCAGGTGACGGTGAGTTCCGGCGGT<br>AGCGGTGGCAGTGGAGGGAGCGGTCAGGTGCAGTTGCAGGAGAGCGGGGGCGGA<br>AGCGTGCAGTCCGGCGGGTCCCTGCGCCTTAGTTGCGCCGCTTCCGGCTTCACT<br>TATAGCACCTCTAACTCTTGGATGGCTTGGTTTCGCCAGGCCCCCGGCAAGGAG<br>AGAGAGGGCGTGGCTGCCATCTACACAGTGGGCGGAAGCATCTTTTACGCGGAT<br>AGCGTGAGAGGCCGTTTCACAATCAGCCAGGATGCAACAAAGAATATGTTCTAT<br>CTCCAGATGAACACACTGAAGCCCGAAGACACCGCTATGTATTACTGTGCTGCC<br>GCTTCAGGACGCTTGAGGGGCAAATGGTTTTGGCCCTATGAATACAACTACTGG<br>GGACAGGGCACCCAGGTGACTGTAAGCAGC |
| DR596-hIL27Ra_VH H10 | 1213 | CAGGTGCAGTTGCAGGAAAGCGGCGGAGGCCTGGTGCAGCCTGGCGGTTCCCTG<br>CGTCTTTCCTGTACTGCCTCAGGACTTACCTTCGATGACAGTGTGATGGGTTGG<br>TTCCGTCAGGCCCCTGGTAAAGGCGGGAAGCAGTCAGTTGTATCTCCAGCTCT<br>GGTGCAAACGCATTCTACGCCGACTCTGTCAAGGGACGTTTCACTATCAGTCGC<br>GATAACGCTAAGAATACCCTGTACCTCCAGATGAACAGCCTGAAGCCTGAGGAT<br>ACGGCTACCTATTACTGTAAACGGGACACGCCTGTGCTGGCTACTATCCCATT<br>CCATACGACGATTATTGGGGACAGGGAACTCAGGTGACAGTGTCAAGCGGCGGT<br>GGCTCACAGGTTCAGCTCCAGGAATCTGGCGGGGCTCTGTCCAGGCAGGAGGC<br>AGCTTGCGCCTGTCCTGTAGGGCAAGTGGAAGCACTTACTCCAACTACTGCCTG<br>GGCTGGTTCCGCCAAATTACTGGTAAAGAGCGGGAAGGTGTCGCGGTCATTAAC<br>TGGGTCGGCGGTATGCTGTATTTTGCTGATTCTGTGAAGGGTCGGTTCACTGTG<br>TCCCAGGACCAGGCTAAGAACACCTTGTATCTGCAAATGAACAGCCTGAAGCCA<br>GAGGATACCGCGATGTATTACTGCGCAGCCGAGAGCGTCTCTAGCTTTAGCTGC<br>GGCGGTTGCTGACCAGGCCGGATCGCGTGCCTTACTGGGGTCAAGGAACCCAG<br>GTGACCGTCTCTTCA |
| DR596-hIL27Ra_VH H10 | 1214 | CAAGTCCAACTCCAGGAGTCCGGGGGTGGCCTCGTCCAGCCTGGTGGCTCCCTT<br>AGGCTGAGCTGCACTGCATCTGGCCTGACTTTCGATGACTCCGTCATGGGCTGG<br>TTCCGCCAGGCTCCGGGAAAGGGACGCGAGGCCGTGTCTTGTATCAGCTCCAGT<br>GGTGCCAACGCTTTTACGCTGACTCTGTAAAAGGCCGGTTCACTATCAGCCGC<br>GACAACGCCAAAACACCCTCTACTTGCAGATGAATAGCCTGAAGCCTGAGGAC<br>ACCGCCACATACTATTGTAAACGTGGCCACGCTTGCGCCGGTTATTACCCTATC<br>CCCTACGATGACTACTGGGGCCAGGGCACCCAGGTGACCGTGAGTTCCGGTGGC<br>AGCGGCGGTTCTGGCGGATCAGGCCAGGTCCAACTTCAGGAAAGCGGAGGGGGC<br>AGTGTTCAGGCTGGTGGCTCCCTGCGTCTGTCCTGCCGTGCTAGTGGGCTACC<br>TATTCTAACTACTGCCTCGGCTGTTCCGCCAAATCACGGGTAAGGAGCGTGAG<br>GGGGTTGCCGTCATAAATTGGGTGGGCGGGATGCTTTACTTCGCCGATAGTGTG<br>AAGGGGCGTTTTACTGTGTCCCAGGACCAGGCAAAGAATACCCTGTACCTCCAA<br>ATGAACTCTCTGAAGCCCGAAGACACAGCCATGTACTATTGTGCCGCAGAGAGC |

TABLE 1B-continued

| Name | SEQ ID NO: | Sequence |
|---|---|---|
| | | GTGTCATCCTTCTCTTGTGGCGGATGGCTGACCCGCCCTGATCGCGTGCCCTAC<br>TGGGGTCAGGGCACCCAGGTGACCGTCTCATCC |
| DR596-<br>hIL27Ra_<br>VH<br>H11 | 1215 | CAGGTGCAGCTCCAGGAATCAGGCGGGGGCCTCGTGCAGCCAGGGGGCAGCCTG<br>AGACTCTCTTGCACAGCCAGCGGACTCACCTTTGATGACAGCGTCATGGGCTGG<br>TTCAGGCAGGCTCCCGGCAAAGGAAGGGAGGCCGTCTCCTGCATCTCTTCCTCT<br>GGTGCTAATGCCTTCTACGCTGACTCCGTCAAGGGCCGCTTTACTATCTCCCGC<br>GACAACGCAAAGAACACTCTGTACCTCCAGATGAACTCCCTGAAGCCTGAGGAC<br>ACCGCGACATATTACTGTAAGAGAGGCCACGCCTGTGCGGGCTATTACCCCATC<br>CCCTACGATGACTATTGGGGTCAGGGCACGCAAGTTACAGTCTCCAGCGGGGGA<br>GGTTCCCAGGTCCAGCTCCAGGAATCTGGCGGGGGCAGTGTCCAGGCCGGAGGC<br>TCCCTGAGACTGAGCTGCCGGGCCTCCGGTTCCACATACTCCAACTACTGCCTG<br>GGCTGGTTCCGCCAGTCCACAGGTAAAGAGAGAGAGGGCGTCGCAGTGATTAAC<br>TGGGTTGGCGGAATGCTGTACTTTGCTGACTCCGTTAAGGGCCGCTTCACCGTC<br>TCCCAGGATCACGCTAAGAACACTGTCACCTTGCAGATGAACTCCATTGAAGCCC<br>GAAGATACCGCCATGTACTATTGTGCTGCCGAGAGCGTTAGTTCATTTCTTGC<br>GGCGGTTGGCTGACGCGCCCAGGCCGCGTGCCCTACTGGGGCCAGGGAACGCAA<br>GTGACCGTGTCATCC |
| DR596-<br>hIL27Ra_<br>VH<br>H11 | 1216 | CAGGTACAGTTGCAGGAGTCCGGTGGGGGACTGGTCCAGCCCGGCGGATCACTG<br>CGCCTGAGCTGCACCGCATCCGGGCTGACCTTCGACGATAGCGTTATGGGTTGG<br>TTCCGCCAGGCCCCAGGTAAGGGACGCGAAGCTGTCAGCTGCATCTCTTCCTCT<br>GGGGCCAATGCCTTCTATGCCGATTCTGTGAAAGGAAGATTCACCATCAGCCGC<br>GACAATGCTAAGAATACTCTGTACCTCCAGATGAACAGCCTCAAGCCGGAGGAC<br>ACTGCCACATATTACTGCAAGAGAGGTCATGCTTGCGCAGGTTATTACCCGATT<br>CCCTACGACGATTATTGGGGCCAGGGGACCCAGGTTACGGTTTCTAGCGGAGGG<br>AGCGGAGGGTCCGGTGGCAGTGGACAAGTTCAGCTCCAGGAAAGTGGCGGGGGC<br>TCTGTCCAAGCCGGGGGCTCCCTGCGGCTCTCCTGCCGGGCTTCTGGCTCTACT<br>TATTCTAACTATTGCTTGGGTTGGTTCCGTCAATCCACTGGGAAGGAGAGAGAG<br>GGCGTGGCCGTTATAAATTGGGTTGGCGGGATGCTCTACTTCGCTGATTCCGTC<br>AAAGGAAGGTTCACAGTGTCCCAGGACCACGCTAAGAACACTGTGACTCTGCAA<br>ATGAACTCCCTGAAGCCAGAGGACACTGCTATGTATTACTGTGCCGCTGAGAGC<br>GTCTCATCCTTCTCCTGCGGCGGGTGGCTGACCCGTCCTGGCCGTGTGCCTTAC<br>TGGGGGCAGGGCACCCAGGTGACCGTCTCTAGT |
| DR596-<br>hIL27Ra_<br>VH<br>H12 | 1217 | CAGGTGCAACTCCAGGAGAGCGGAGGTGGACTTGTTCAGCCCGGCGGAAGCCTT<br>CGCCTTTCATGCACTGCCAGCGGACTGACGTTCGATGACTCAGTCATGGGCTGG<br>TTCAGGCAGGCCCCCGGTAAGGGCCGCGAAGCCGTGTCTTGTATCTCTAGCTCT<br>GGAGCAAACGCTTTCTACGCGGATTCCGTGAAGGGCCGTTTTACAATTAGCAGA<br>GACAACGCCAAGAATACTCTGTACTTGCAGATGAACTCTCTGAAGCCTGAAGAT<br>ACCGCTACCTATTACTGTAAGAGAGGCCATGCGTGTGCAGGGTATTACCCTATT<br>CCTTACGACGATTACTGGGGTCAAGGAACCCAGGTAACCGTGTCTTCAGGCGGG<br>GGTTCCCAGGTGCAGCTCCAGGAGTCCGGGGAGGCAGTGTGCAAGCAGGCGAG<br>AGCTTGCGTCTGAGTTGCCGCGCTTCCGGTTCAACTTACTCTAACTACTGTCTT<br>GGATGGTTCCGCCAGATCACCGGCAAGGAGCGGGAGGGTGTGGCTGTCATCAAC<br>TGGGTTGGGGGTATGCTTTACTTCGCAGACTCTGTGAAGGGCCGCTTTACCGTA<br>TCACAGGACCAAGCAAAGAACACCGTGACCTGGAGATGAACAGTCTGAAGCCC<br>GAAGACACCGCTATGTACTATTGTGCCACCGAATCCGTCTCTTCCTTCTCCTGT<br>GGAGGCTGGCTGACACGCCCCGACCGGGTGCCCATTGGGGCCAGGGAACTCAG<br>GTCACAGTCTCTAGT |
| DR596-<br>hIL27Ra_<br>VH<br>H12 | 1218 | CAGGTCCAGCTCCAGGAGTCTGGCGGTGGGCTCGTGCAGCCCGGAGGCTCTTTG<br>AGGCTGAGCTGCACCGCGAGCGGCCTGACTTTCGACGATAGTGTGATGGGCTGG<br>TTCCGTCAAGCCCCTGGCAAAGGCCGCGAGGCGGTTAGCTGTATCTCCTCTTCC<br>GGGGCCAATGCCTTCTATGCTGACAGCGTGAAGGGCCGCTTACCATCAGCCGT<br>GACAACGCCAAGAACACTCTTTACCTTCAGATGAACTCCTTGAAGCCGGAGGAC<br>ACCGCGACATACTATTGTAAGCGCGGCCACGCTTGTGCAGGCTATTACCCCATC<br>CCCTATGACGATTATTGGGGACAGGGCACCCAGGTGACCGTCTCCTCGGGGGC<br>AGCGGAGGCTCTGGTGGCTCCGGGCAGGTGCAGCTCCAGGAGTCCGGCGGTGGC<br>TCCGTGCAGGCTGGCGAAAGCCTGCGCCTGTCCTGTCGTGCGTCCGGCAGTACA<br>TATAGCAACTACTGTCTCGGATGGTTCCGTCAAATTACCGGGAAGGAACGCGAG<br>GGAGTGGCCGTTATCAACTGGGTGGGAGGCATGTTGTATTTTGCCGACAGTGTG<br>AAAGGCAGGTTTACAGTGAGCCAGGACCAGGCCAAGAACACGGTGTATCTCGAA<br>ATGAACAGCCTGAAGCCCGAAGACACTGCAATGTATTACTGCGCCACCGAGTCT<br>GTTAGCTCCTTTTCATGTGGTGGGTGGCTGACACGCCCAGACCGCGTGCCATAC<br>TGGGGTCAGGGAACCCAGGTTACCGTGAGTAGT |
| DR596-<br>hIL27Ra_<br>VH<br>H13 | 1219 | CAGGTGCAGTTGCAGGAGTCCGGTGGCGGACTCGTACAGCCAGGAGGTAGCCTT<br>CGCCTGAGTTGCACTGCCTCCGGTCTGACCTTCGATGACTCCGTTATGGGTTGG<br>TTCCGCCAAGCCCAGGGAAGGGCAGAGAAGCTGTCTCTTGTATCAGCTCTAGC<br>GGGGCCAACGCCTTCTACGCAGACTCCGTGAAGGGCCGCTTTACCATCAGTCGT<br>GACAACGCCAAGAATACACTCTATTTGCAAATGAACTCTCTCAAGCCTGAGGAT<br>ACCGCTACGTACTATTGCAAACGTGGACACGCTTGTGCCGGTTATTACCCTATC<br>CCTTACGATGACTACTGGGGCCAGGGCACCCAGGTGACCGTGAGTAGCGGCGGA<br>GGCTCTCAGGTGCAGCTCCAGGAGTCTGGTGGCGGGAGCGTCCAGGCCGGGGC<br>TCTCTGCGCCTGTCCTGCGTGGCTTCCGGGTATGTTCCTGCGATTACTTTCTG<br>CCCTCCTGGTATCGTCAGGCCCCTGGTAAGGAGCGCGAGTTCGTGAGCATCATT |

TABLE 1B-continued

| Name | SEQ ID NO: | Sequence |
|---|---|---|
| | | GATGGCACTGGATCTACTTCTTACGCAGCGAGTGTGAAGGGCCGCTTCACCGCC<br>AGCCAGGATAGGGGAAAAAATATCGCATACCTCCAGATGAACAGCCTGAAGCCT<br>GAGGACACTGCCATGTATTACTGCAAGGCGTCCTGTGTGAGGGGAAGGACTATC<br>AGCGAGTATTGGGGCCAAGGTACGCAGGTGACAGTAAGCTCC |
| DR596-<br>hIL27Ra_<br>VH<br>H13 | 1220 | CAAGTTCAACTTCAGGAGAGTGGTGGAGGCCTGGTGCAGCCAGGGGGTTCCCTC<br>AGGCTCAGCTGTACCGCAAGCGGTCTGACATTTGATGACTCCGTGATGGGATGG<br>TTTGCCCAGGCACCCGGTAAGGGGCGTGAAGCCGTTAGTTGTATTAGTTCCAGC<br>GGAGCCAATGCTTTCTATGCCGACTCCGTGAAGGGTAGATTCACCATCTCCCGT<br>GACAACGCCAAAAACACGCTGTATCTTCAGATGAACTCTCTGAAGCCGGAGGAC<br>ACGGCCACCTATTACTGTAAGCGTGGTCATGCCTGCGCGGGGTATTACCCCATC<br>CCCTACGATGACTACTGGGGGCAGGGAACCCAGGTCACTGTTTCCAGCGGTGGC<br>TCCGGTGGCTCAGGAGGCAGTGGCCAGGTACAGTTGCAAGAGTCTGGCGGAGGC<br>AGCGTTCAGGCTGGCGGGTCCCTCAGACTGTCATGCGTGGCATCTGGGTATGTT<br>TCCTGCGACTACTTCCTTCCCAGTTGGTATCGTCAAGCGCCGGGTAAGGAACGC<br>GAATTTGTGAGTATCATTGATGGGACCGGGTCTACCTCTTACGCCGCGAGCGTG<br>AAGGGCCGCTTCACCGCGTCTCAGGATCGCGGTAAGAACATTGCCTACCTCCAG<br>ATGAACAGTCTGAAACCAGAAGACACCGCTATGTATTACTGCAAGGCGAGCTGC<br>GTGAGAGGCAGAACCATTTCTGAGTATTGGGGACAGGGAACTCAGGTGACCGTG<br>TCTTCA |
| DR596-<br>hIL27Ra_<br>VH<br>H14 | 1221 | CAGGTGCAGCTCCAGGAGTCAGGTGGCGGATTGGTGCAGCCCGGTGGCAGCTTG<br>CGCCTGTCCTGCACAGCGAGTGGCTTGACTTTCGACGATTCCGTCATGGGGTGG<br>TTTAGACAGGCTCCTGGCAAGGGCCGTGAGGCAGTCTCCTGTATCTCTTCCAGT<br>GGTGCTAACGCTTTTTACGCCGATAGTGTTAAGGGGAGATTCACGATCTCTCGC<br>GACAACGCCAAGAATACGCTCTACTTGCAGATGAACTCTCTCAAGCCTGAAGAT<br>ACCGCCACCTATTACTGCAAGCGTGGTCACGCTTGCGCAGGCTATTACCCCATC<br>CCCTACGACGATTACTGGGGCCAGGGCACCCAGGTGACCGTCAGTTCCGGTGGG<br>GGAAGCCAGGTCCAGCTTCAGGAGTCCGGCGGTGGCTCCGTCAGGCAGGTGGC<br>TCCCTGCGCCTGTCTTGCGTGGCTTCTGGGTACGTGAGCTGCGACTACTTTCTC<br>CCCTCTTGGTATCGCCAGGCCCCCGGAAAGGAGCGCGAGTTCGTTTCTATCATT<br>GACGGCACTGCTCCACCAGCTATGCTGCCAGCGTGAAGGCCGCTTTACCGCC<br>AGCCAGGACAAAGGCAAGAACATCGCTTACCTCCAGATGAACTCCCTGAAGCCC<br>GAAGATACCGCGATGTATTACTGTAAGGCTTCATGCGTGCGCGGCAGAGCCATC<br>TCCGAGTACTGGGGCAAGGCACTCAAGTTACAGTCTCTTCA |
| DR596-<br>hIL27Ra_<br>VH<br>H14 | 1222 | CAGGTGCAGTTGCAGGAGAGCGGTGGGGGCCTGGTGCAGCCCGGTGGCTCCCTG<br>CGTCTTTCTTGCACTGCGTCCGGCTTGACTTTTGACGATAGCGTCATGGGCTGG<br>TTCCGCCAGGCCCCTGGCAAAGGACGTGAGGCCGTGAGCTGCATCTCTTCAAGT<br>GGAGCCAACGCATTCTATGCTGACTCCGTGAAAGGCCGCTTCACCATCAGTCGG<br>GACAACGCCAAGAACACCCTCTACTTGCAGATGAACTCCCTGAAGCCCGAGGAC<br>ACCGCCACCTATTACTGTAAGCGCGGCCACGCTTGCGCTGGCTATTACCCGATC<br>CCATACGATGACTACTGGGGACAAGGCACCCAGGTTACCGTGTCTTCCGGGGGC<br>TCTGGTGGCTCAGGGGGCTCTGGCCAGGTCCAACTCCAAGAGTCTGGGGGAGGC<br>TCTGTGCAGGCGGGTGGCTCCCTGCGTCTGAGCTGCGTAGCTTCCGGTTACGTC<br>TCCTGCGATTACTTCCTGCCCTCCTGGTATAGGCAGGCTCCCGGCAAGGAGCGC<br>GAGTTTGTCTCTATTATCGACGGTACAGGCTCTACCTCTTACGCCGCAAGCGTG<br>AAGGGCCGGTTCACAGCCTCTCAGGATAAGGGTAAAAACATCGCCTACTTGCAG<br>ATGAACAGCCTTAAACCAGAGGACACCGCCATGTACTATTGTAAGGCAAGCTGC<br>GTGAGGGGCCGCGCCATCAGCGAGTACTGGGGCCAGGGAACGCAGGTGACCGTC<br>AGCAGC |
| DR596-<br>hIL27Ra_<br>VH<br>H15 | 1223 | CAGGTCCAGCTCCAGGAGTCCGGGGGTGGCCTGGTCCAGCCCGGCGGGTCTCTG<br>AGACTGTCCTGTACGGCAAGCGGGCTGACCTTCGATGACTCCGTCATGGGCTGG<br>TTTCGTCAAGCCCCTGGTAAGGGCCGCGAGGCGGTTTCTTGCATCAGCTCTTCA<br>GGCGCGAATGCGTTCTACGCCGACTCTGTGAAGGGTCGGTTTACTATCAGCCGC<br>GATAATGCGAAGAACACACTGTACTTGCAAATGAACTCCCTGAAGCCTGAGGAC<br>ACAGCCACTTATTACTGCAAACGTGGACACGCCTGCGCTGGCTATTACCCAATC<br>CCTTACGACGATTACTGGGGCCAGGGCACCCAAGTGACCGTGAGTTCCGGCGGT<br>GGCTCCCAAGTCCAGCTCCAGGAAAGTGGTGGCGGGTCCGTGCAGGCGGGAGGC<br>AGCCTTAGGCTCTCTTGCGTCGCCTCTGGGTACGTCTCTTGCGACTATTTCCTC<br>CCTTCCTGGTATCGCCAAGCGCCGGGCAAGGAGCGCGAGTTCGTCTCCATCATT<br>GATGGCACCGGCTCCACCTCCTACGCTGCCTCCGTGAAAGGCCGCTTCACTGCC<br>TCCCAGGACAAGGGGAAAAACATCGCCTACTTGCAGATGAACACCCTTAAACCC<br>GAAGACACGGCCATGTATTACTGTAAAGCGTCCTGCGTGAGGGGAAGAGCAATC<br>TCCGAGTACTGGGGCAGGGGACCCAGGTGACAGTGTCCTCA |
| DR596-<br>hIL27Ra_<br>VH<br>H15 | 1224 | CAGGTGCAGTTGCAGGAGTCCGGTGGCGGACTGGTACAGCCCGGCGGTTCCTTG<br>AGGCTGAGTTGTACCGCTTCCGGCTTGACTTTCGATGACTCAGTGATGGGATGG<br>TTCAGACAAGCGCCCGGTAAGGGTCGCGAGGCGGTCAGTTGCATCAGCTCCAGT<br>GGAGCCAATGCGTTCTACGCTGATTCTGTGAAAGGACGTTTCACCATCTCCAGG<br>GACAATGCTAAGAATACACTGTACCTTCAGATGAACAGCCTGAAGCCTGAAGAT<br>ACAGCTACGTATTACTGCAAGCGCGGACACGCTTGTGCAGGATATTACCCAATT<br>CCTTATGATGACTACTGGGGTCAGGGGACCCAGGTGACTGTATCCAGCGGGGGC<br>TCCGGCGGAAGCGGAGGCAGTGGGCAGGTGCAGCTCCAGGAGTCCGGCGGAGGC<br>TCAGTTCAGGCCGGAGGTTCACTCGACTGTCATGTGTGGCCTCTGGCTACGTG<br>TCCTGTGACTACTTCCTGCCAAGTTGGTATCGGCAGGCCCCTGGCAAGGAGCGG |

TABLE 1B-continued

| Name | SEQ ID NO: | Sequence |
|---|---|---|
| | | GAGTTCGTTAGCATTATCGACGGCACGGGCAGCACCAGTTACGCTGCCTCCGTG<br>AAAGGCAGATTCACAGCATCTCAGGATAAGGGGAAAAATATCGCCTACCTCCAG<br>ATGAACACTCTGAAGCCCGAGGACACCGCCATGTACTATTGTAAGGCTTCATGC<br>GTGAGAGGCCGCGCCATTAGCGAGTACTGGGGCCAGGGAACCCAGGTTACTGTC<br>AGTTCT |
| DR596-<br>hIL27Ra_<br>VH<br>H16 | 1225 | CAGGTGCAGTTGCAGGAATCTGGCGGTGGACTGGTGCAGCCCGGAGGCTCACTG<br>CGCCTCTCTTGTACGGCCAGCGGACTCACTTTCGATGACAGCGTGATGGGGTGG<br>TTCCGCCAGGCCCCTGGCAAAGGCCGCGAGGCTGTCTCCTGTATCTCCAGCAGT<br>GGTGCGAACGCCTTCTACGCTGACTCCGTGAAAGGCCGTTTCACCATCAGCCGT<br>GATAACGCTAAGAACACACTCTACTTGCAGATGAACAGCCTGAAGCCGGAGGAC<br>ACTGCCACCTATTACTGTAAGCGCGGTCACGCATGTGCTGGCTATTACCCTATT<br>CCTTACGACGATTACTGGGGCCAGGGCACCCAGGTTACGGTGTCCTCTGGCGGG<br>GGTAGCCAGGTGCAGCTTCAGGAGTCCGGTGGAGGTTCCGTGCAGGCAGGGGGA<br>AGCCTTAGGCTGAGCTGCCGCGCTTCCGGTTCTACCTACAGCAATTACTGCCTG<br>GGGTGGTTCCGGCAGATTACAGGTAAAGAGCGCGAGGGTGTCGCCGTGATTAAC<br>TGGGTGGGCGGGATGCTTTACTTCGCTGATTCAGTGAAGGGCCGCTTCACTGTG<br>AGTCAGGACCAGGCCAAGAACACAGTGTACCTCCAGATGAACTCCCTTAAACCC<br>GAGGACACTGCAATGTACTATTGCGCTGCCGAGTCAGCGTCCTCTTTCAGTTGC<br>GGCGGATGGCTCACTCGTCCTGACCGTGTCCCTTACTGGGGCCAGGGCACGCAG<br>GTGACCGTCTCCTCC |
| DR596-<br>hIL27Ra_<br>VH<br>H16 | 1226 | CAGGTGCAGTTGCAGGAGAGCGGCGGAGGCCTGGTCCAGCCCGGAGGCAGCCTG<br>AGACTTTCTTGCACAGCTTCCGGGCTTACCTTCGATGACTCCGTCATGGGCTGG<br>TTTCGGCAGGCTCCAGGTAAGGGTAGGGAGGCTGTTAGCTGTATCAGTTCCAGC<br>GGCGCTAATGCCTTCTACGCCGACTCTGTGAAGGGCCGGTTTACCATCAGCAGA<br>GACAACGCAAAAAATACGCTCTACTTGCAGATGAACTCTCTGAAGCCCGAAGAT<br>ACCGCCACCTACTATTGCAAGAGGGGCCACGCCTGCGCCGGTTACTATCCAATC<br>CCATACGATGACTACTGGGGCCAGGGTACTCAGGTGACTGTGTCTTCCGGTGGA<br>AGCGGCGAAGCGGCGGTAGCGGGCAGGTCCAGCTGCAAGAAAGCGGAGGCGGG<br>TCTGTGCAAGCTGGCGGTTCCCTGAGGCTGAGCTGTCGTGCATCAGGCTCAACC<br>TACTCTAACTACTGCTTGGGGTGGTTCCGCCAGATTACCGGCAAGGAGCGCGAG<br>GGCGTGGCCGTCATCAACTGGGTAGGCGGGATGCTGTATTTCGCTGATTCCGTG<br>AAGGGCCGCTTTACCGTCTCACAGGACCAGGCCAAGAACACCGTCTACCTTCAG<br>ATGAACTCCCTGAAACCTGAAGATACTGCCATGTATTACTGTGCAGCGGAGAGC<br>GCCAGCTCCTTCTCCTGTGGAGGGTGGCTGACCCGCCCGGATCGTGTTCCGTAC<br>TGGGGCCAGGGGACTCAAGTGACCGTGTCCTCC |
| DR596-<br>hIL27Ra_<br>VH<br>H17 | 1227 | CAGGTGCAGCTCCAGGAATCAGGGGCGGACTGGTTCAGCCCGGAGGTTCTCTC<br>AGGCTCAGCTGCACTGCCTCCGGGCTTACTTTTGACGATAGCGTTATGGGCTGG<br>TTCCGCCAGGCTCCCGGCAAAGCCGCGAGGCCGTGTCTTGTATCTCCAGCTCC<br>GGTGCCAACGCCTTCTACGCTGACTCCGTGAAGGGACGCTTTACCATCTCACGC<br>GACAACGCGAAGAACACACTTTACCTGCAAATGAACAGCTTGAAACCTGAGGAT<br>ACAGCAACCTACTATTGCAAGCGCGGTCACGCTTGCGCCGGTTATTACCCTATC<br>CCTTACGATGACTACTGGGGTCAGGGTACTCAGGTAACGGTGTCAAGTGGGGGC<br>GGGTCCCAGGTCCAGCTTCAAGAGTCCGGCGGGGACTGGTGCAGCCCGGTGGC<br>TCTCTGAGGCTCTTTGTCTGCGAGCGGATTCACTTTCTCTCTGTCAGGGATG<br>TCTTGGGTGCGTCAAGCACCTGGGAAGGGCCTGGAATGGGTCTCAGCAATCTCC<br>AGCGGCGGTGCTTCCACCTATTACACTGACAGCGTGAAGGGCAGGTTTACCATC<br>TCCAGAGACAACGCCAAGAACATGCTGTATCTCCAGTTGAACTCACTGAAAACC<br>GAGGATACAGCCATGTATTACTGTCCAAAGGAGGGAGCGGCTACGGTGATGCC<br>TCTCGTATGACCAGCCCCGGCTCCCAGGGAACCCAGGTGACGGTGTCTTCC |
| DR596-<br>hIL27Ra_<br>VH<br>H17 | 1228 | CAGGTCCAGCTCCAGGAGTCTGGCGGGGGCCTGGTCCAGCCTGGGGGTAGCCTG<br>AGACTGTCCTGCACTGCTTCTGGTCTTACCTTTGATGACAGCGTGATGGGCTGG<br>TTTAGACAAGCGCCCGGCAAAGGCCGCGAAGCCGTGAGTTGTATCTCCTCTAGC<br>GGCGCGAACGCATTCTACGCTGACTCTGTCAAGGGCCGGTTCACCATTTCCAGG<br>GATAACGCCAAGAACACCCTGTACCTTCAGATGAACAGCCTGAAACCCGAAGAC<br>ACCGCCACTTATTACTGCAAGCGGGGCCACGCCTGTGCTGGCTATTACCCTATT<br>CCTTACGACGATTACTGGGGACAGGGCACCCAGGTAACTGTCTCAGGCGGA<br>AGCGGCGGTTCCGGCGGGTCTGGGCAGGTGCAGTTGCAAGAGTCCGGCGGTGGG<br>CTGGTCCAGCCGGGTGGCTCACTCCGCTTGTCCTGCGCGGCTTCAGGATTTACT<br>TTCAGTCTGAGTGGTATGAGCTGGGTACGCCAGGCACCCGGCAAGGGCCTGGAG<br>TGGGTGTCCGCCATTTCCTCTGGCGGAGCGAGCACATACTATACCGATTCAGTG<br>AAAGGGCGTTTTACTATCTCTCGCGATAATGCCAAGAACATGCTGTACCTCCAG<br>CTCAACTCTCTGAAGACTGAGGACACCGCCATGTACTATTGCGCCAAAGGCGGA<br>AGTGGATACGGTGACGCCTCAAGGATGACTTCCCCTGGTTCCCAGGGCACGCAG<br>GTGACCGTGAGTAGC |
| DR596-<br>hIL27Ra_<br>VH<br>H18 | 1229 | CAGGTGCAGCTCCAGGAATCCGGTGGGGACTCGTCCAGCCAGGCGGGTCACTG<br>CGTCTCTCCTGTACCGCGAGTGGACTGACATTCGATGACTCCGTGATGGGCTGG<br>TTCCGCCAGGCCCCGGCAAGGGCCGCGAGGCGGTGTCTTGCATTTCTAGCTCT<br>GGGGCCAATGCGTTTTACGCTGACTCTGTGAAGGGCAGATTCACTATCAGCAGA<br>GACAACGCGAAGAACACGCTGTATCTGCAAATGAACTCTCTGAAACCCGAGGAT<br>ACTGCCACATACTATTGTAAGCGCGGCCACGCCTGCGCAGGCTACTATCCTATT<br>CCTTACGACGACTACTGGGGCCAGGGAACACAGGTCACCGTTAGCTCAGGGGGA<br>GGCTCCCAGGTGCAGCTCCAGGAGAGCGGAGGTGGCAGCGTCCAGGCTGGCGGA |

TABLE 1B-continued

| Name | SEQ ID NO: | Sequence |
|---|---|---|
| | | TCTCTGCGCCTGTCTTGTGTCGCCAGCGGATACGTGAGCTGTGACTACTTCCTG<br>CCTAGCTGGTATCGTCAAGCGCCGGGGAAGGAAAGGGAGTTCGTGTCCATTATC<br>GACGGTACTGGGTCTACCTCATACGCGGCCTCCGTCAAGGGCCGTTTCACGGCC<br>TCCCAGGACAAGGGGAAAAACATCGCATATCTGCAAATGAACTCTCTGAAGCCT<br>GAGGACACCGCAATGTATTACTGCAAGGCCTCCTGTGTACGCGGACGTGGAATC<br>TCTGAGTATTGGGGCCAGGGGACCCAGGTGACCGTGTCTTCC |
| DR596-<br>hIL27Ra_<br>VH<br>H18 | 1230 | CAGGTGCAGCTCCAGGAATCCGGGGCGGTCTGGTTCAGCCAGGTGGCTCTCTC<br>CGTCTGAGCTGCACCGCTTCCGGTCTCACATTCGACGATTCCGTAATGGGGTGG<br>TTCCGCCAGGCCCCTGGAAAAGGTCGCGAGGCCGTGTCTTGCATTTCTTCCAGC<br>GGGGCGAACGCATTCTACGCAGACTCTGTGAAGGGTCGTTTTACAATCTCCCGC<br>GACAACGCGAAGAACACCCTTTACTTGCAAATGAACTCCCTCAAGCCCGAGGAC<br>ACCGCGACCTACTATTGCAAGCGTGGCCATGCTTGCGCCGGGTATTACCCCATC<br>CCCTATGATGACTACTGGGGACAGGGAACCCAAGTGACAGTTTCTAGCGGAGGC<br>AGTGGTGGCAGCGGTGGGTCCGGCCAGGTGCAGTTGCAAGAGAGTGGCGGAGGC<br>TCTGTCCAAGCTGGCGGTTCCCTCCGCCTGTCCTGCGTGGCCTCTGGCTACGTT<br>AGCTGCGACTATTTCCTGCCTTCATGGTATCGTCAGGCCCCAGGGAAGAAAGG<br>GAGTTCGTTAGCATCATTGATGGAACTGGCTCCACCTCCTACTGCAAGCGTG<br>AAGGGTCGGTTCACCGCCTCCCAGGATAAGGGCAAGAATATCGCTTATTTGCAG<br>ATGAACTCTCTGAAGCCAGAGGATACCGCCATGTACTATTGCAAGGCATCCTGC<br>GTGCGGGGACGCGGGATCAGCGAATATTGGGGCCAGGGAACTCAGGTGACCGTC<br>AGTTCT |
| DR596-<br>hIL27Ra_<br>VH<br>H19 | 1231 | CAGGTTCAGCTCCAGGAAAGCGGAGGCGGTCTCGTACAGCCTGGCGGTTCCCTG<br>AGGCTGTCCTGCACCGCCAGCGGACTCACGTTTGACGATAGTGTAATGGGATGG<br>TTCAGGCAGGCTCCCGGCAAGGGCCGCGAGGCCGTAAGTTGCATCTCCAGCTCA<br>GGTGCCAATGCGTTCTATGCCGACTCCGTGAAGGGTAGATTCACCATCAGCCGT<br>GATAACGCGAAAAACACGCTCTACCTCCAGATGAACTCACTGAAGCCTGAGGAC<br>ACGGCCACATATTACTGCAAGAGGGCCACGCCTGTGCTGGGTATTACCCCATC<br>CCCTATGATGACTACTGGGGCCAGGGGACACAAGTGACCGTCTCCAGCGGGGGC<br>GGAAGCCAGGTGCAGTTGCAGGAATCCGGGGGTGGCAGCGTGCAGGCTGGTGGG<br>TCTCTCAGGCTCAGTTGTAGGGCCTCTGGTTCCACCTACAGCAACTACTGTCTG<br>GGCTGGTTCCGTCAGATCACTGGTAAAGAGAGGGAGGGCGTGGCAGTCATCAAC<br>TGGGTTGGCGGAATGTTGTATTTCGCTGACTCTGTCAAGGGCAGATTCACCGTC<br>TCCCAGGATCAGGCTAAGAACACAGTATACTTGCAGATGAACTCCCTGAAGCCC<br>GAGGATACTGCTATGTATTACTGTGCCGCAGAAAGCGTGTCCTCTTTTCTCTTGC<br>GGTGGCTGGCTGACACGCCCTGACAGAGTCCCTTATTGGGTCAGGGGACCCAG<br>GTAACGGTATCTTCC |
| DR596-<br>hIL27Ra_<br>VH<br>H19 | 1232 | CAGGTCCAGCTGCAAGAAAGCGGCGGAGGCCTGGTGCAGCCTGGCGGTTCTCTC<br>CGTCTGAGCTGTACCGCCTCTGGCCTGACATTCGATGACTCCGTTATGGGTTGG<br>TTCCGCCAAGCGCCTGGGAAAGGAAGGGAGGCAGTGAGCTGTATTTCTAGCTCT<br>GGAGCCAATGCTTTCTATGCTGATAGCGTGAAGGGGCGGTTCACTATCTCAAGG<br>GACAACGCCAAGAATACACTGTATCTTCAGATGAACAGCCTGAAGCCAGAGGAT<br>ACAGCCACCTATTACTGTAAGCGCGGACATGCCTGTGCTGGCTATTACCCGATT<br>CCCTACGACGATTACTGGGGCAAGGAACTCAGGTTACTGTGAGTTCCGGGGGC<br>TCTGGGGGCTCAGGCGGTTCCGGCCAGGTACAACTCCAGGAGAGCGGCGGAGGC<br>TCCGTACAGGCCGGGGGCAGCCTGAGACTGAGCTGTCGCGCGAGCGGCAGTACC<br>TACAGCAATTACTGCCTGGGGTGGTTCCGCCAGATTACTGGGAAGGAGCGGGAA<br>GGCGTCGCAGTGATAAATTGGGTCGGTGGAATGCTCTACTTCGCCGATAGCGTC<br>AAGGGACGCTTCACCGTGAGTCAGGATCAGGCCAAAAACACCGTTTATCTTCAG<br>ATGAACTCCTTGAAGCCGGAAGACACAGCAATGTACTATTGCGCCGCTGAAAGT<br>GTCTCCAGCTTCAGCTGCGGAGGGTGGCTCACCCGCCCGGATCGCGTGCCTTAC<br>TGGGGGCAGGGCACCCAGGTCACTGTGTCCTCT |
| DR596-<br>hIL27Ra_<br>VH<br>H20 | 1233 | CAGGTGCAGTTGCAGGAGTCCGGGGGAGGCCTCGTGCAGCCTGGGGGCTCCCTG<br>CGCCTCTCTTGTACTGCGTCAGGTCTGACTTTTGACGATTCTGTTATGGGATGG<br>TTCCGGCAAGCGCCCGGCAAGGGCCGCGAGGCGGTGAGTTGCATCTCCAGCTCT<br>GGCGCAAACGCTTTCTATGCTGACAGTGTGAAGGGCCGTTTTACAATTTCCAGG<br>GACAATGCCAAGAATACACTGTACCTCCAGATGAACAGTCTGAAACCCGAAGAT<br>ACCGCAACCTATTACTGCAAGCGCGGCCACGCTTGCGCCGGATACTATCCAATC<br>CCCTATGATGACTACTGGGGCCAGGGCACGCAGGTCACCGTGAGTAGCGGGGGT<br>GGCTCCCAGGTTCAGCTTCAGGAGTCAGGTGGAGGCCTGGTTCAGCCAGGTGGC<br>AGCCTGCGCTTGAGCTGCGCGGCCAGCGGTTTCACCTTTAGCTCTTACCCGATG<br>TCTTGGGTCAGACAGGCTCCCGGCAAGGGCCTGGAGTGGGTGTCTACCATCTCT<br>TCCGGGGGCGATACCACTCTGTACGCGATTCCGTGAAAGGTCGCTTTACCTCC<br>TCTAGGGATAATGCTAAAAATACGCTGTACCTCCAGCTTAATTCCCTGAAGACA<br>GAAGATACCGCCATGTATTACTGCGCGAAGCGCATCGACTGCAACTCCGGGTAC<br>TGTTACAAACGCAGCTATTGGGGCCAGGGAACACAGGTGACCGTGTCCTCC |
| DR596-<br>hIL27Ra_<br>VH<br>H20 | 1234 | CAGGTGCAACTTCAGGAATCCGGCGGGGGCTTGGTGCAGCCAGGCGGGTCTCTC<br>CGCCTGTCCTGCACGGCCTCTGGCCTGACCTTTGACGATTCCGTGATGGGCTGG<br>TTTCGCCAAGCGCCAGGCAAGGGCGGGAGGCCGTTAGTTGCATCAGTTCCTCT<br>GGAGCCAACGCTTTCTACGCCGACTCCGTCAAGGGCCGTTTCACCATCAGCAGA<br>GACAACGCCAAGAATACACTGTATCTCCAGATGAACAGCCTCAAACCGGAGGAC<br>ACGGCCACCTACTATTGTAAGCGCGGTCACGCATGTGCGGGTATTACCCAATC<br>CCGTATGATGACTACTGGGGTCAGGGCACCCAGGTCACCGTTAGCTCCGGTGGA |

TABLE 1B-continued

| Name | SEQ ID NO: | Sequence |
| --- | --- | --- |
| | | TCTGGCGGAAGCGGGGGCAGCGGACAGGTCCAGCTCCAGGAGAGCGGCGGGGGA<br>CTGGTTCAGCCTGGCGGGTCTCTGCGTCTGTCCTGCGCCGCTTCAGGCTTCACC<br>TTTTCATCTTATCCGATGTCCTGGGTCAGACAAGCCCCAGGTAAGGGGCTGGAG<br>TGGGTTTCTACGATTAGCTCTGGTGGCGATACCACACTGTACGCGGACAGCGTG<br>AAGGGGCGGTTCACCAGCTCAAGACAACGCCAAAAACACCTTGTACCTCCAG<br>CTGAACTCCCTGAAGACCGAGGACACCGCCATGTATTACTGCGCCAAGAGAATT<br>GACTGTAACAGCGGTTATTGTTATAAAAGATCCTACTGGGGCCAGGGAACCCAG<br>GTGACAGTCAGTTCT |
| DR596-<br>hIL27Ra_<br>VH<br>H21 | 1235 | CAGGTGCAGTTGCAGGAGAGCGGTGGAGGCCTGGTCCAGCCAGGTGGCTCTCTG<br>CGGCTGAGCTGCACCGCTTCTGGTCTGACCTTTGATGACAGCGTGATGGGGTGG<br>TTCCGCCAGGCTCCCGGAAAGGGGCGCGAAGCTGTGTCCTGCATCAGCTCCTCT<br>GGTGCCAACGCCTTTTACGCTGATTCCGTGAAGGGTCGCTTCACCATTAGCCGC<br>GACAACGCAAAGAATACCCTCTACTTGCAGATGAACAGCTTGAGCCCGAGGAC<br>ACAGCGACCTATTACTGTAAGCGCGGCCATGCGTGCGCAGGCTACTATCCGATC<br>CCCTATGATGACTACTGGGGCCAGGGAACCCAGGTGACTGTCTCTTCCGGTGGC<br>GGTTCCCAGGTCCAGCTTCAGGAGAGCGGTGGCGGACTGGTTCAGCCCGGCGGG<br>AGCCTCAGGTTGAGCTGTGCCGCTAGTGGCTTCACCTTCTCCCTCTCTAGCATG<br>AGCTGGGTTCGTCAGGCCCCAGGCAAAGGGCTCGAATGGGTCAGCGCAATCTCC<br>AGCGGGGGTGCCTCCACCTATTACACAGACTCTGTGAAAGGAAGATTCACTATC<br>TCACGTGACAATGCTAAAAACATGCTGTACCTTCAGCTGAACAGCCTGAAGACC<br>GAGGATACCGCTATGTACTATTGTGCCAAGGGTGGCTCCGGCTATGGCGACGCA<br>TCACGCATGACCTCTCCGGGCTCCCAAGGAACCCAAGTTACCGTATCTTCA |
| DR596-<br>hIL27Ra_<br>VH<br>H21 | 1236 | CAGGTGCAGCTCCAGGAGTCCGGTGGAGGCCTGGTACAACCCGGCGGTTCCCTG<br>CGCCTGTCCTGCACAGCAAGCGGGCTTACTTTTGATGACAGTGTCATGGGATGG<br>TTCCGCCAAGCGCCCGGTAAGGGCAGGGAGGCTGTCAGCTGTATCAGTTCCAGC<br>GGGGCTAATGCGTTTTATGCCGATAGTGTCAAGGGCCGGTTTACCATCAGCCGC<br>GACAACGCCAAAAACACCCTGTATTTGCAGATGAATAGCCTCAAACCAGAGGAC<br>ACAGCGACCTATTACTGTAAGCGCGGTCATGCGTGCGCGGGCTATTACCCGATT<br>CCTTACGACGATTATTGGGGACAGGGCACCCAGGTGACCGTCAGCTCCGGTGGC<br>AGTGGCGGTTCCGGTGGCTCCGGCCAGGTGCAGCTTCAGGAGAGCGGTGGCGGG<br>CTGGTGCAGCCCGGAGGTTCCCTCCGCCTGTCCTGTGCTGCCAGCGGCTTCACA<br>TTTTCCCTGTCATCCATGAGCTGGGTGCGCCAGGCACCCGGTAAGGGACTGGAA<br>TGGGTTTCTGCGATTTCTTCCGGCGGTGCCTCCACCTACTATACCGATAGCGTC<br>AAGGGGCGGTTTACGATTTCCAGAGACAACGCCAAGAATATGCTGTACCTTCAG<br>CTCAATTCTCTTAAAACCGAGGACACCGCCATGTATTACTGTGCTAAGGGGGC<br>TCTGGATATGGTGATGCCTCACGCATGACATCCCCTGGATCTCAGGGCACCCAG<br>GTAACCGTGTCCTCA |
| DR596-<br>hIL27Ra_<br>VH<br>H22 | 1237 | CAGGTCCAACTCCAGGAGAGCGGTGGAGGCTTGGTGCAGCCCGGCGGGTCCCTG<br>CGGCTGTCTTGCACTGCTAGTGGACTGACCTTCGACGATTCCGTGATGGGGTGG<br>TTCCGCCAAGCTCCGGGAAAGGGCCGCGAGGCCGTGAGTTGCATTTCTTCCAGT<br>GGTGCAAACGCCTTTTATGCGGACAGCGTTAAAGGACGGTTCACCATCTCACGC<br>GATAACGCGAAGAATACACTGTATCTTCAGATGAACTCCCTGAAGCCCGAGGAT<br>ACCGCTACCTACTATTGTAAGAGGGGTCATGCGTGTGCGGGATACTATCCAATC<br>CCGTATGACGATTATTGGGGTCAAGGCACTCAGGTTACTGTGTCTTCCGGTGCA<br>GGGTCCCAGGTGCAGTTGCAGGAGTCAGGAGGCGGTAGCGTGCAGGCCGGAGGG<br>AGCCTGCGCCTGTCTTGTCGCGCATCCGGGAGCACATATTCAAATTATTGTCTC<br>GGGTGGGTTCCGCCAAACCACAGGCAAGGAACGGGAGGGCGTGGCTGTAATCAAC<br>TGGGTCGGTGGAATGCTCTACTTTGCTGACTCTGTGAAAGGCCGCTTCACTGTC<br>TCCCAGGACCAGGCCAAGAACACCGTTTATCTTCAGATGAACTCCCTGAAGCCC<br>GAAGACACCGCCATGTATTACTGCGCTGCCGAGAGCGTCTCCAGCTTCTCCTGC<br>GGCGGATGGCTGACCCGTCCTGATAGAGTGCCCTATTGGGGCCAAGGCACCCAG<br>GTTACCGTGTCCAGC |
| DR596-<br>hIL27Ra_<br>VH<br>H22 | 1238 | CAGGTGCAGCTCCAGGAGAGTGGCGGGGGCTTGGTGCAGCCAGGCGGATCTCTG<br>AGGCTGTCTTGCACAGCGAGCGGCCTGACATTCGATGACTCCGTGATGGGCTGG<br>TTTCGCCAGGCCCCCGGCAAGGGCCGCGAGGCCGTCTCCTGTATCAGTTCATCT<br>GGAGCAAACGCCTTTTACGCTGATTCCGTGAAGGGACGCTTTACCATTAGCCGG<br>GACAACGCCAAGAACACCCTCTACCTCCAGATGAACGCCTGAAGCCTGAAGAT<br>ACCGCAACGTATTACTGTAAGAGAGGCCATGCTTGTGCGGGTTACTATCCAATC<br>CCCTATGACGATTACTGGGGTCAGGGCACCCAAGTCACCGTGTCTAGCGGAGGG<br>TCTGGAGGCTCCGGCGGTAGCGGTCAGGTGCAGCTCCAGGAATCTGGTGGCGGA<br>AGCGTGCAGGCGGGCGGTAGCCTGCGCCTGAGCTGTCGCGCCAGCGGTAGCACC<br>TACAGCAATTATTGTCTCGGCTGGTTTCGTCAGACCACTGGCAAGGAACGGGAA<br>GGCGTTGCCGTTATCAACTGGGTGGGCGGTATGCTGTACTTCGCCGATAGTGTG<br>AAGGGTCGCTTCACCGTGTCCCAGGACCAGGCTAAGAACACTGTGTATCTCCAG<br>ATGAACTCCTTGAAGCCCGAGGACACCGCGATGTACTATTGCGCCGCTGAGTCT<br>GTCAGCTCTTTTTCCTGCGGCGGTGCTGACGCGGCCCGACCGGGTGCCATAT<br>TGGGGCCAAGGTACTCAGGTGACCGTTAGCAGT |
| DR596-<br>hIL27Ra_<br>VH<br>H23 | 1239 | CAGGTGCAGCTTCAGGAATCCGGCGGAGGCCTGGTGCAACCTGGAGGTAGCTTG<br>CGTCTGTCATGCACAGCCAGTGGACTTACTTTCGACGATAGCGTGATGGGTTGG<br>TTCCGGCAGGCTCCTGGCAAGGGCCGTGAGGCCGTGAGCTGCATCTCCAGCTCC<br>GGTGCCAATGCCTTTTACGCTGATTCCGTCAAAGGACGGTTCACTATCTCCCGC<br>GATAACGCCAAAAACACATTGTATCTCCAGATGAATAGTCTGAAGCCGGAGGAT |

TABLE 1B-continued

| Name | SEQ ID NO: | Sequence |
|---|---|---|
| | | ACCGCAACCTATTACTGCAAGCGCGGCCACGCTTGCGCAGGATACTATCCTATC CCTTATGACGATTATTGGGGACAGGGAACACAAGTGACGGTGTCCTCTGGCGGA GGTTCCCAGGTGCAGTTGCAGGAGTCTGGGGGCGGGTCCGTCCAGGCCGGAGGC AGCCTGCGCCTTTCCTGTCGCGCCAGCCGCTCCCCCTACGGGAACTATTGTCTG GGCTGGTTTCGCCAGTCCACTGGTAAGGAAAGAGAGGGCGTAGCCGTGATAAAT TGGGTCGGGGGTATGTTGTACTTCGCTGACAGCGTTAAGGGAAGATTCACCGTG AGCCAGGATCACGCGAAGAACACCGTCACCCTCCAGATGAACTCTCTCAAGCCT GAGGATACAGCTATGTATTACTGTGCCGCTGAGTCCGTTAGCTCCTTTTCATGC GGCGGATGGCTGACCCGCCCCGACCGTGTCCCCTATTGGGGCCAGGGCACCCAA GTTACTGTGAGTTCT |
| DR596-hIL27Ra_VH H23 | 1240 | CAAGTGCAGCTCCAGGAGTCTGGGGGCGGTCTTGTTCAGCCAGGAGGCTCTTTG CGGCTGTCCTGTACCGCTTCCGCCCTGACATTCGATGACTCTGTCATGGGGTGG TTCAGACAAGCCCCTGGGAAGGGACGCGAAGCCGTGAGCTGCATCTCTAGCTCT GGGGGCTAACGCCTTTTACGCGGACTCCGTGAAAGGAAGATTCACCATCTCCAGA GACAACGCCAAGAACACACTCTACCTCCAGATGAACTCCCTGAAACCCGAGGAC ACCGCCACCTATTACTGCAAGCGCGGCCATGCGTGCGCGGGCTATTACCCTATT CCTTATGATGACTACTGGGGCAGGGGACACAGGTGACCGTTTCTAGCGGCGGT TCCGGTGGCTCCGGCGGTTCTGGGCAGGTCCAGCTCCAGGAGAGCGGTGGAGGC TCAGTGCAGGCTGGGGGCTCACTGAGACTGTCCTGCCGCGCCTCCCGCTCTCCG TATGGCAACTACTGCCTTGGCTGGTTTCGCCAGAGCACTGGTAAGGAACGTGAG GGAGTCGCCGTCATCAACTGGGTGGGAGGGATGCTGTATTTCGCTGACAGCGTG AAGGGCCGCTTCACTGTGTCCCAGGACCACGCGAAGAACACAGTGACCCTGCAA ATGAATAGTCTCAAACCAGAAGACACTGCTATGTATTACTGTGCTGCCGAATCC GTCAGCTCTTTCAGCTGCGGTGGATGGCTGACAAGGCCAGATCGGGTGCCTTAC TGGGGTCAGGGCACCCAGGTGACCGTTAGCAGC |
| DR596-hIL27Ra_VH H24 | 1241 | CAGGTGCAGTTGCAGGAATCCGGGGGCGGATTGGTGCAACCTGGGGGCTCCCTG CGCTTGTCCTGTACTGCAAGCGGACTGACCTTCGATGACTCTGTTATGGGCTGG TTTCGCCAAGCTCCGGGTAAAGGAGGGAAGCAGTGTCCTGTATCAGCTCCAGC GGGGCCAATGCTTTCTACGCGGATAGCGTGAAGGGTCGTTTTACTATTAGCCGC GACAATGCAAAGAACACCCTGTACTTCAGATGAACTCACTCAAGCCCGAAGAT ACAGCCACTTACTATTGTAAGCGCGGCCACGCCTGCGCCGGATATTACCCAATC CCTTACGATGACTACTGGGGCCAGGGCACACAGGTTACCGTGAGTTCTGGCGGT GGCAGTCAGGTGCAGCTCCAGGAGAGCGGGGGTGGCTTGGTGCAGCCGGGAGGC TCTCTGAGGCTGTCCTGTGCTGCCTCAGGTTTCACCTTTTCCCACTCCGGCATG TCCTGGGTGCGCCAGGCCCCCGGCAAGGGTCTGGAATGGGTGAGTACCATCAAC AGTGGGGCGCAAGTACCTACTATACCGACTCTGTTAAGGGACGCTTCACTATC AGCCGCGACAACGCTAAGAACATGCTGTACCTCCAGTTGAACAGCCTTAAAACC GAAGACACGGCCATGTATTACTGCGCGAAAGGGGGCTCTGGCTACGGCGACGCG AGCAGGATGACCAGTCCCGGTTCCCAGGGCACACAGGTGACTGTTAGCAGC |
| DR596-hIL27Ra_VH H24 | 1242 | CAGGTGCAGTTGCAGGAATCTGGGGGTGGCCTGGTGCAACCTGGGGGCAGCCTG CGCCTGAGCTGCACCGCCAGCGGTCTGACCTTCGACGATTCCGTGATGGGATGG TTCCGCCAGGCTCCTGGAAAGGGAAGGGAAGCTGTGAGCTGCATCAGCTCATCC GGCGCGAACGCCTTCTACGCCGATTCTGTGAAGGGCCGTTTTACCATCAGCAGA GACAACGCCAAGAACACTCTTTATTTGCAGATGAACTCCCTGAAACAGAGGAT ACAGCAACCTATTACTGTAAGAGGGGTCACGCCTGCGCCGGTTATTACCCCATT CCGTATGACGATTACTGGGGACAGGGCACCCAGGTAACCGTGTCCTCAGGTGGC AGTGGTGGCTCCGGCGGGAGCGGTCAGGTGCAACTCCAGGAGAGCGGCGGGGGC CTGGTCCAGCCCGGTGGCTCCCTGCGTCTGTCCTGCGCGGCCTCTGGGTTCACT TTCAGCCATTCCGGCATGAGCTGGGTCCGCCAGGCCCCTGGCAAGGGTCTGGAG TGGGTTAGCACGATCAACTCAGGCGGGGCCAGCACTTATTACACCGACTCCGTG AAGGGACGCTTCACCATCTCTCGTGACAATGCTAAGAACATGCTGTATTTGCAG CTGAACTCCCTGAAGACTGAGGACACTGCCATGTACTATTGCGCCAAAGGTGGG TCCGGTTACGGTGACGCGAGCAGAATGACCTCACCTGGGAGCCAGGGCACGCAG GTGACCGTGTCCTCT |
| hIL27Ra_VH H1-DR591 | 1243 | CAGGTGCAGCTGCAAGAGTCTGGCGGGGGCCTGGTGCAGCCTGGAGGCAGCCTG CGCCTGAGCTGTGCGGCATCAGGATTCACGTTTAGCTCCTACCCTATGTCTTGG GTCAGACAGGCACCGGGAAAGGGTTTGGAGTGGATCTCCACAATTTCCGCTGGT GGCGACACCACTCTCTACGCTGATTCTGTGAAGGGCCGCTTCACCTCATCTCGC GACAACGCTAAGAACACCTTGTACCTGCAACTGAACTCTCTCAAGACCGAGGAC GCCGCAATTTACTATTGCGCCAAGCGTATTGATTGCAATTCCGGTTACTGCTAC CGTAGGAACTACTGGGGCCAGGGTACTCAGGTCACAGTGTCTAGTGGTGGCGGT TCCCAAGTGCAGCTCCAGGAATCTGGAGGTGGGTCTGTGCAGGCTGGAGGCAGC CTGAGGCTGAGCTGTACCGCATCCGGGGCAATCGCCTCTGGCTACATCGACTCC CGCTGGTGCATGGCCTGGTTTCGCCAGGCTCCCGGCAAAGAGCGCGAGGGCGTG GCCGCAATCTGGCCTGGCGGGGCCTGACCGTTTATGCCGACAGCGTCAAGGGA CGCTTCACTATTAGCCGGGACCACGCTAAAAACACACTGTACCTTCAGATGAAT AACCTCAAACCGGAGGACACTGCGATGTACTATTGCGCGGCAGGATCACCCCGC ATGGTGTCCCTCCCTGGAGTTCGGTTTCGATTACTGGGGGCAGGGCACCCAGGTT ACCGTAAGTTCC |

TABLE 1B-continued

| Name | SEQ ID NO: | Sequence |
|---|---|---|
| hIL27Ra_VH H1-DR591 | 1244 | CAAGTCCAGCTCCAAGAGAGCGGCGGTGGCCTGGTGCAACCTGGGGGCTCCCTG CGCCTGTCTTGCGCTGCATCCGGGTTCACCTTCTCTAGCTACCCGATGTCTTGG GTGCGTCAGGCTCCGGGTAAGGGCCTGGAATGGATCAGTACCATCTCAGCCGGA GGCGATACCACTCTGTATGCCGATTCTGTGAAAGGCCGCTTTACCTCCAGCCGT GATAACGCAAAGAACACTTTGTACCTCCAGCTGAACTCATTGAAGACTGAGGAT GCGGCCATTTATTACTGTGCAAAACGCATTGATTGTAATTCCGGCTACTGCTAC CGCCGTAACTATTGGGGTCAAGGTACACAGGTAACCGTGTCCAGTGGTGGCTCT GGCGGTAGTGGTGGGTCTGGCCAGGTGCAGCTTCAGGAAAGTGGTGGAGGTAGC GTGCAAGCTGGAGGCTCCCTGAGGCTCAGCTGTACCGCCTCTGGAGCAATCGCC TCCGGCTACATCGACAGCGCTGGTGCATGGCTTGGTTCCGCCAGGCTCCAGGG AAGGAGAGGGAAGGTGTGGCTGCAATTTGGCCTGGAGGGGGCTTGACGGTGTAT GCTGATAGCGTCAAGGGACGCTTCACCATTTCCAGGGATCACGCGAAAAACACC CTGTACCTGCAAATGAATAACCTGAAACCCGAGGACACCGCAATGTATTACTGC GCTGCGGGTTCCCCGCGCATGTGTCCTTCTCTGGAGTTCGGGTTCGATTACTGG GGGCAGGGTACACAAGTGACTGTGTCCTCT |
| hIL27Ra_VH H1-DR592 | 1245 | CAGGTGCAGCTCCAGGAATCAGGCGGTGGACTGGTCCAACCCGGAGGGTCCCTG CGGCTTTCCTGCGCCGCAAGCGGATTTACTTTCTCCTCTTACCCAATGAGCTGG GTGCGCCAAGCGCCAGGGAAGGGTCTGGAGTGGATCTCTACAATTAGTGCGGGC GGTGACACCACACTCTACGCTGACAGCGTCAAGGGTCGGTTTACCTCCTCTCGC GACAACGCCAAGAACACTCTGTATCTTCAGCTGAACTCCCTGAAAACCGAAGAC GCGGCAATTTACTATTGCGCTAAGCGGATCGACTGCAACTCCGGCTACTGTTAC CGTCGGAACTACTGGGGCCAGGGCACACAAGTTACCGTCAGCTCCGGTGGCGGT TCACAAGTACAGCTCCAGGAGTCCGGCGGGGGCAGTGTGCAGGCTGGTGGCTCC CTGCGCCTGTCCTGCACGGCTCCCGGCTTCACGTCAACTCATGCGGTATGGAT TGGTATCGGCAGGCTCCTGGAAAGGAACGCGAATTTGTGAGTTCAATTTCTACT GACGGCACCACGGGCTACGCTGACAGCGTCAAGGGCAGATTTACTATTTCCAAA GATAAGGCCAAGGATACCGTGTATCTCCAAATGAATAGCTTGAAGCCTGAGGAT ACGGGGATGTACTCTTGCAAGACCAAGGACGGCACCATCGCAACTATGGAACTC TGTGATTTCGGCTATTGGGGGCAAGGGACACAGGTGACCGTCAGCTCT |
| hIL27Ra_VH H1-DR592 | 1246 | CAAGTACAGCTTCAGGAGTCTGGCGGGGGCCTCGTCCAGCCCGGAGGCAGCCTG CGGTTGTCCTGTGCCGCATCCGGGTTCACCTTCTCCTCTTACCCAATGTCTTGG GTGCGCCAGGCCCCAGGTAAGGGATTGGAGTGGATCTCCACCATCTCTGCGGGC GGAGACACGACTCTTTACGCCGACAGCGTTAAGGGCCGGTTTACCTCTTCCCGC GATAACGCCAAAAACACTCTGTATCTTCAGCTGAACAGTCTGAAGACCGAGGAT GCCGCTATTTATTACTGTGCTAAGCGCATCGACTGCAACAGCGGATATTGCTAC CGGAGGAACTACTGGGGCAGGGCACCCAGGTTACTGTCAGCTCAGGCGGTTCC GGGGGCTCTGGGGGCTCCGGGCAGGTGCAGCTCCAGGAGTCCGGCGGAGGCAGT GTCCAAGCAGGAGGTTCACTGCGTCTGTCCTGTACCGCCCCCGGTTTTACATCA AACTCATGTGGCATGGACTGGTATCGCCAGGCCCCCGGTAAGGAACGCGAATTT GTCTCAAGCATTTCCACTGACGGCACCACTGGTTACGCTGACTCCGTGAAGGGC CGTTTCACAATCTCCAAGGACAAGGCCAAGGACACCGTGTACCTTCAGATGAAC AGCTTGAAGCCAGAAGACACGGGTATGTACTCTTGCAAGACCAAGGACGGGACC ATCGCTACAATGGAGTTGTGTGACTTCGGTTACTGGGGGCAGGGCACGCAAGTC ACCGTTTCCTCC |
| hIL27Ra_VH H1-DR593 | 1247 | CAGGTTCAGCTCCAGGAAAGTGGAGGCGGTCTCGTGCAGCCGGGCGGATCTCTT AGACTGAGCTGTGCGGCCAGCGGCTTCACTTTCTCTAGCTACCCCATGTCCTGG GTGCGGCAGGCTCCGGGTAAGGGCCTGGAGTGGATCTCCACCATTTCCGCAGGA GGCGATACTACCCTGTATGCCGACTCTGTCAAAGGCCGCTTCACCTCATCCCGC GACAACGCCAAGAACACTCTGTACCTCCAGCTCAACTCCCTGAAGACCGAAGAC GCCGCTATCTACTATTGTGCCAAGCGCATCGACTGTAATTCCGGCTACTGTTAT AGACGTAACTACTGGGGTCAGGGAACACAGGTTACTGTGTCCTCTGGCGGAGGT TCTCAGGTTCAGCTTCAGGAGTCAGGTGGAGGTTCTGTGCAGGCAGGCGGGAGC TTGAGACTCTCCTGTGCGGCCAGCGGATACCCTTACTCAAATGGCTATATGGGA TGGTTCAGGCAGGCTCCCGGAAAGGAGAGGGAGGCGTGGCGACTATCTACACA GGGGACGGTAGGACTTATTACGCAGACAGCGTCAAAGGGAGGTTTACTATCTCA CGTGACAATGCGAAGAACACAGTGGACCTCCAAATGTCCAGCCTGAAGCCAGAG GATACTGCCATGTATTACTGTGCAGCTAGGGCGGCACCCCTCTACTCTAGTGGC TCTCCCTTGACACGGGCGAGGTACAATGTTTGGGGTCAGGGGACCCAGGTGACT GTGTCCTCA |
| hIL27Ra_VH H1-DR593 | 1248 | CAGGTCCAGTTGCAGGAAAGTGGAGGCGGACTCGTGCAACCCGGAGGCAGCCTC CGTTTGTCCTGTGCGGCTTCACGTTCAGCTCCTACCCAATGTCTTGG GTGCGGCAAGCGCCCGGCAAGGGGCTTGAGTGGATCTCTACAATCAGCGCAGGA GGTGATACTACCCTGTATGCCGACTCTGTCAAGGGCAGATTCACCTCCAGCCGC GACAACGCCAAGAACACCCTTTATCTCCAACTGAACAGCCTCAAGACCGAAGAT GCCGCGATTTACTATTGTGCTAAGCGCATTGACTGCAACTCCGGCTATTGCTAC AGGCGCAACTACTGGGGCCAGGGCACTCAGGTGACTGTGTCCAGCGGCGGTTCT GGAGGCTCCGGGGGCAGCGGCCAGGTGCAGCTCCAGGAGTCTGGTGGAGGCTCC GTTCAGGCCGGAGGTTCCCTTCGCCTGTCTTGTGCTGCAAGCGGCTACCCATAC TCTAACGGCTACATGGGCTGGTTCCGGCAAGCGCCGGGTAAGAACGCGAAGGG GTGGCCACGATCTACACCGGGGATGGCAGAACCTATTACGCCGATAGCGTGAAG GGTCGTTTCACTATTTCCCGTGACAATGCGAAGAACACCGTGGACCTCCAGATG AGTTCCTTGAAGCCTGAGGATACAGCTATGTACTATTGCGCCGCTCGCGCAGCC |

TABLE 1B-continued

| Name | SEQ ID NO: | Sequence |
|---|---|---|
| | | CCACTCTATTCCAGCGGTAGTCCCCTGACCCGTGCTCGCTACAACGTATGGGGA<br>CAGGGTACACAGGTGACTGTGTCCTCC |
| hIL27Ra_<br>VH<br>H1-<br>DR594 | 1249 | CAGGTCCAGCTCCAGGAATCCGGTGGGGGCCTCGTGCAGCCCGGAGGTTCTCTG<br>CGCCTGTCTTGTGCCGCGAGCGGATTTACTTTCAGCTCCTACCCCATGTCCTGG<br>GTGCGTCAAGCCCCAGGTAAGGGGCTGGAGTGGATTTCTACTATTAGCGCTGGA<br>GGCGACACAACCCTGTATGCCGACAGCGTGAAGGGTCGCTTTACTTCTAGCCGC<br>GACAATGCAAAGAACACACTGTACCTTCAGCTCAACTCCCTGAAAACTGAAGAC<br>GCGGCCATCTATTACTGCGCCAAGCGGATTGATTGTAACAGCGGATATTGCTAC<br>AGACGCAACTACTGGGGACAGGGGACCCAGGTGACAGTGTCAAGCGGGGGCGGG<br>TCTCAGGTGCAGCTTCAGGAGAGCGGGGGAGGCAGCGTCCAGGCTGGTGGCTCC<br>CTGAGGCTTTCTTGTGTGGCCTCCGCCAGTACCTACTGCACCTATGATATGCAC<br>TGGTATCGGCAAGCGCCGGGCAAAGGGAGAGAGTTTGTGTCCGCTATCGACTCA<br>GATGGCACAACCAGATACGCCGATAGCGTTAAGGGCAGGTTCACTATCAGTCAG<br>GGGACCGCTAAGAACACCGTGTATCTCCAGATGAATAGCCTCCAGCCAGAGGAT<br>ACCGCCATGTACTATTGTAAGCAGTGTGTGTTGTCGGATCACGCTGGAGCGAC<br>TACTGGGGACAGGGCACCCAGGTGACCGTGTCCTCT |
| hIL27Ra_<br>VH<br>H1-<br>DR594 | 1250 | CAGGTCCAGTTGCAAGAATCCGGCGGTGGCCTCGTGCAGCCTGGCGGGTCACTG<br>CGTTTGTCTTGTGCCGCTAGTGGCTTCACATTTAGCTCCTACCCCATGAGCTGG<br>GTCCGGCAGGCCCCTGGCAAAGGCCTGGAGTGGATCAGTACCATCTCCGCAGGG<br>GGCGACACAACCCTGTATGCGGACTCTGTGAAGGGTAGATTCACATCATCCAGG<br>GACAACGCCAAGAACACACTTTATCTCCAGCTTAACTCTCTGAAGACAGAGGAT<br>GCAGCCATCTACTATTGCGCTAAGCGTATCGACTGCAACTCCGGTTATTGTTAC<br>CGTCGCAATTACTGGGGACAGGGAACACAGGTGACTGTTTCCTCTGGAGGCTCC<br>GGTGGCTCCGGGGGCAGCGGCCAGGTGCAGCTCCAGGAGTCTGGAGGCGGAAGC<br>GTGCAGGCTGGCGGTTCTCTGCGCCTGAGCTGTGTCGCAAGTGCCTCTACCTAC<br>TGCACTTACGACATGCACTGGTATCGGCAAGCGCCCGGAAAAGGCAGGGAGTTT<br>GTTAGCGCCATTGATTCCGACGGTACTACCCGCTATGCCGATAGCGTGAAAGGC<br>AGGTTTACTATCAGCCAGGGCACTGCGAAGAACACCGTGTACCTCCAGATGAAC<br>TCCCTCCAGCCCGAGGACACCGCCATGTATTACTGCAAAACCGTCTGCGTCGTG<br>GGATCACGTTGGTCTGACTATTGGGGGCAGGGGACTCAGGTCACTGTGTCCAGC |
| hIL27Ra_<br>VH<br>H1-<br>DR595 | 1251 | CAGGTGCAGCTTCAGGAGAGCGGCGGGGGTCTCGTGCAGCCTGGAGGCTCTCTG<br>CGCCTGTCCTGTGCCGCGAGCGGATTCACTTTCTCTTCATACCCGATGTCCTGG<br>GTGCGCCAGGCCCCCGGCAAGGGACTGGAGTGGATCAGCACGATCTCCGCCGGA<br>GGCGACACAACCCTGTATGCCGACTCTGTTAAGGGGAGGTTCACCAGTAGCCGT<br>GACAATGCCAAGAACACTCTGTATCTGCAACTGAACTCTCTCAAGACTGAGGAT<br>GCCGCTATCTATTACTGCGCGAAGCGCATTGACTGCAACAGTGGCTACTGCTAC<br>CGCAGGAACTATTGGGGCCAGGGCACCCAGGTTACCGTTAGTTCTGGAGGCGGA<br>TCACAAGTGCAGCTGCAAGAGTCTGGAGGTGGCAGTGTGCAAGCAGGTGGCTCT<br>CTGACTCTGTCCTGCGCTGCCAGCGAGTATGCTTACTCTACGTGCAACATGGGC<br>TGGTATCGCCAGGCCCCTGGGAAAGAGCGGGAACTGGTTTCCGCGTTCATCTCC<br>GACGGCTCCACTTATTACGCCGACTCCGTGAAGGGGAGATTCACCATCACTCGG<br>GACAACGCAAAAAATACTGTCTATCTCCAGATGAACTCCCTCAAGCCTGAGGAT<br>ACAGCTATCTACTATTGCTCTGCTAACTGCTATCGTCGCCTGCGCAACTATTGG<br>GGACAGGGCACACAGGTGACAGTTAGCAGC |
| hIL27Ra_<br>VH<br>H1-<br>DR595 | 1252 | CAGGTGCAGTTGCAGGAATCTGGCGGGGGTCTTGTCCAGCCCGGTGGCTCACTC<br>CGCCTGAGCTGCGCTGCCAGCGGTTTCACTTTCAGTTCCTATCCTATGAGTTGG<br>GTGCGGCAGGCCCCAGGCAAAGGACTGGAGTGGATCTCTACAATCTCAGCTGGT<br>GGCGATACCACTCTTTATGCCGATTCTGTGAAGGGTCGTTTCACTTCTTCCAGA<br>GACAACGCGAAGAACACGTTGTATTTGCAGCTGAACAGTCTGAAAACCGAAGAC<br>GCGGCCATCTATTACTGTGCCAAGAGGATTGATTGTAACAGCGGGTATTGTTAT<br>CGCCGTAACTATTGGGGGCAGGGCACTCAAGTTACCGTTAGCTCCGGTGGCTCC<br>GGGGGTAGCGGGGGAAGCGGCCAGGTCCAGCTGCAAGAGTCTGGAGGGGGTTCC<br>GTTCAGGCGGAGGGTCTCTGACCCTGTCTTGCGCGGCCTCAGAATACGCCTAC<br>TCCACCTGTAATATGGGTTGGTACAGACAGGCCCCTGGCAAAGAGAGGGAACTC<br>GTTAGCGCTTTCATCTCCGATGGGTCCACTTATTACGCGGACAGCGTCAAGGGC<br>CGCTTCACCATCACACGCGATAACGCCAAGAATACGGTTTATCTCCAGATGAAC<br>TCCCTCAAGCCCGAGGATACTGCGATCTATTACTGTTCCGCGAACTGCTACAGA<br>CGGCTGCGTAACTATTGGGGCCAGGGGACTCAGGTTACCGTGTCCAGC |
| hIL27Ra_<br>VH<br>H1-<br>DR596 | 1253 | CAGGTTCAGCTCCAGGAGAGCGGTGGAGGTTTGGTCCAACCGGGAGGCAGCCTG<br>AGACTCAGTTGTGCCGCTTCTGGCTTCACTTTCTCCTCTTACCCTATGTCCTGG<br>GTCAGACAAGCACCGGGAAGGGTCTGGAATGGATCTCCACCATTTCAGCTGGA<br>GGCGATACCACATTGTACGCCGACTCCGTGAAGGGACGCTTCACCTCTTCCCGC<br>GATAATGCCAAGAACACCCTGTATTTGCAGTTGAATAGCCTGAAGACCGAGGAT<br>GCCGCTATTTACTATTGTGCTAAGCGGATCGACTGTAACAGCGGTTACTGTTAC<br>AGGCGCAACTACTGGGGTCAAGGCACCCAGGTAACCGTCAGCTCCGGCGGTGGG<br>TCCCAGGTGCAGCTCCAGGAGTCAGGAGGCGGACTCGTGCAACCCGGTGGCTCC<br>CTCCGCCTCAGCTGTACCGCTTCCGGTCTCACCTTTGATGACTACAGTTATGGGC<br>TGGTTTAGGCAAGCGCCGGGCAAGGGCAGAGAAGCTGTGTCTTGTATCTCCTCA<br>TCCGGTGCTAACGCCTTCTACGCTGACAGCGTGAAGGGTCGCTTTACAATCAGT<br>AGAGATAACGCCAAAAACACTCTTTACTTGCAGATGAACTCTCTCAAGCCTGAG<br>GATACCGCCACTTATTACTGTAAGAGGGTCATGCTTGCGCTGGCTATTACCCC<br>ATCCCCTATGATGACTATTGGGGCCAGGGCACCCAGGTGACTGTGTCTAGT |

TABLE 1B-continued

| Name | SEQ ID NO: | Sequence |
|---|---|---|
| hIL27Ra_VH H1-DR596 | 1254 | CAGGTGCAGCTTCAGGAGAGCGGCGGAGGCCTCGTGCAGCCAGGAGGCTCCCTG<br>AGACTCTCCTGCGCCGCAAGCGGATTTACATTTTCTAGCTACCCGATGTCCTGG<br>GTGAGACAAGCGCCCGGCAAAGGCCTTGAATGGATCTCTACTATCTCTGCTGGA<br>GGCGCACAACCCTGTATGCCGATAGCGTTAAGGGACGTTTCACCTCTTCCAGA<br>GACAATGCTAAGAACACCCTGTACTTGCAGCTGAACTCCCTCAAGACGGAGGAT<br>GCAGCGATCTACTATTGCGCGAAGAGGATTGACTGTAACAGTGGCTATTGTTAC<br>AGGCGCAATTACTGGGGCCAGGGAACTCAGGTGACCGTCTCCTCTGGCGGTTCC<br>GGGGGATCAGGAGGCAGTGGCCAGGTGCAGTTGCAGGAAAGTGGCGGAGGGCTG<br>GTGCAACCAGGCGGATCTTTGAGATTGTCCTGCACCGCCTCCGGCCTGACATTT<br>GACGATTCAGTGATGGGCTGGTTCCGTCAGGCACCCGGCAAGGGCCGCGAGGCC<br>GTGAGTTGTATCAGCTCCTCAGGCGCAAACGCCTTCTACGCCGACAGTGTTAAG<br>GGCAGGTTCACTATCTCCAGAGACAATGCAAAGAACACTCTGTACCTTCAGATG<br>AACAGCCTGAAGCCAGAGGACACAGCCACATACTATTGCAAGCGCGGCCACGCT<br>TGCGCCGGGTACTATCCCATCCCCTACGACGATTACTGGGGACAGGGCACTCAG<br>GTCACAGTGAGTAGC |
| hIL27Ra_VH H2-DR591 | 1255 | CAAGTACAACTTCAGGAATCTGGGGGCGGTCTCGTTCAGCCTGGGGGCTCTCTG<br>AGGCTGTCTTGCGCCGCAAGCGGATTTACTTTTTCCCTCAGCGGCATGAGCTGG<br>GTCAGACAGGCCCCTGGCAAAGGGCTGGAATGGGTGTCCGCCATCTCCAGCGGG<br>GGCGCTTCTACATACTATACTGACAGCGTGAAGGGCAGGTTCACTATTTCCCGC<br>GACAATGCCAAGAACATTCTTTACCTTCAGCTGAACTCCCTCAAAACAGAGGAC<br>ACCGCGATGTATTACTGTGCTAAGGGCGGGAGCGGTTATGGCGATGCGAGTCGC<br>ATGACCTCCCCCGGCAGTCAGGGAACTCAGGTCACTGTCAGCTCTGGGGGCGGG<br>TCCCAGGTTCAACTCCAGGAGTCAGGAGGGGCTCTGTTCAGGCTGGCGGTAGC<br>CTGAGGCTGTCCTGCACCGCCTCTGGAGCCATCGCCAGCGGCTATATTGATTCA<br>CGCTGGTGTATGGCGTGGTTCCGCCAGGCTCCTGGCAAAGAAAGGGAAGGTGTA<br>GCCGCTATTTGGCCTGGAGGCGGTCTGACCGTCTATGCCGATAGCGTGAAGGGC<br>AGGTTTACTATCTCTCGGGATCACGCGAAGAACACCCTGTATCTTCAGATGAAC<br>AATCTCAAGCCTGAGGACACAGCTATGTATTACTGCGCAGCGGGTTCCCCGCGC<br>ATGTGCCCCAGCCTGGAGTTCGGATTCGATTACTGGGGCAAGGCACCCAAGTC<br>ACTGTTTCTAGC |
| hIL27Ra_VH H2-DR591 | 1256 | CAAGTTCAGCTCCAGGAGTCCGGTGGCGGACTCGTTCAGCCTGGAGGCAGTCTG<br>AGGCTGTCTTGTGCCGCGTCAGGGTTCACCTTCAGCCTGTCTGGGATGAGCTGG<br>GTCCGCCAGGCCCCAGGCAAGGGCCTGGAATGGGTGTCAGCCATCAGCTCCGGC<br>GGTGCCTCTACTTATTACACTGACTCAGTGAAGGGTCGTTTTACCATCTCCCGC<br>GACAACGCCAAGAACATTCTGTATCTCCAGCTCAACAGCCTGAAAACGGAGGAC<br>ACCGCTATGTATTACTGTGCTAAGGGTGGCTCAGGGTACGGGGACGCTTCTCGC<br>ATGACATCTCCTGGCTCCCAGGGCACCCAGGTGACTGTCAGCTCAGGAGGCAGC<br>GGAGGCAGTGGCGGATCTGGGCAGGTCCAGCTCCAAGAGTCTGGAGGGGGTTCA<br>GTGCAGGCTGGAGGTTCTCTTAGGCTGAGCTGTACCGCCAGCGGAGCCATCGCT<br>TCTGGGTATATTGACAGCCGCTGGTGCATGGCTTGGTTCCGGCAAGCTCCAGGT<br>AAGGAGAGGGAGGGAGTGGCAGCCATTTGGCCCGGAGGCGGACTCACAGTGTAT<br>GCCGATAGCGTTAAGGGCAGATTTACCATCAGCCGCGATCACGCAAAAAACACA<br>CTCTACCTTCAGATGAATAACCTGAAGCCGGAGGACACCGCCATGTATTACTGT<br>GCCGCTGGCTCTCCACGCATGTGCCCTAGCCTGGAGTTCGGTTTTGACTACTGG<br>GGTCAAGGCACACAGGTGACCGTGTCTAGT |
| hIL27Ra_VH H2-DR592 | 1257 | CAGGTCCAGTTGCAGGAATCTGGAGGCGGACTGGTGCAACCTGGCGGTTCCCTG<br>CGGCTGTCCTGTGCAGCCAGTGGCTTTACCTTCAGCCTGAGCGGCATGTCCTGG<br>GTGAGACAGGCCCCCGGAAAGGGTCTGGAATGGGTGAGTGCCATCAGCTCCGGC<br>GGAGCCAGTACCTATTACACCGATAGTGTTAAGGGGCGCTTTACCATCTCCCGT<br>GACAACGCTAAGAATATCCTTTATCTCCAACTGAACAGCCTGAAGACCGAAGAC<br>ACCGCCATGTATTACTGTGCCAAGGGTGGCTCTGGATATGGCGATGCCAGCCGC<br>ATGACCAGTCCTGGGTCCCAAGGCACAGAGGTAACAGTGTCTAGCGGCGGAGGC<br>AGCCAGGTGCAGCTGCAAGAAAGCGGCGGTGGCAGTGTCCAAGCTGGGGGCAGC<br>TTGCGCCTCTCTTGCACTGCGCCCGGTTTCACCTCTAATAGCTGTGGCATGGAT<br>TGGTATCGCCAGGCACCGGGCAAGGAGAGGGAGTTCGTGAGTTCCATCAGCACC<br>GACGGCACTACGGGATATGCCGACAGCGTTAAGGGCCGCTTCACCATCTCAAAG<br>GACAAGGCCAAGGATACTGTGTACCTGCAAATGAACAGTCTGAAGCCGGAGGAT<br>ACCGGGATGTACTCTTGCAAGACCAAGGACGGAACCATCGCAACTATGGAGCTG<br>TGTGACTTCGGCTACTGGGGCCAGGGAACCCAGGTGACAGTCTCTTCC |
| hIL27Ra_VH H2-DR592 | 1258 | CAGGTGCAGCTTCAGGAGTCCGGCGGTGGCCTGGTCCAGCCGGGCGGAAGCCTG<br>CGCCTTTCCTGCGCCGCGTCTGGCTTCACCTTCTCTCTCAGCGGTATGAGTTGG<br>GTCCGCCAGGCCCCAGGGAAGGGCTGGAGTGGGTGTCTGCTATCTCTAGCGGA<br>GGCGCTAGTACCTATTACACAGATTCCGTCAAGGGCCGCTTTACAATCTCACGC<br>GATAACGCCAAGAACATCCTGTACCTTCAGCTGAACAGCCTGAAAACCGAGGAT<br>ACCGCTATGTACTATTGCGCTAAGGGAGGCTCTGGCTACGGAGACGCTTCACGT<br>ATGACCAGTCCTGGCAGCCAGGGAACACAGGTCACAGTCAGCTCCGGCGGTAGC<br>GGTGGCTCCGGCGGGAGCGGCCAGGTTCAACTCCAGGAATCTGGGGCGGTTCC<br>GTCCAGGCTGGGGGTTCTCTGAGACTGAGCTGCACAGCCCCTGGGTTCACCTCC<br>AACAGTTGCGGAATGGATTGGTATCGTCAGGCCCCCGGCAAGGAGAGAGAGTTT<br>GTTAGCTCTATCTCCACGGACGGGACCACTGGTTATGCTGACAGCGTTAAGGGC<br>CGTTTTACTATCTCCAAGGACAAGGCCAAAGACACCGTGTACTTGCAGATGAAC<br>TCTCTGAAGCCCGAGGATACCGGAATGTACTCATGCAAAACCAAAGATGGTACT |

TABLE 1B-continued

| Name | SEQ ID NO: | Sequence |
|---|---|---|
| | | ATTGCTACTATGGAGCTGTGTGACTTCGGCTATTGGGGCCAGGGGACCCAGGTG<br>ACTGTGTCCTCT |
| hIL27Ra_<br>VH<br>H2-<br>DR593 | 1259 | CAGGTTCAACTGCAAGAGTCTGGAGGCGGTCTCGTACAGCCAGGTGGGAGCCTC<br>CGCCTGTCCTGTGCAGCCAGCGGTTTCACCTTCTCCCTCTCCGGTATGTCCTGG<br>GTGCGCCAGGCCCCTGGAAAAGGCTTGGAGTGGGTGTCTGCCATCAGCTCAGGA<br>GGCGCGTCCACATATTACACCGACAGTGTCAAGGGCCGGTTCACCATCTCCAGG<br>GACAATGCGAAGAATATCCTCTACTTGCAGCTGAACTCCCTCAAAACTGAGGAC<br>ACTGCAATGTATTACTGCGCTAAAGGGGGCAGCGGATATGGGGATGCTTCCCGG<br>ATGACATCCCCAGGCAGCCAGGGCACCCAAGTGACCGTGTCTTCCGGTGGGGGC<br>TCCCAGGTGCAGCTCCAGGAAAGCGGAGGGGGAAGCGTGCAGGCAGGGGGTAGC<br>CTTCGTCTGTCTTGTGCAGCCAGCGGCTACCCGTATTCTAATGGATACATGGGC<br>TGGTTCAGGCAAGCCCCTGGCAAGGAACGCGAGGGCGTGGCCACGATCTATACC<br>GGAGACGGCAGGACTTACTATGCCGATAGCGTGAAAGGGCGCTTCACCATCTCA<br>CGTGACAACGCGAAAAATACCCTGGATCTTCAGATGTCCTCTCTCAAACCCGAG<br>GACACCGCGATGTACTATTGCGCCCACGGGCTGCCCCTCTGTACTCATCTGGC<br>TCACCGTTGACTCGGGCAAGATATAACGTGTGGGGTCAGGGCACACAGGTCACC<br>GTGTCTTCC |
| hIL27Ra_<br>VH<br>H2-<br>DR593 | 1260 | CAGGTCCAACTCCAGGAAAGCGGCGGTGGCCTGGTGCAGCCTGGTGGGTCCCTC<br>AGACTGTCTTGCGCCGCTTCTGGCTTCACCTTTTCTTTGTCCGGGATGTCTTGG<br>GTCCGCCAAGCGCCGGGCAAGGGCCTGGAGTGGGTGTCCGCCATTTCATCTGGT<br>GGAGCTTCAACTTATTACACCGACTCTGTGAAGGGTCGTTTTACCATCTCCCGT<br>GACAACGCGAAGAACATCCTGTATTTGCAGCTGAACTCCTTGAAAACCGAGGAT<br>ACGGCCATGTACTATTGTGCAAAGGGCGGTTCCGGTTACGGCGACGCTTCACGC<br>ATGACCTCCCCCGGTTCCCAGGGCACTCAGGTGACCGTCTCAAGTGGCGGTAGC<br>GGTGGCTCTGGTGGCAGCGGACAGGTCCAGCTTCAGGAATCAGGCGGAGGGAGT<br>GTGCAAGCAGGCGGATCTCTGAGACTGAGCTGTGCTGCCAGCGGTTACCCCTAC<br>TCTAACGGCTATATGGGTTGGTTCAGGCAAGCGCCTGGTAAGGAGCGCGAGGGT<br>GTGGCCACGATCTATACCGGGGATGGCAGGACCTACTATGCCGACTCTGTGAAG<br>GGTCGGTTCACCATCAGCGGGACAACGCGAAGAACACTGTGGATTTGCAGATG<br>TCTTCCCTGAAACCCGAGGACACCGCCATGTATTACGCGCTGCAAGAGCCGCT<br>CCCCTGTATAGCTCTGGATCTCCTCTGACCCGTGCAAGATACAATGTATGGGT<br>CAGGGAACCCAGGTCACCGTCAGCAGT |
| hIL27Ra_<br>VH<br>H2-<br>DR594 | 1261 | CAGGTGCAGCTTCAGGAGTCAGGTGGGGGCCTGGTCCAGCCAGGCGGTTCCTTG<br>CGCCTGTCATGCGCCGCTAGTGGGTTCACTTTTAGCCTGTCCGGCATGTCCTGG<br>GTTCGGCAAGCACCCGGCAAGGGTTTGGAGTGGGTGTCCGCCATTTCTTCCGGG<br>GGCGCATCTACCTATTACACTGATTCTGTCAAGGGGCGCTTTACCATTTCTCGT<br>GACAACGCTAAAAACATTCTGTATCTGCAACTTAACTCACTGAAGACCGAGGAT<br>ACAGCAATGTACTATTGCGCCAAGGGTGGCTCCGGGTACGGCGATGCGTCACGG<br>ATGACATCTCCTGGGTCCCAGGGAACTCAGGTGACCGTGTCCTCAGGCGGGGGC<br>AGTCAAGTGCAGCTCCAGGAGAGCGGAGGTGGCTCTGTGCAAGCTGGGGGAAGT<br>CTCCGCTTGTCTTGTGTGGCCTCCGCAAGCACATATTGCACCTACGACATGCAC<br>TGGTATAGGCAGGCTCCCGGCAAGGGCCGGGAGTTTGTTTCCGCAATGACAGC<br>GACGGCACCACTCGCTATGCCGATAGCGTGAAAGGTCGTTTTACCATCTCCCAG<br>GGGACCGCAAAGAACACAGTCTACTTGCAGATGAACTCCCTTCAGCCTGAGGAC<br>ACCGCTATGTATTACTGTAAGACCGTGTGCGTCGTGGGCAGTCGTTGGTCCGAT<br>TACTGGGGCCAGGGAACACAGGTGACAGTCAGTTCT |
| hIL27Ra_<br>VH<br>H2-<br>DR594 | 1262 | CAGGTGCAGCTCCAGGAGTCTGGCGGGGGCCTGGTCCAACCGGGTGGCTCACTC<br>CGCCTGTCTTGCGCCGCGTCCGGCTTCACATTCAGTCTCTCCGGGATGTCCTGG<br>GTGCGCCAAGCTCCGGGCAAAGCTTGGAGTGGGTATCTGCTATCTCTAGCGGT<br>GGAGCTTCCACATACTATACCGACTCCGTGAAGGGCCGCTTCACCATTTCACGT<br>GATAACGCGAAGAACATTCTGTATCTTCAGCTGAACAGCCTGAAAACCGAGGAC<br>ACCGCTATGTACTATTGTGCCAAGGGAGGCAGCGGGTATGGGGACGCTTCCCGG<br>ATGACCTCCCCCGGTTCTCAGGGTACTCAGGTGACCGTCTCTAGCGGTGGCTCT<br>GGTGGCTCCGGCGGATCTGGACAGGTACAGCTCCAGGAGTCAGGTGGAGGGAGT<br>GTGCAGGCAGGTGGCTCCCTGCGGTTGTCCTGTGTGGCCAGCGCCTCTACATAT<br>TGCACCTACGACATGCACTGGTACAGGCAGGCCCCAGGTAAAGGGCGTGAATTT<br>GTGAGTGCCATTGACTCTGATGGAACGACTAGATACGCGGATTCCGTCAAGGGG<br>CGGTTTACAATCTCTCAGGGCACCGCCAAGAACACCGTGTATCTCCAAATGAAC<br>TCATTGCAGCCTGAGGACACTGCCATGTATTACTGCAAGACCGTGTGCGTCGTG<br>GGCTCCCGTTGGTCCGATTATTGGGGCCAGGGCACACAGGTAACCGTATCTTCC |
| hIL27Ra_<br>VH<br>H2-<br>DR595 | 1263 | CAGGTACAGCTCCAGGAATCCGTGGGGGGCTTGGTCCAGCCAGGGGGTAGTCTG<br>CGCCTTTCCTGCGCTGCCTCCGGCTTCACCTTCAGCCTGTCAGGCATGTCCTGG<br>GTCCGGCAAGCGCCTGGCAAGGGCCTGGAGTGGGTCTCCGCCATTAGCAGTGGT<br>GGAGCGAGCACTTATTACACTGACAGCGTGAAGGGACGCTTTACAATTTCACGT<br>GACAACGCCAAGAACATCCTCTACTTGCAGCTCAATTCTCTGAAGACCGAGGAT<br>ACCGCAATGTACTATTGCGCCAAGGGTGGCTCCGGTTACGGGGACGCCAGCCGC<br>ATGACATCTCCGGGTTCTCAGGGTACACAGGTGACTGTCTCATCCGGGGCGGG<br>AGCCAGGTCCAGCTCCAGGAGTCTGGTGGGGGCTCCGTGCAAGCTGGCGGTTCA<br>CTGACACTGAGCTGTGCAGCGTCTGAGTATGCGTACTCTACGTGTAACATGGGA<br>TGGTATAGGCAGGCTCCGGGGAAGGAGCGCGAACTCGTGTCAGCTTTTATTAGC<br>GACGGCTCCACGTATTACGCAGATAGCGTCAAGGGACGGTTCACCATCACACGG<br>GACAATGCGAAGAATACCGTGTATCTCCAGATGAACTCCCTCAAGCCCGAGGAC |

TABLE 1B-continued

| Name | SEQ ID NO: | Sequence |
|---|---|---|
| | | ACCGCAATCTATTACTGTAGCGCAAATTGCTACCGGAGACTGCGGAACTACTGG<br>GGCCAGGGCACCCAGGTAACCGTGTCTTCC |
| hIL27Ra_<br>VH<br>H2-<br>DR595 | 1264 | CAGGTGCAGTTGCAGGAATCAGGGGCGGTCTCGTGCAGCCCGGTGGATCACTG<br>AGACTGTCATGTGCTGCCTCCGGCTTCACATTCAGCCTGTCTGGTATGAGCTGG<br>GTCCGCCAGGCACCAGGCAAGGGACTGGAGTGGGTGAGTGCTATCTCATCCGGG<br>GGTGCCAGCACCTATTACACCGACAGCGTAAAAGGACGTTTCACTATCTCCCGC<br>GATAACGCTAAGAACATCCTGTACCTCCAGCTCAATTCTCTGAAAACAGAAGAT<br>ACCGCCATGTATTACTGCGCTAAGGGAGGCAGCGGGTACGGCGATGCGTCCCGC<br>ATGACATCCCCCGGAAGTCAGGGAACCCAAGTGACAGTGTCTTCCGGGGGCTCT<br>GGCGGTTCCGGGGGTTCTGGCCAAGTGCAGCTCCAGGAATCCGGCGGGGGATCT<br>GTGCAGGCGGGCGGGTCTCTGACATTGAGCTGCGCGGCCTCTGAGTATGCTTAC<br>TCTACCTGCAACATGGGCTGGTATAGGCAGGCCCCCGGCAAGGAACGCGAACTG<br>GTGTCCGCCTTCATTTCCGACGGGTCCACCTATTACGCCGACTCCGTGAAAGGC<br>AGGTTCACTATCACCCGCGACAACGCCAAGAATACTGTGTACCTCCAGATGAAT<br>AGCTTGAAGCCCGAGGATACCGCGATTTATTACTGCTCCGCAAATTGCTATCGT<br>CGGCTCAGAAATTATTGGGGCCAGGGCACACAGGTTACCGTTAGCTCA |
| hIL27Ra_<br>VH<br>H2-<br>DR596 | 1265 | CAAGTCCAACTCCAGGAGTCCGGCGGTGGCCTGGTGCAGCCCGGTGGGTCCCTG<br>CGCCTGTCATGTGCTGCCAGTGGTTTCACATTCAGCCTCTCAGGCATGTCTTGG<br>GTACGCCAGGCCCCTGGGAAGGGCCTGGAGTGGGTCTCCGCCATCTCCAGCGGT<br>GGCGCAAGTACATATTACACTGATTCCGTGAAGGGTCGTTTCACAATCTCTAGG<br>GATAACGCTAAGAATATCCTGTACCTCCAGCTTAACTCCCTGAAGACCGAAGAT<br>ACCGCTATGTATTACTGTGCGAAGGGCGGTTCTGGCTATGGGGATGCCTCACGC<br>ATGACCTCTCCTGGGTCCCAGGGCACCCAGGTGACTGTCAGCTCAGGCGGGGC<br>AGCCAGGTGCAGCTCCAGGAGTCCGGTGGCGGGCTGGTGCAGCCTGGCGGAAGC<br>CTCAGACTGTCATGTACCGCGAGTGGACTGACATTTGATGACAGCGTCATGGGC<br>TGGTTCCGGCAGGCCCCAGGGAAGGGGAGGGAAGCTGTGAGCTGTATTTCTTCC<br>TCTGGCGCTAACGCCTTCTACGCTGACAGTGTGAAGGGCCGTTTCACCATTTCC<br>AGAGACAACGCAAAGAACACTCTGTACCTCCAGATGAACTCACTGAAGCCTGAG<br>GACACCGCGACATACTATTGTAAGCGTGGTCACGCTTGTGCTGGCTACTATCCT<br>ATCCCATACGATGACTATTGGGGTCAGGGCACACAGGTGACCGTGAGTAGC |
| hIL27Ra_<br>VH<br>H2-<br>DR596 | 1266 | CAGGTCCAGTTGCAGGAATCTGGAGGTGGCCTGGTTCAGCCCGGAGGCAGCCTG<br>AGACTGAGCTGCGCTGCGAGCGGATTCACCTTTAGCCTGTCTGGCATGAGCTGG<br>GTAAGGCAGGCTCCAGGCAAGGGACTGGAGTGGGTGTCTGCTATCTCCAGCGGA<br>GGCGCTTCCACCTATTACACAGACTCTGTTAAAGGCCGTTTCACTATCAGTAGA<br>GACAACGCGAAGAACATCCTCTATCTTCAGCTGAATAGCCTGAAGACAGAGGAT<br>ACCGCCATGTATTACTGTGCCAAGGGAGGTAGCGGTTACGGCGACGCCAGCCGC<br>ATGACAAGTCCGGGCTCCCAGGGCACACAGGTGACCGTATCCAGCGGTGGCTCC<br>GGTGGGAGCGGCGGTTCCGGCCAGGTGCAGCTGCAAGAAAGCGGCGGTGGCCTG<br>GTGCAGCCAGGGGGTTCTCTGCGTCTGAGCTGCACCGCGAGTGGGCTGACCTTC<br>GACGATTCCGTTATGGGCTGGTTCCGCCAAGCTCCGGGAAAGGGCAGAGAGGCC<br>GTATCCTGCATCAGCTCCAGCGGGGCCAACGCCTTCTATGCCGATAGTGTGAAG<br>GGACGCTTTACCATTTCTCGCGATAACGCGAAAAACACACTGTATCTTCAGATG<br>AACTCACTGAAGCCTGAGGACACCGCCACGTACTATTGTAAACGCGGCCACGCC<br>TGCGCTGGTTATTACCCTATTCCATACGACGATTACTGGGGCCAGGGCACCCAG<br>GTCACTGTGTCCTCA |
| hIL27Ra_<br>VH<br>H3-<br>DR591 | 1267 | CAAGTGCAGCTCCAGGAGAGCGGAGGTGGCTCAGTGCAGGCAGGCGGTTCACTG<br>CGTCTGTCCTGCGTCGCCTCTGGCTACGTTAGCGTGATTATTTTCTCCCCTCC<br>TGGTATCGGCAGGCTCCTGGGAAAGAGCGCGAATTTGTAAGCATCATTGACGGC<br>ACCGGCTCTACCAGCTATGCGGCCTCCGTCAAAGGACGCTTTACCGCATCCGAA<br>GATAAGGGCAAGAACATCGCTTACTTGCAGATGAACTCTCTGAAACCAGAGGAT<br>ACCGCTATGTACTATTGTAAGGCGTCATGCGTGCGTGGCCGCGCCGTGAGCGAA<br>TACTGGGGCCAAGGAACCCAAGTTACCGTCTCCTCAGGGGGCGGGTCCCAAGTG<br>CAGTTGCAAGAATCCGGTGGCGATCTGTCCAAGCCGGAGGTTCCCTGAGACTC<br>TCATGTACCGCAAGCGGTGCCATTGCAAGCGGCTATATTGATTCCCGCTGGTGC<br>ATGGCTTGGTTCGCCAGGCCCCAGGGAAGGAGCGTGAGGGTGTGGCCGCTATC<br>TGGCCCGGAGGGGCTTGACCGTGTATGCCGATTCCGTCAAAGGACGTTTCACT<br>ATCAGCCGCGACCACGCCAAAAACACTCTTTATCTGCAAATGAATAACCTCAAG<br>CCAGAGGACACAGCTATGTACTATTGCGCCGCAGGCTCCCACGCATGTGTCCT<br>TCCTTGGAGTTCGGCTTCGACTACTGGGGACAGGGTACTCAGGTTACTGTCTCC<br>TCC |
| hIL27Ra_<br>VH<br>H3-<br>DR591 | 1268 | CAGGTGCAGCTCCAGGAGTCTGGAGGCGGTTCCGTTCAGGCCGGTGGCTCCCTG<br>CGTTTGTCTTGCGTGGCCAGTGGCTACGTCAGTTGTGACTACTTCCTGCCCTCA<br>TGGTATCGTCAAGCGCCAGGTAAGGAGCGCGAGTTCGTCTCCATTATCGACGGA<br>ACAGGTTCTACTAGCTACGCCGCTTCTGTCAAGGGGCGCTTCACCGCTTCCGAG<br>GATAAGGGTAAGAACATCGCGTATCTGCAAATGAACTCATTGAAGCCCGAGGAC<br>ACCGCCATGTATTACTGTAAAGCCTCCTGTGTGCGTGGCCGCGCTGTGTCCGAG<br>TACTGGGGCCAGGGCACACAGGTGACCGTTTCCAGCGGCGGTTCC<br>GGGGGCTCAGGGCAGGTGCAGCTTCAGGAGAGCGGAGGGGATCTGTGCAGGCC<br>GGTGGCTCCCTCGGCTGTCCTGCACAGCATCTGGGGCATCGCGTCCGGGTAC<br>ATCGACTCCCGCTGGTGTATGGCCTGGTTCCGCCAAGCGCCTGGCAAGGAGCGT<br>GAGGGCGTGGCCGCGATCTGGCCGGTGGCGGACTCACAGTCTACGCTGACAGC<br>GTCAAGGGCGTTTCACTATTAGCAGAGACCACGCTAAGAACACCCTTTACCTT |

TABLE 1B-continued

| Name | SEQ ID NO: | Sequence |
|---|---|---|
| | | CAGATGAATAACCTGAAGCCTGAAGACACCGCGATGTACTATTGCGCAGCTGGT<br>TCTCCCCGCATGTGCCCCTCACTTGAATTTGGTTTCGACTACTGGGGCAGGGT<br>ACGCAGGTCACGGTGTCCTCC |
| hIL27Ra_<br>VH<br>H3-<br>DR592 | 1269 | CAAGTCCAGCTCCAGGAGAGCGGTGGCGGGTCCGTGCAGGCGGGAGGCAGCCTC<br>CGCCTCAGTTGTGTCGCCTCTGGCTACGTGTCCTGCGATTATTTTCTTCCGTCC<br>TGGTATCGCCAGGCTCCCGGCAAAGAAAGGGAGTTCGTTAGCATCATTGATGGC<br>ACGGGTTCCACAAGTTACGCTGCCAGCGTGAAAGGTAGGTTTACCGCTTCTGAA<br>GACAAAGGAAAGAACATCGCCTACTTGCAGATGAACTCTCTGAAGCCCGAGGAC<br>ACAGCCATGTACTATTGCAAAGCCTCTTGCGTGAGGGGACGGGCGGTGTCTGAA<br>TACTGGGGGCAAGGAACCCAAGTGACCGTGTCCTCTGGAGGCGGTAGCCAGGTC<br>CAGCTGCAAGAGTCCGGCGGAGGCTCTGTTCAGGCCGGTGGCTCACTGCGCCTG<br>TCTTGTACCGCACCTGGCTTCACTAGCAACTCTTGTGGAATGGACTGGTATCGT<br>CAGGCCCCCGGTAAGGAAAGAGAGTTCGTTTCTTCCATTTCTACAGACGGCACA<br>ACGGGGTATGCGGACAGTGTGAAAGGAAGATTCACTATCAGTAAGGATAAGGCC<br>AAAGACACCGTGTATCTCCAGATGAACTCCTTGAAACCAGAGGACACTGGAATG<br>TATAGCTGCAAGACCAAGGACGGGACCATTGCTACGATGGAACTCTGCGATTTC<br>GGCTACTGGGGGCAGGGGACACAGGTGACTGTGTCCTCC |
| hIL27Ra_<br>VH<br>H3-<br>DR592 | 1270 | CAGGTGCAGTTGCAGGAGTCCGGCGGTGGGTCCGTGCAGGCTGGCGGTAGCCTG<br>CGCCTGAGTTGCGTGGCCTCTGGATACGTCTCTTGCGATTACTTCTTGCCCTCT<br>TGGTATCGCCAGGCTCCCCAAGGAGCGCGAGTTCGTGAGCATCATTGACGGC<br>ACGGGTAGCACCAGCTACGCTGCCAGCGTGAAGGGACGTTTTACAGCCTCTGAG<br>GACAAGGGGAAGAACATTGCGTATCTTCAGATGAACTCCCTGAAGCCCGAGGAT<br>ACCGCCATGTACTATTGCAAGGCCTCCTGCGTGCGTGGCCGGGCCGTTAGTGAG<br>TATTGGGGCCAGGGGACGCAGGTCACCGTCAGTAGCGGTGGCTCCGGCGGTTCT<br>GGTGGCAGTGGTCAGGTCCAGCTCCAGGAGAGCGGTGGAGGCAGCGTCCAAGCT<br>GGCGGGTCCCTGAGGCTGTCTTGTACTGCGCCGGGATTTACTTCCAACAGCTGC<br>GGTATGGACTGGTATCGGCAGGCCCCTGGGAAAGAGAGGGAGTTCGTGTCTTCC<br>ATCTCTACGGATGGTACTACCGGCTACGCCGACAGCGTGAAGGGCCGTTTTACT<br>ATTAGCAAAGACAAGGCTAAAGACACAGTCTACCTTCAGATGAACTCTCTCAAA<br>CCAGAGGACACTGGTATGTATAGCTGTAAAACCAAAGATGGGACCATCGCTACA<br>ATGGAACTCTGCGATTTCGGGTACTGGGGACAGGGCACCCAAGTCACTGTCTCT<br>AGT |
| hIL27Ra_<br>VH<br>H3-<br>DR593 | 1271 | CAGGTGCAGCTTCAGGAGTCCGGGGAGGCAGCGTGCAGGCAGGAGGCAGCCTG<br>CGCCTGTCTTGCGTCGCTTCCGGCTACGTGTCCTGCGACTATTTCCTGCCTTCT<br>TGGTACAGACAGGCACCTGGAAAGGAGCGCGAGTTCGTCTCTATTATCGACGGC<br>ACCGGCAGCACTTCTTACGCTGCCTCCGTTAAGGGCCGCTTCACCGCAAGCGAG<br>GACAAGGGAAAGAATATTGCCTACCTCCAGATGAACAGCCTGAAACCAGAGGAC<br>ACCGCGATGTATTACTGTAAGGCATCATGCGTGCGCGTCGCGCAGTGTCAGAG<br>TATTGGGGTCAGGGAACCCAGGTGACAGTTTCTTCCGCGGTGGCTCTCAGGTG<br>CAGTTGCAGGAGAGTGGTGGAGGGTCAGTCCAGGCTGGAGGCTCCCTCAGACTT<br>TCCTGTGCCGCTAGTGGATACCCCTATTCCAATGGATATATGGGTTGGTTTAGA<br>CAAGCTCCAGGAAAGGAGCGTGAGGGCGTCGCGACCATCTACACTGGCGACGGT<br>CGCACCTACTATGCGGATAGCGTGAAGGGCCGTTTCACCATCAGCCGTGACAAC<br>GCCAAGAATACCGTCGATTTGCAGATGCTTCCTTGAAACCGGAGGACACCGCT<br>ATGTATTACTGTGCGGCCAGAGCTGCGCCATTGTATAGCTCCGGTTCCCCTCTG<br>ACCCGCGCTCGCTACAATGTGTGGGACAGGGCACTCAGGTCACCGTCTCATCC |
| hIL27Ra_<br>VH<br>H3-<br>DR593 | 1272 | CAGGTGCAACTCCAGGAGAGCGGCGGGGGTTCCGTCCAGGCTGGTGGCTCTCTG<br>AGGTTGAGCTGTGTAGCCAGCGGCTACGTGTCTTGTGACTACTTCCTCCCCAGC<br>TGGTATCGTCAGGCTCCTGGCAAGGAGCGCGAGTTTGTCAGTATCATTGATGGC<br>ACCGGGAGCACCTCATACGCTGCCTCTGTGAAGGGTCGCTTCACTGCCAGCGAG<br>GATAAGGGCAAGAACATCGCCTACCTTCAGATGAACTCTTTGAAGCCGGAAGAC<br>ACTGCCATGTATTACTGCAAGGCTTCTTGCGTCAGGGGACGCGCAGTGTCAGAG<br>TATTGGGGGCAGGGAACCCAGGTTACCGTCAGCTCCGGCGGAAGCGGAGGCAGC<br>GGGGGCAGCGGGCAGGTGCAACTCCAGGAATCTGGGGGAGGCTCCGTTCAGGCT<br>GGCGGTTCTCTCAGACTCAGCTGCGCGGCCTCCGGCTATCCATATTCCAACGGA<br>TACATGGGCTGGTTCCGTCAGGCTCCCGGAAAGGAACGCGAAGGGTGGCTACC<br>ATCTACACCGGAGATGGCCGGACTTATTACGCGGACTCTGTGAAGGGTCGCTTC<br>ACCATTTCAAGGGACAACGCAAAGAACACCGTGGACCTGCAAATGTCTTCCCTG<br>AAACCAGAAGACACCGCCATGTACTATTGTGCTGCCCGCGCCGCACCCCTGTAT<br>AGCTCCGGTTCCCCTCTTACGAGGGCACGTTACAACGTCTGGGGCCAGGGCACT<br>CAGGTGACAGTTAGCTCC |
| hIL27Ra_<br>VH<br>H3-<br>DR594 | 1273 | CAAGTGCAGCTGCAAGAGAGTGGCGGAGGCTCTGTGCAGGCTGGCGGTTCCCTG<br>AGACTCAGTTGCGTTGCCTCAGGCTACGTGTCTTGTGACTACTTCTTGCCCTCT<br>TGGTATCGGCAGGCTCCCGGAAAGGAGCGCGAGTTTGTTTCAATCATTGATGGG<br>ACAGGTTCTACCTCCTACGCCGCGTCAGTTAAGGGACGGTTTACTGCGTCCGAG<br>GACAAGGGAAAGAACATTGCATACCTTCAGATGAACTCTCTGAAGCCCGAAGAT<br>ACAGCCATGTATTACTGCAAGGCCTCCTGCGTCAGAGGTAGACAGTCTCCGAG<br>TACTGGGGCCAGGGAACCCAGGTGACAGTGAGTAGCGGAGGGGGCTCTCAGGTG<br>CAGCTGCAAGAGAGCGGCGGTGCTCCGTTCAGGCCGGTGGGAGCCTCAGGCTC<br>AGCTGTGTGGCGAGCGCTTCCACTTATTGCACCTACGACATGCACTGGTATCGG<br>CAGGCTCCGGGAAAGGGCAGAGAGTTCGTATCTGCCATCGACTCAGACGGGACC<br>ACACGTTACGCCGACTCTGTGAAGGGCCGCTTCACTATCAGCCAAGGCACCGCC |

TABLE 1B-continued

| Name | SEQ ID NO: | Sequence |
|---|---|---|
| | | AAAAACACTGTTTATTTGCAGATGAACAGCTTGCAGCCAGAGGACACCGCCATG<br>TATTACTGTAAGACAGTTTGTGTGGTAGGCAGCAGATGGTCCGACTACTGGGGC<br>CAGGGTACTCAAGTGACCGTCTCCAGC |
| hIL27Ra_<br>VH<br>H3-<br>DR594 | 1274 | CAGGTCCAGCTCCAGGAAAGCGGCGGTGGCAGCGTGCAGGCTGGCGGATCTTTG<br>CGTCTTTCATGCGTGGCCAGCGGTTATGTAAGCTGCGACTATTTTCTGCCAAGC<br>TGGTATCGGCAGGCACCTGGCAAGGAGCGTGAATTTGTCAGCATCATTGATGGC<br>ACCGGATCTACCTCCTACGCAGCGAGCGTCAAGGGAAGATTCACCGCCTCAGAA<br>GATAAGGGCAAAAACATCGCCTACCTCCAGATGAACTCCCTGAAGCCTGAAGAT<br>ACAGCGATGTACTATTGCAAAGCCAGCTGTGTCCGTGGCAGAGCCGTGTCCGAG<br>TATTGGGGCCAGGGAACACAAGTGACTGTTTCCTCTGGTGGATCAGGAGGCAGC<br>GGTGGCTCTGGCCAGGTGCAGCTTCAGGAGAGCGGAGGTGGATCTGTGCAGGCT<br>GGCGGTTCACTTCGTCTGTCCTGCGTCGCCTCTGCGTCTACCTATTGTACCTAC<br>GATATGCACTGGTATCGCCAAGCCCCTGGCAAGGGCCGCGAGTTCGTGTCCGCT<br>ATTGATTCCGACGGAACTACCCGGTACGCCGATTCTGTCAAGGGAAGATTTACA<br>ATCTCCCAGGGGACCGCCAAGAATACCGTCTATCTGCAAATGAACAGTTTGCAG<br>CCAGAGGACACTGCTATGTATTACTGCAAGACCGTGTGCGTGGTCGGAAGCCGC<br>TGGTCTGACTATTGGGGTCAGGGCACCCAGGTGACCGTGTCCTCC |
| hIL27Ra_<br>VH<br>H3-<br>DR595 | 1275 | CAGGTCCAGCTCCAGGAGTCAGGTGGCGGTTCCGTCCAGGCCGGAGGCAGCCTG<br>CGGCTTTCCTGTGTGGCTTCTGGCTATGTTAGCTGCGACTACTTTCTCCCTTCC<br>TGGTATCGTCAAGCGCCTGGAAAGGAGAGGGAGTTCGTCTCCATCATTGACGGG<br>ACGGGTTCCACCAGCTATGCAGCCTCCGTGAAGGGGAGATTCACTGCCAGTGAA<br>GACAAGGGTAAGAACATCGCTTATTTGCAGATGAACTCCCTGAAACCAGAGGAT<br>ACCGCTATGTATTACTGCAAGGCGTCTTGCGTGAGGGGCCGCGCTGTGTCCGAA<br>TACTGGGGCCAGGGGACCCAGGTCACCGTTAGCTCTGGAGGCGGTTCCCAGGTG<br>CAGCTTCAGGAAAGCGGAGGTGGCAGCGTGCAGGCTGGAGGCTCACTGACACTG<br>TCTTGCGCAGCCTCCGAATACGCATATTCAACCTGCAACATGGGCTGGTATCGT<br>CAGGCCCCTGGCAAGGAGAGAGAGCTGGTGTCTGCTTTCATCTCTGATGGCTCC<br>ACGTATTACGCTGATTCTGTTAAGGGTCGTTTTACCATCACACGGGACAACGCT<br>AAGAACACGGTGTATCTTCAGATGAACAGTTTGAAGCCCGAGGATACAGCGATC<br>TACTATTGCAGCGCGAATTGTTATAGACGCCTGCGCAACTATTGGGGTCAGGGC<br>ACACAGGTTACCGTAAGCTCA |
| hIL27Ra_<br>VH<br>H3-<br>DR595 | 1276 | CAAGTTCAGCTGCAAGAATCTGGAGGCGGGTCTGTGCAGGCTGGCGGTTCCCTG<br>CGTCTCTCATGCGTCGCCTCTGGCTACGTTTCCTGCGACTACTTTCTTCCTTCA<br>TGGTACAGGCAGGCCCCTGGCAAGGAGCGCGAGTTTGTGTCCATTATCGACGGG<br>ACTGGTAGCACATCCTATGCTGCCTCCGTGAAAGGACGCTTTACAGCCAGTGAG<br>GACAAGGGTAAGAACATCGCTTATCTGCAAATGAACTCACTCAAGCCCGAAGAC<br>ACAGCTATGTATTACTGCAAGGCATCCTGTGTGCGTGGCCGCGCCGTGTCTGAG<br>TACTGGGGGCAGGGGACACAGGTGACCGTGTCCTCTGGGGGCTCAGGTGGCTCC<br>GGTGGCTCCGGCCAAGTTCAGCTCCAGGAGTCTGGAGGCGGTAGCGTGCAGGCT<br>GGAGGCTCCCTGACCCTTAGCTGCGCCGCTAGTGAGTATGCGTATTCAACTTGC<br>AACATGGTTGGTACAGGCAGGCCCCAGGGAAGGAGAGAGAGCTGGTCAGCGCT<br>TTCATTAGTGACGGGTCTACGTATTACGCCGACTCCGTGAAGGGGAGATTTACT<br>ATTACCCGTGATAACGCGAAGAATACTGTGTATTTGCAGATGAACTCTCTCAAG<br>CCGGAGGACACCGCCATCTATTACTGTAGCGCCAACTGTTACAGACGCCTGAGA<br>AACTATTGGGGCAAGGAACCCAGGTGACCGTGAGCAGC |
| hIL27Ra_<br>VH<br>H3-<br>DR596 | 1277 | CAGGTGCAACTGCAAGAGTCAGGCGGGGGCAGTGTGCAGGCGGGTGGCAGTCTG<br>CGCCTGTCCTGCGTAGCTTCTGGCTACGTGTCTTGCGACTACTTCCTCCCGTCC<br>TGGTATAGGCAAGCGCCGGGGAAGGAACGGGAGTTTGTCAGTATCATTGATGGT<br>ACTGGTAGCACATCTTATGCTGCCTCTGTCAAGGGAAGATTTACTGCCAGCGAG<br>GATAAGGGCAAGAACATTGCCTACCTGCAAATGAACTCTCTGAAGCCAGAGGAT<br>ACCGCCATGTATTACTGCAAGGCCAGCTGCGTTAGGGGACGTGCTGTCTCTGAA<br>TATTGGGGCCAGGGCACCCAGGTCACCGTGAGTAGCGGTGGGGCTCTCAGGTT<br>CAACTGCAAGAGTCTGGAGGTGGGCTCGTCCAGCCGGGCGGGTCTCTGAGGTTG<br>TCTTGCACCGCGTCAGGGCTGACCTTCGACGATTCGTGATGGGCTGGTTTCGC<br>CAGGCCCCTGGCAAAGGGCGTGAGGCTGTGTCCTGCATCAGCTCAAGCGGAGCA<br>AATGCCTTCTATGCCGACAGTGTCAAAGGCCGCTTCACAATCAGCAGAGACAAC<br>GCTAAGAACACCCTGTACCTCCAGATGAACTCACTCAAGCCTGAAGATACGGCA<br>ACCTATTACTGCAAAAGGGGCCACGCCTGCGCCGGGTATTACCCTATCCCCTAT<br>GATGACTACTGGGGCCAGGGTACTCAAGTAACCGTGTCCTCC |
| hIL27Ra_<br>VH<br>H3-<br>DR596 | 1278 | CAGGTCCAGCTTCAGGAGTCCGGCGGTGGCTCCGTGCAGGCTGGCGGGTCCCTG<br>CGCCTGTCCTGCGTGGCCAGCGGCTACGTGTCCTGCGACTATTCCTGCCCTCT<br>TGGTATCGCCAAGCGCCGGGCAAAGAAAGAGTTCGTATCAATCATTGATGGG<br>ACCGGTCAACCAGCTACGCAGCTTCCGTAAAGGGAGATTCACAGCCTCCGAA<br>GATAAGGGCAAGAACATCGCTTACCTCCAGATGAACTCTCTGAAGCCTGAGGAT<br>ACTGCAATGTACTATTGTAAGGCCTCATGCGTGCGTGGCCGCAGTGTCTGAA<br>TATTGGGGCCAGGGCACCCAGGTTACCGTCTCAAGCGGAGGCTCAGGAGGCTCA<br>GGAGGCTCAGGACAGGTGCAGCTTCAGGAGTCCGGCGGTGGCAGCCC<br>GGCGGTAGCCTCCGTCTTAGTTGTACTGCCAGCGGGCTCACCTTTGATGACTCA<br>GTGATGGGTGGTTTCGCCAGGCTCCGGGCAAAGGCCGGGAGGCCGTGTCCTGC<br>ATCTCTAGCTCCGGTGCCAATGCGTTCTACGCAGATAGCGTGAAGGGCAGATTC<br>ACTATCAGTAGAGATAATGCCAAGAATACACTGTACTTGCAGATGAACTCCCTC<br>AAGCCTGAAGACACGGCCACCTACTATTGTAAACGGGGCCACGCCTGCGCTGGC |

TABLE 1B-continued

| Name | SEQ ID NO: | Sequence |
|---|---|---|
| | | TATTACCCGATCCCGTATGATGACTACTGGGGACAGGGCACCCAAGTCACCGTC<br>TCCTCT |
| hIL27Ra_<br>VH<br>H4-<br>DR591 | 1279 | CAGGTTCAGTTGCAGGAATCTGGTGGGGGCCTCGTTCAGCCTGGGGAGAGCCTC<br>CGTCTGTCCTGCACCGCTTCAGGATTCACTTTCTCAAACTACGCCATGTCTTGG<br>GTCCGGCAGGCTCCGGGCAAAGGCTTGGAATGGGTGTCAGGCATCAATGTTGCA<br>TACGGCATTACCTCCTACGCAGATAGCGTGAAGGGCCGTTTCACCATCAGTCGT<br>GACAACACCAAAAACACTCTCTACTTGCAGCTCAATTCACTCAAGACAGAGGAC<br>ACCGCTATTTATTACTGTGTCAAACACTCCGGCACTACCATCCCACGCGGCTTC<br>ATTAGCTATACCAAACGCGGCCAGGGCACCCAGGTCACCGTCTCCTCTGGTGGC<br>GGTTCCCAGGTGCAGTTGCAGGAATCCGGCGGGGAAGCGTGCAGGCCGGTGGC<br>AGCCTGCGCCTGAGCTGCACAGCTTCCGGGGCTATCGCTTCTGGCTACATTGAT<br>TCCCGGTGGTGTATGGCCTGGTTCCGCCAGGCCCCTGGCAAAGAGCGTGAGGGC<br>GTGGCTGCGATCTGGCCTGGAGGGGGCCTGACCGTCTACGCCGATAGCGTTAAA<br>GGCAGGTTTACCATCAGCCGCGACCATGCCAAGAACACCCTGTACCTCCAGATG<br>AATAACCTGAAGCCTGAGGACACGGCCATGTATTACTGCGCCGCAGGCTCACCT<br>AGAATGTGCCCTAGTTTGGAGTTCGGCTTTGACTATTGGGGTCAGGGTACGCAG<br>GTGACTGTGTCCTCC |
| hIL27Ra_<br>VH<br>H4-<br>DR591 | 1280 | CAAGTGCAGTTGCAGGAGTCCGGTGGCGGACTCGTCCAGCCTGGAGAATCCCTG<br>AGGTTGAGCTGCACCGCGTCCGGGTTCACGTTCAGCAATTACGCCATGTCTTGG<br>GTGAGGCAAGCCCCAGGTAAAGGCCTTGAGTGGGTCAGCGGAATCAACGTGGCT<br>TACGGGATCACCAGTTACGCAGATAGCGTCAAGGGGCGGTTCACTATTAGCAGA<br>GATAACACTAAGAACACTCTGTACCTTCAGCTGAACTCACTCAAGACCGAAGAC<br>ACCGCCATTTATTACTGCGTAAAGCACAGCGGTACTACGATCCCTCGCGGCTTT<br>ATCAGCTATACTAAGCGCGGTCAAGGAACCCAAGTGACCGTGTCAAGCGGAGGG<br>AGCGGTGGATCTGGGGGATCAGGCCAGGTGCAGCTTCAGGAGAGTGGCGGTGGC<br>TCTGTGCAGGCCGGGGGCTCACTGAGACTGTCTTGCACTGCCAGCGGGGCTATC<br>GCGTCTGGCTACATCGACAGTCGCTGGTGCATGGCCTGGTTCAGACAGGCCCCT<br>GGTAAGGAGCGTGAAGGCGTGGCTGCCATTTGGCCTGGAGGCGGACTGACCGTC<br>TATGCGGATAGCGTCAAGGGGAGGTTTACCATTAGCCGCGACCACGCCAAGAAT<br>ACTCTGTACCTTCAGATGAATAACCTGAAACCCGAGGATACCGCGATGTATTAC<br>TGTGCAGCTGGCAGTCCTCGGATGTGTCCGAGCTTGGAGTTCGGGTTCGATTAT<br>TGGGGTCAGGGAACTCAGGTGACTGTGTCCTCC |
| hIL27Ra_<br>VH<br>H4-<br>DR592 | 1281 | CAGGTACAGCTCCAGGAATCCGGCGGAGGCCTTGTCCAGCCCGGAGAGTCCTTG<br>CGCCTCTCTTGCACCGCAAGCGGCTTCACCTTCTCCAACTATGCTATGTCTTGG<br>GTGCGTCAGGCCCCCGGCAAAGGCCTGGAATGGGTCAGCGGGATCAATGTGGCA<br>TACGGGATCACTTCCTACGCGATAGTGTCAAGGGTCGTTTTACCATCAGCCGT<br>GATAACACGAAAAACACTCTGTACCTCCAGCTCAACAGCCTGAAGACGGAAGAT<br>ACGGCTATCTATTACTGTGTCAAACACAGTGGCACGACTATTCCGCGCGGCTTC<br>ATCTCATATACTAAGCGCGGACAGGGGACCCAAGTGACTGTCAGCAGTGGCGGA<br>GGCTCCCAGGTGCAGCTCCAGGAATCCGGTGGCGGTTCCGTCCAAGCGGGCGGG<br>TCTCTGCGTCTTTCCTGTACCGCTCCGGGGTTTACCAGCAACTCTTGTGGAATG<br>GACTGGTACAGGCAGGCACCAGGGAAGGAGCGCGAGTTCGTTTCCAGCATCAGC<br>ACCGACGGAACCACTGGCTATGCCGACAGCGTGAAGGGTCGCTTCACGATCTCT<br>AAGGATAAGGCCAAAGATACTGTGTACCTGCAAATGAACTCTCTTAAACCGGAA<br>GATACAGGTATGTACTCATGCAAAACAAAAGACGGCACCATCGCCACGATGGAG<br>CTTTGCGATTTCGGATACTGGGGCCAGGGCACACAAGTGACGGTTAGTAGC |
| hIL27Ra_<br>VH<br>H4-<br>DR592 | 1282 | CAGGTCCAGCTCCAGGAGAGCGGCGGGGGCCTGGTCCAGCCAGGTGAGTCTCTG<br>CGTCTGTCTTGCACCGCTTCTGGTTTCACATTTTCCAATTATGCCATGTCCTGG<br>GTCCGCCAGGCTCCAGGGAAGGGCCTTGAGTGGGTCTCTGGCATCAACGTGGCC<br>TATGGCATCACCTCTTATGCCGACAGCGTGAAGGGTCGTTTCACCATCTCCCGC<br>GACAACACGAAGAACACACTGTACCTCCAGTTGAACAGCTTGAAGACCGAGGAC<br>ACCGCGATCTACTATTGCGTGAAGCATAGCGGGACCACGATCCCTCGCGGATTC<br>ATCAGCTATACGAAGCGCGGCCAGGTACACAGGTCACCGTTAGCTCCGGCGGT<br>AGTGGCGGGTCCGGTGGCAGCGGACAGGTGCAGCTCCAGGAGTCCGGTGGGGGT<br>TCCGTACAAGCCGGAGGCTCACTGCGCCTGTCCTGCACAGCTCCGGGTTTCACT<br>TCTAACAGTTGCGGCATGGACTGGTATCGCCAAGCCCCAGGCAAAGAAGAGAG<br>TTCGTTTCTAGCATCTCCACCGATGGCACCACAGGTTACGCCGACTCTGTCAAG<br>GGCCGCTTTACTATCAGCAAGGATAAGGCCAAGGACACCGTGTATCTTCAGATG<br>AACTCCCTGAAGCCCGAGGATACTGGGATGTACTCATGCAAGACCAAGGATGGA<br>ACTATCGCCACGATGGAGCTGTGTGACTTCGGTTATTGGGGGCAGGGCACCCAG<br>GTGACCGTCAGCAGC |
| hIL27Ra_<br>Ra_VH<br>H4-<br>DR593 | 1283 | CAGGTGCAGCTCCAGGAGAGTGGCGGGGGCCTGGTTCAGCCAGGTGAAAGCCTG<br>CGCTTGAGCTGCACCGCATCCGGCTTCACCTTCTCTAATTATGCCATGAGTTGG<br>GTGAGACAAGCCCCCGGCAAAGGACTGGAGTGGGTGTCTGGAATTAACGTAGCG<br>TATGGCATCACGTCCTACGCTGATAGCGTCAAGGGGCGCTTCACCATCTCCCGC<br>GACAACACGAAAACACCCTGTACCTCCAGCTGAACTCCCTCAAGACTGAAGAT<br>ACCGCGATTTATTACTGTGTGAAACACTCTGGACAACCATCCGTCGCGGCTTC<br>ATTAGTTACACCAAGCGCGGCCAGGGCACCCAGGTGACCGTCAGTTCCGGGGGC<br>GGAAGCCAGGTGCAGTTGCAGGAGTCCGGCGGAGGTTCCGTGCAGGCTGGCGGG<br>TCCCTGAGACTGTCCTGCGCAGCCAGCGGCTACCCTTATAGCAATGGCTACATG<br>GGATGGGTTTCGCCAGGCTCCTGGCAAGGAGCGCGAAGGTGTGGCCACTATTTAC<br>ACGGGTGATGGACGCACCTATTACGCCGACAGCGTCAAGGGCCGCTTTACCATT |

TABLE 1B-continued

| Name | SEQ ID NO: | Sequence |
|---|---|---|
| | | AGCCGGGATAACGCCAAGAATACTGTCGATCTCCAGATGTCTTCACTGAAACCT GAAGACACCGCCATGTACTATTGCGCCGCACGCGCCGCGCCGTTGTACTCTTCC GGCAGCCCCCTGACCCGTGCTGCTCGCTACAACGTCTGGGGGCAAGGCACACAGGTG ACAGTCTCCTCT |
| hIL27Ra_VH H4-DR593 | 1284 | CAGGTCCAGTTGCAGGAGAGCGGAGGGGGCCTGGTGCAGCCTGGGGAATCCCTC CGTCTCTCCTGCACCGCCAGCGGCTTCACCTTCAGCAACTACGCCATGAGCTGG GTGCGCCAGGCTCCAGGGAAGGGCCTGGAGTGGGTGTCAGGCATTAACGTCGCC TACGGCATCACCAGTTATGCCGATAGTGTCAAGGGCCGCTTCACTATCTCCAGG GACAACACAAAGAACACTCTCTATCTTCAGCTTAATTCCCTGAAAACTGAAGAC ACCGCTATCTATTACTGTGTGAAACACAGCGGAACAACCATCCCGCGCGGTTTC ATCTCCTACACTAAGAGAGGCCAGGGCACCCAGGTTACCGTTTCTAGCGGCGGA TCTGGGGGCAGCGGGGGCTCCGGTCAGGTCCAACTCCAAGAGTCTGGCGGAGGC TCTGTCCAGGCTGGCGGGTCTTTGCGTCTGTCCTGTGCCGCTTCTGGCTACCCG TACAGCAACGGTTACATGGGTTGGTTCAGACAGGCCCCCGGCAAAGAGAGGGAG GGAGTGGCCACCATCTACACCGGCGACGGCAGGACATATTACGCTGATTCCGTG AAGGGTCGTTTCACTATCTCCCGCGATAACGCCAAGAACACCGTCGATCTTCAG ATGTCATCCCTGAAGCCTGAAGACACTGCGATGTATTACTGTGCAGCTCGCGCC GCGCCCCTCTACAGCTCAGGTAGCCCACTGACACGTGCCCGGTACAACGTCTGG GGGCAGGGCACCCAGGTGACGGTGTCTTCC |
| hIL27Ra_VH H4-DR594 | 1285 | CAGGTGCAGCTCCAGGAAAGCGGTGGCGGGCTGGTTCAGCCTGGCGAGTCCCTC CGTCTGTCCTGCACAGCTAGTGGTTTTACGTTTAGCAACTACGCGATGAGCTGG GTCCGTCAAGCCCCTGGTAAGGGGCTGGAGTGGGTGTCCGGCATCAACGTGGCC TACGGCATCACCTCCTACGCTGACTCTGTGAAGGGCCGGTTCACTATCAGCCGG GATAACACTAAGAACACCTTGTATCTCCAACTGAACTCCCTGAAGACAGAGGAC ACCGCTATTTACTATTGTGTGAAGCACTCTGGCACGACCATCCCCAGGGGCTTC ATCAGCTACACCAAGCGTGGGCAGGGTACACAGGTGACAGTCTCCAGCGGCGGA GGCTCCCAAGTGCAGCTGCAAGAATCTGGCGGGGAAGCGTCCAGGCCGGTGGA AGTCTGCGCCTTAGTTGCGTGGCTTCTGCAAGCACCTATTGCACCTATGACATG CACTGGTATAGGCAGGCCCCCGGCAAGGGGCGCGAGTTCGTTAGCGCCATCGAC AGTGATGGGACCACGCGCTACGCGGACAGTGTGAAGGGCAGGTTCACCATCAGC CAGGGTACTGCCAAAAATACAGTGTACTTGCAGATGAACTCCTCCAGCCTGAG GACACCGCCATGTACTATTGCAAGACCGTGTGCGTCGTAGGCTCCCGTTGGAGC GACTACTGGGGCCAGGGCACACAGGTGACCGTCTCCTCC |
| hIL27Ra_VH H4-DR594 | 1286 | CAGGTCCAACTGCAAGAGTCTGGAGGTGGATTGGTCCAGCCCGGCGAAAGCCTG AGGTTGAGCTGCACCGCGAGCGGATTCACCTTTAGCAACTATGCCATGTCTTGG GTTCGCCAAGCCCCTGGGAAGGGCCTGGAGTGGGTCAGTGGGATCAATGTGGCT TATGGAATCACCAGCTATGCGGACTCTGTGAAGGGAAGGTTCACTATCTCTCGT GACAATACTAAAAACACCCTGTACCTCCAGCTCAATTCCCTCAAGACTGAGGAC ACCGCTATTTACTATTGTGTGAAACACTCCGGCACCACGATCCCCCGTGGGTTC ATCAGCTACACCAAACGGGGCCAAGGCACCCAGGTCACCGTATCTAGTGGCGGT AGTGGTGGGAGTGGCGGTTCCGGGCAGGTGCAGCTCCAGGAGTCCGGCGGTGGC TCCGTGCAGGCAGGCGGTAGCCTGCGCCTGTCCTGTGGCGTCTGCAAGCACC TATTGTACTTATGATATGCACTGGTATCGTCAGGCTCCAGGCAAGGGCAGAGAG TTCGTCTCCGCAATCGACTCCGATGGCACCACGCGCTACGCCGATTCTGTGAAG GGCCGTTTCACTATCAGCCAGGGTACAGCCAAAAATACCGTGTATCTTCAGATG AACAGTCTCCAGCCAGAGGATACCGCTATGTACTATTGCAAGACTGTGTGCGTG GTTGGCTCCAGGTGGTCCGATTACTGGGGCCAGGGAACCCAGGTGACAGTGTCC AGC |
| hIL27Ra_VH H4-DR595 | 1287 | CAGGTGCAGCTCCAGGAGAGCGGAGGGGGTTTGGTCCAGCCTGGCGAGTCTCTC AGACTTTCTTGTACCGCATCTGGCTTTACTTTCAGCAATTACGCCATGTCCTGG GTGCGGCAAGCCCCCGGCAAGGGCCTGGAATGGGTGAGCGGCATCAACGTGGCC TACGGCATCACCTCATACGCAGATTCCGTCAAGGGGCGTTTTACCATCAGTCGC GATAATACAAAGAACACATTGTACCTCCAACTGAACTCCCTCAAGACCGAGGAT ACCGCGATTTACTATTGCGTGAAACACAGCGGCACTACCATCCCACGCGGGTTT ATCAGCTACACGAAGAGGCCAGGGTACACAGGTCACCGTGTCAAGCGGCGCT GGATCTCAGGTACAGCTCCAGGAGTCTGGGGGTGGAAGCGTGCAGGCGGGCGGA TCTCTGACATTGTCCTGCGCCGCAAGTGAGTATGCTTATTCCACGTGCAACATG GGATGGTACAGGCAGGCCCCTGGTAAAGAGAGAGAACTCGTGAGCGCTTTTATT TCAGACGGCAGCACTTATTACGCCGACTCCGTCAAAGGACGCTTCACCATCACT CGTGACAACGCTAAGAATACGGTCTACCTTCAGATGAACTCCCTCAAACCTGAA GATACTGCAATCTACTATTGTAGTGCCAACTGCTATAGACGCCTCCGCAACTAT TGGGGGCAGGGAACACAGGTGACCGTTAGCAGC |
| hIL27Ra_VH H4-DR595 | 1288 | CAAGTTCAGCTGCAAGAGTCTGGCGGTGGCCTGGTGCAGCCCGGCGAATCTTTG CGCTTGAGTTGTACCGCCTCTGGTTTTACATTCTCAAACTATGCAATGAGCTGG GTGAGACAGGCCCCAGGCAAGGGCTTGGAATGGGTCTCTGGGATCAACGTCGCT TACGGCATTACCTCATACGCCGATAGCGTCAAGGGTCGCTTCACTATCTCTCGG GATAATACGAAGAATACTCTCTACTTGCAGCTCAACTCACTGAAGACCGAGGAC ACTGCGATCTATTACTGCGTCAAACACTCCGGCACCACTATCCCTCGCGGCTTC ATCCTTACACTAAACGCGGCCAGGGTACTCAGGTGACTGTGAGTTCAGGTGGC TCTGGAGGTAGCGGGGGTTCCGGTCAGGTGCAGCTCCAGGAGAGCGGGGGCGGA AGCGTACAGGCTGGAGGCAGCCTGACCTTGAGCTGTGCAGCTTCCGAGTATGCC TACTCCACCTGTAACATGGGATGGTATAGACAGGCTCCCGGCAAGGAACGTGAG |

TABLE 1B-continued

| Name | SEQ ID NO: | Sequence |
|---|---|---|
| | | CTGGTCAGCGCCTTTATCAGTGATGGGTCCACTTACTATGCCGATTCCGTGAAA<br>GGCCGGTTCACCATCACTCGCGACAACGCCAAGAATACAGTGTACTTGCAGATG<br>AACTCCCTCAAGCCCGAGGACACTGCTATCTATTACTGTTCTGCAAACTGCTAC<br>CGTCGCCTGCGCAACTACTGGGGCCAAGGCACTCAGGTTACCGTGAGCAGC |
| hIL27Ra_<br>VH<br>H4-<br>DR596 | 1289 | CAGGTGCAGTTGCAGGAGTCTGGAGGTGGCCTGGTCCAACCTGGAGAATCCCTG<br>CGGCTCTCTTGTACCGCGAGTGGTTTCACCTTCAGCAACTATGCAATGAGCTGG<br>GTGCGCCAGGCTCCCGGCAAGGGATTGGAGTGGGTCAGCGGCATCAACGTGGCC<br>TATGGCATCACCAGCTACGCTGATAGTGTGAAGGGCCGGTTTACCATCAGTAGG<br>GACAACACCAAGAACACACTGTATCTTCAGCTCAACTCCCTGAAGACAGAAGAC<br>ACCGCTATCTACTATTGTGTGAAGCATTCCGGCACTACCATCCCACGCGGGTTC<br>ATCCTCATACACCAAAAGGGGCCAGGGCACCCAGGTGACAGTTTCTAGCGGTGGC<br>GGTTCCCAAGTGCAGTTGCAGGAGTCCGGTGGCGGTCTGGTTCAGCCTGGTGGG<br>TCTCTTCGTCTGAGTTGTACCGCAAGCGGTCTTACCTTCGATGACAGCGTCATG<br>GGGTGGTTCAGGCAGGCCCCCGGCAAGGGTCGCGAGGCAGTGAGCTGCATCAGC<br>TCCAGTGGGGCTAACGCCTTTTATGCAGACTCCGTAAAAGGAAGATTCACTATC<br>AGCAGGGACAACGCAAAGAACACCCTGTATCTCCAAATGAACAGTCTGAAACCG<br>GAAGACACCGCCACTTATTACTGTAAACGCGGCCACGCCTGCGCAGGGTATTAC<br>CCGATTCCTTATGATGACTACTGGGGCCAAGGCACCCAGGTGACAGTGTCTAGC |
| hIL27Ra_<br>VH<br>H4-<br>DR596 | 1290 | CAGGTGCAGCTCCAGGAAAGCGGAGGCGGGCTGGTGCAGCCGGAGAGAGTCTC<br>AGGCTTTCTTGTACCGCCTCTGGATTTACATTCAGCAATTACGCCATGTCCTGG<br>GTTCGCCAAGCACCAGGGAAGGGCCTGGAGTGGGTGTCCGGCATCAACGTGGCA<br>TACGGCATCACATCCTACGCGGATTCCGTCAAGGGTCGGTTTACCATCAGCCGC<br>GATAATACAAAGAACACCTTGTATCTCCAGCTTAACAGCCTCAAGACAGAGGAC<br>ACCGCCATCTACTATTGTGAAGCACTCCGGCACCACTATCCCTCGCGGTTTC<br>ATTTCCTACACCAAAAGGGGTCAGGGCACTCAGGTAACAGTGTCCTCTGGGGGC<br>TCCGGTGGATCAGGTGGCTCCGGCCAGGTACAACTCCAAGAGTCAGGAGGCGGT<br>CTGGTACAGCCTGGTGGCTCCTTGCGCCTGTCTTGCACAGCAAGCGGCCTGACT<br>TTCGATGACTCTGTGATGGGCTGGTTTCGTCAGGCCCCAGGGAAGGGCAGGGAG<br>GCCGTCTCCTGCATTAGTAGCTCCGGCGCTAACGCCTTCTATGCCGATAGTGTG<br>AAGGGGCGCTTTACCATCTCTCGTGACAATGCCAAGAACACCCTGTACTTGCAG<br>ATGAACAGCCTGAAGCCGGAGGATACTGCCACCTATTACTGCAAGCGCGGCCAT<br>GCGTGTGCTGGCTACTATCCCATCCCTTACGATGACTATTGGGGTCAGGGCACC<br>CAGGTGACCGTGTCCAGC |
| hIL27Ra_<br>VH<br>H5-<br>DR591 | 1291 | CAGGTCCAGCTTCAGGAAAGCGGGGGTGGATCTGTCCAGGCGGGCGGATCACTT<br>CGCCTCAGTTGTACGGCCAGTGGCTATGTATCCTGCGACTACTTCCTCCCATCA<br>TGGTATCGCCAGGCTCCGGAAAGGAAAGGGAGTTCGTGTCTGTGATCGACGGC<br>ACTGGCTCCACCTCCTACGCTGCCAGCGTCAAGGGTCGCTTCACCGCCTCACAG<br>GACAAGGGCAAAAACATCGCCTATCTTCAGATGAACTCCCTGAAACCCGAGGAC<br>ACAGCCATGTATTACTGTAAGGCCTCCTGTGTGCGTGGCCGCGCAATTTCCGAA<br>TATTGGGGCCAGGGCACTCAGGTGACTGTGAGTTCCGGCGGGGGTTCCCAGGTC<br>CAGTTGCAGGAGTCCGGTGGCGGATCTGTGCAGGCCGGAGGGTCCCTGCGCCTG<br>AGCTGCACAGCGAGCGGTGCCATCGCCTCCGGCTATATTGACTCCAGGTGGTGC<br>ATGGGCCTGGTTCAGGCAAGCGCCCGAAAAGAGCGTGAAGGTGTAGCTGCCATC<br>TGGCCTGGCGGAGGCCTGACCGTGTATGCCGATTCCGTCAAGGGCCGCTTCACC<br>ATCAGCCGCGACCACGCAAAAAACACTCTGTACCTCCAGATGAATAACCTGAAG<br>CCGGAGGACACCGCCATGTATTACTGTGCTGCCGGTTCTCCCCGTATGTGCCCC<br>AGCCTGGAGTTCGGCTTCGACTACTGGGGCCAGGGAACTCAGGTCACTGTGTCA<br>TCT |
| hIL27Ra_<br>VH<br>H5-<br>DR591 | 1292 | CAGGTCCAGCTCCAAGAGTCTGGAGGTGGCTCTGTGCAGGCTGGCGGTTCCCTC<br>CGCCTGAGCTGCACAGCGAGCGGGTACGTGAGCTGCGATTATTTTCTGCCGTCT<br>TGGTATCGTCAAGCGCCCGGAAAGGAGCGCGAGTTCGTGTCCGTGATCGACGGT<br>ACGGGTAGCACCAGTTACGCGGCTTCTGTAAAAGGACGGTTCACCGCTTCCCAG<br>GATAAGGGCAAAAACATCGCGTATTTGCAGATGAACAGCCTGAAGCCCGAGGAT<br>ACCGCCATGTATTACTGTAAGGCCAGTTGTGTCAGAGGCCGCGCCATCTCCGAG<br>TACTGGGGACAGGGCACTCAGGTGACCGTGTCCAGCGGTGGAAGCGGTGGCTCC<br>GGGGGCTCCGGTCAGGTCCAGTTGCAAGAGTCAGGCGGTGGCTCCGTCCAGGCG<br>GGCGGGAGCCTGCGCTTGTCCTGCACAGCTTCTGGGGCCATCGCCTCCGGCTAT<br>ATCGACAGCCGCTGGTGCATGGCGTGGTTCCGCCAAGCGCCGGGCAAGGAACGT<br>GAAGGCGTCGCAGCTATTTGGCCTGGGGGCGGGTTGACCGTGTACGCCGACTCC<br>GTGAAGGGCCGTTTCACCATCAGTAGAGACCACGCCAAGAACACTCTCTACCTT<br>CAGATGAATAACCTGAAACCGGAGGACACTGCTATGTATTACTGCGCTGCGGGC<br>TCCCCCAGGATGTGTCCAGCCTGGAGTTCGGCTTCGACTATTGGGGCAGGGG<br>ACCCAGGTCACCGTGTCCTCC |
| hIL27Ra_<br>VH<br>H5-<br>DR592 | 1293 | CAGGTTCAGCTCCAGGAATCCGGCGGAGGCTCTGTCCAGGCTGGGGGTTCTTTG<br>CGTTTGAGCTGTACCGCGAGCGGGTACGTGTCTTGCGACTACTTCTTGCCTTCC<br>TGGTATCGCCAGGCTCCTGGTAAGGAACGCGAGTTCGTCTCCGTCATTGATGGC<br>ACCGGCTCTACGAGCTATGCTGCCTCAGTTAAGGGCCGCTTCACAGCCAGCCAG<br>GATAAGGGCAAAAATATCGCTTACCTCCAGATGAACTCTCTGAAACCTGAAGAC<br>ACTGCCATGTATTACTGTAAAGCGAGCTGCGTAAGAGGACGTGCCATCAGCGAG<br>TACTGGGGCCAAGGGACACAGGTGACAGTTAGTAGCGGTGGCGGGTCCCAGGTG<br>CAGTTGCAAGAGAGCGGTGGCGGAAGCGTGCAGGCAGGCGGATCTCTGCGGCTG<br>TCCTGCACCGCCCCTGGATTCACCAGTAACTCTTGTGGTATGGACTGGTATCGT |

TABLE 1B-continued

| Name | SEQ ID NO: | Sequence |
|---|---|---|
| | | CAGGCTCCGGGTAAGGAGAGAGAGTTTGTTTCAAGTATCTCCACTGATGGCACA<br>ACCGGGTATGCCGACTCCGTCAAGGGTCGTTTCACCATCTCCAAGGACAAGGCC<br>AAGGACACTGTGTACCTTCAGATGAACTCACTGAAGCCTGAGGACACCGGGATG<br>TATTCTTGCAAGACTAAAGATGGCACCATTGCCACTATGGAGCTGTGCGACTTC<br>GGCTATTGGGGTCAGGGGACACAGGTCACTGTATCTAGC |
| hIL27Ra_<br>VH<br>H5-<br>DR592 | 1294 | CAGGTGCAGCTTCAGGAGTCCGGCGGTGGGAGCGTTCAGGCTGGAGGCTCTCTC<br>AGGCTGTCATGCACTGCAAGCGGGTACGTTAGTTGTGACTACTTTCTTCCAAGC<br>TGGTATCGCCAGGCTCCCGGAAAAGAGCGCGAGTTTGTTTCCGTTATTGATGGA<br>ACTGGGAGTACGTCCTATGCCGCTTCAGTCAAGGGGCGCTTCACCGCATCCCAG<br>GACAAGGGTAAGAATATCGCTTACCTTCAGATGAACTCCCTGAAGCCCGAAGAC<br>ACCGCGATGTATTACTGTAAGGCTTCTTGCGTGAGGGGCCGCGCTATCAGTGAA<br>TACTGGGGTCAGGGGACCCAGGTGACGGTTTCTAGCGGAGGCAGCGGCGGAGC<br>GGCGGGTCTGGACAGGTCCAGCTTCAGGAAAGTGGTGGGGGCTCCGTTCAGGCT<br>GGCGGGATCACTGCGCCTGAGCTGTACTGCTCCCGGCTTCACGAGCAACTCCTGC<br>GGTATGGACTGGTATCGTCAGGCCCCAGGTAAGGAGCGTGAGTTCGTGTCTTCC<br>ATCAGTACAGACGGGACAACCGGCTACGCAGACAGCGTAAAGGGCCGCTTCACC<br>ATCTCCAAGGATAAGGCAAAGGACACCGTCTACCTCCAGATGAACAGCTTGAAG<br>CCAGAGGACACGGGTATGTATAGCTGTAAGACCAAAGACGGTACAATCGCTACA<br>ATGGAGCTGTGTGACTTCGGGTATTGGGGCCAGGGAACTCAGGTTACCGTCTCA<br>TCC |
| hIL27Ra_<br>VH<br>H5-<br>DR593 | 1295 | CAGGTGCAGCTCCAGGAGAGCGGGGGCGGTTCTGTGCAAGCTGGGGGAAGTCTG<br>CGGCTCAGCTGTACCGCTAGTGGTTACGTGTCTTGCGACTATTTCCTGCCTTCA<br>TGGTATCGCCAGGCCCCAGGCAAAGAGCGCGAGTTCGTGTCCGTCATTGACGGA<br>ACCGGGAGTACCTCCTATGCAGCCAGTGTTAAGGGCCGTTTTACAGCCAGCCAG<br>GACAAGGGCAAAAATATCGCTTACCTCCAGATGAACAGCCTGAAGCCCGAGGAC<br>ACTGCCATGTATTACTGTAAAGCGAGCTGTGTCAGGGGTAGAGCAATTAGTGAA<br>TATTGGGGCCAAGGGACACAGGTGACAGTATCTTCAGGGGGCGGATCTCAGGTG<br>CAGCTCCAGGAAAGTGGAGGTGGGTCCGTGCAGGCGGGCGGTTCTCTCAGACTG<br>TCTTGCGCCGCGTCTGGCTATCCTTACAGCAACGGGTACATGGGATGGTTTAGA<br>CAAGCCCCAGGGAAGGAGCGCGAGGGGGTGGCCACCATTTACACCGGCGATGGC<br>CGGACTTACTATGCGGATTCCGTGAAGGGCCGCTTTACCATTTCAAGAGATAAC<br>GCGAAAAATACCGTGGACCTCCAGATGTCCTCTTTGAAGCCAGAGGATACCGCG<br>ATGTACTATTGCGCTGCCCGCGCCGCTCCTCTCTACAGTAGCGGCTCCCCACTT<br>ACCCCGCGCTCGCTATAACGTGTGGGGCCAGGGGACACAGGTGACTGTGTCCTCC |
| hIL27Ra_<br>VH<br>H5-<br>DR593 | 1296 | CAGGTGCAGCTTCAGGAATCTGGGGGTGGGTCCGTCCAGGCTGGCGGATCTTTG<br>AGACTGTCTTGCACTGCCAGTGGTTACGTGAGCTGTGATTACTTCCTGCCGTCT<br>TGGTATCGTCAAGCGCCAGGCAAGGACGTGAGTTCGTGTCCGTGATCGACGGG<br>ACAGGTTCCACATCTTACGCCGCATCTGTTAAGGGGAGGTTCACAGCTTCTCAG<br>GACAAGGGTAAAAATATCGCCTATCTCCAGATGAACTCACTGAAGCCTGAAGAT<br>ACCGCTATGTATTACTGCAAGGCTTCTTGTGTGCGGGGCCGCGCTATCAGCGGA<br>TACTGGGGACAGGGCACTCAGGTGACGGTCTCCAGCGGCGGGAGCGGGGGCTCC<br>GGGGGCAGCGGCCAGGTGCAGTTGCAGGAGAGCGGGGGAGGCTCTGTGCAAGCT<br>GGAGGGCTCTTTGCGCCTGTCCTGCGCTGCCAGCGGATATCCTTACTCTAATGGT<br>TATATGGGATGGTTCAGGCAGGCCCCAGGAAAGGAGAGAAGGGGTTGCCACC<br>ATTTATACTGGGGATGGCCGCACCTATTACGCCGATTCCGTGAAGGGGCGGTTC<br>ACAATCTCTCGTGACAACGCCAAGAACACTGTCGATCTTCAGATGTCCAGTCTG<br>AAACCGGAGGACACTGCCATGTATTACTGTGCCGCACGCGCAGCTCCCCTCTAT<br>TCAAGCGGCTCCCCTCTCACTCGCGCACGCTATAACGTGTGGGGCCAGGGGAACT<br>CAGGTGACTGTGTCTAGC |
| hIL27Ra_<br>VH<br>H5-<br>DR594 | 1297 | CAGGTGCAGCTGCAAGAGAGCGGCGGTGGCAGCGTGCAAGCCGGAGGTTCTCTG<br>CGGCTGAGTTGTACCGCTTCTGGATACGTGTCCTGCGACTACTTTTTGCCTTCA<br>TGGTATCGGCAGGCCCCAGGCAAAGAACGCGAGTTTGTGTCAGTGATCGACGGC<br>ACTGGTTCCACATCTACGCAGCCAGCGTGAAGGGCCGTTTTACTGCGTCTCAG<br>GATAAAGGCAAGAACATCGCTTATTGCAAATGAACAGCCTGAAGCCTGAAGAC<br>ACAGCCATGTATTACTGCAAGGCAAGCTGCGTTCGCGGTCGGGCGATCTCCGAG<br>TACTGGGGGCAGGGTACACAGGTCACCGTCTCCAGTGGAGGTGGCTCCCAGGTG<br>CAGCTTCAGGAAAGCGGTGGGGAAGCGTCCAAGCTGGGGGCTCTCTCCGCCTC<br>TCATGTGTGGCCTCTGCCTCCACCTACTGCACTTACGATATGCACTGGTATCGT<br>CAGGCACCAGGGAAGGGACGCGAGTTCGTGTCCGCCATCGACAGCGACGGGACA<br>ACCCGGTACGCCGACTCTGTGAAAGGCCGCTTCACCATCAGCCAGGGGACAGCT<br>AAAAACACCGTGTACCTGCAAATGAACTCCCTCCAGCCAGAGGATACCGCCATG<br>TACTATTGTAAGACCGTATGCGTAGTGGGCAGCAGATGGTCCGACTATTGGGGC<br>CAGGGGACGCAGGTCACCGTGTCCAGC |
| hIL27Ra_<br>VH<br>H5-<br>DR594 | 1298 | CAGGTCCAGCTCCAGGAATCCGGTGGCGGTTCCGTGCAGGCAGGCGGGAGCCTG<br>CGTCTGAGTTGCACTGCCAGCGGCTACGTTTCATGTGATTACTTCCTGCCCAGT<br>TGGTACAGGCAGGCTCCTGGTAAAGAGCGCGAGTTCGTGAGCGTGATTGATGGG<br>ACTGGTTCAACCAGTTACGCGGCCAGCGTGAAGGGCGCTTCACCGCTTCCCAG<br>GACAAGGGTAAGAACATCGCATATCTTCAGATGAACTCTCTCAAGCCTGAAGAC<br>ACCGCTATGTACTATTGCAAAGCAGCTGCGTGCGTGGCCGCGCCATCAGCGAA<br>TACTGGGGGCAGGGCACCCAGGTCACTGTGTCTAGCGGTGGCTCAGGAGGGAGC<br>GGAGGCTCCGGCCAGGTGCAGCTCCAGGAGTCTGGCGGTGGCAGCGTTCAGGCT<br>GGCGGGAGCCTGCGCCTGAGCTGCGTGGCCTCTGCATCCACCTATTGCACCTAC |

TABLE 1B-continued

| Name | SEQ ID NO: | Sequence |
|---|---|---|
| | | GACATGCACTGGTATCGCCAGGCTCCTGGTAAGGGCCGTGAGTTCGTGAGCGCT<br>ATTGATAGCGACGGGACTACCCGTTACGCGGATTCTGTGAAGGGCAGATTCACC<br>ATCAGCCAGGGCACCGCCAAAAATACTGTTTATCTCCAGATGAATAGCCTGCAA<br>CCAGAAGACACCGCCATGTATTACTGCAAGACCGTGTGCGTAGTGGGAAGTAGG<br>TGGAGTGATTACTGGGGCAGGGTACACAAGTCACAGTTTCAAGC |
| hIL27Ra_<br>VH<br>H5-<br>DR595 | 1299 | CAGGTCCAGCTCCAGGAGAGCGGCGGAGGTAGCGTCCAGGCGGGCGGAAGCCTC<br>AGACTGAGCTGCACAGCCTCTGGGTACGTCTCCTGCGACTATTTCCTGCCATCA<br>TGGTATAGGCAAGCACCAGGCAAGGAGAGGGAGTTCGTGAGTGTGATTGACGGA<br>ACAGGGAGTACCTCCTACGCCGCATCTGTTAAGGGCGGTTCACTGCAAGTCAG<br>GATAAAGGTAAGAACATTGCCTACCTGCAAATGAACTCCCTGAAGCCAGAGGAC<br>ACCGCAATGTATTACTGCAAGGCGAGCTGCGTTCGTGGTCGCGCAATCTCCGAG<br>TACTGGGGCCAAGGGACCCAGGTGACCGTGTCTTCCGGTGGCGGTTCCCAGGTG<br>CAGCTCCAGGAGTCCGGGGGTGGCTCTGTGCAGGCCGGGGGCTCTCTGACCCTC<br>TCCTGTGCGGCCAGCGAGTACGCCTACTCTACTTGTAACATGGGGTGGTATCGC<br>CAGGCTCCCGGCAAGGAGCGTGAGCTTGTTAGTGCATTTATCTCCGACGGTTCC<br>ACCTATTACGCCGACAGCGTGAAGGGCCGCTTTACCATTACCCGTGACAATGCG<br>AAGAACACTGTATATTTGCAGATGAACTCCTTGAAGCCCGAAGACACCGCCATC<br>TACTATTGCAGCGCTAACTGTTACCGTCGCCTGCGCAACTATTGGGGGCAGGGG<br>ACACAGGTGACAGTCTCCTCC |
| hIL27Ra_<br>VH<br>H5-<br>DR595 | 1300 | CAGGTGCAGCTTCAGGAGAGCGGCGGAGGGTCCGTCCAAGCTGGCGGTTCCCTG<br>AGACTGAGTTGCACCGCTTCAGGGTATGTTTCCTGTGACTATTTCCTTCCGAGC<br>TGGTATCGGCAAGCGCCAGGAAAGGAGCGTGAGTTTGTCAGCGTGATCGACGGC<br>ACCGGAAGCACCTCCTACGCCGCGAGTGTGAAAGGCCGTTTTACTGCATCCCAA<br>GACAAAGGCAAGAACATCGCCTACCTTCAAATGAACTCTCTGAAGCCCGGAGGAC<br>ACCGCCATGTACTATTGCAAGGCATCTTGCGTCAGGGGCAGGGCCATCTCAGAG<br>TACTGGGGACAGGGAACCCAGGTGACAGTGTCTTCCGGCGGAAGTGGTGGCTCT<br>GGTGGCTCTGGTCAGGTTCAGTTGCAGGAGTCCGGTGGAGGCTCAGTGCAGGCC<br>GGTGGCTCCCTGACGCTGTCTTGCGCGGCCAGCGAGTATGCTTATTCCACCTGC<br>AATATGGGGTGGTATCGCCAGGCCCCCGGAAAGGAACGTGAGCTGGTGAGCGCC<br>TTCATCAGCGACGGGTCTACTTATTACGCTGATTCCGTCAAGGGTAGGTTTACC<br>ATCACACGGGATAATGCCAAGAACACCGTCTACCTCCAGATGAACTCTCTGAAG<br>CCCGAAGACACTGCCATCTACTATTGCTCCGCAAATTGCTACCGCAGACTGAGA<br>AATTATTGGGGCCAGGGAACTCAGGTGACTGTGTCATCA |
| hIL27Ra_<br>VH<br>H5-<br>DR596 | 1301 | CAGGTGCAGCTTCAGGAATCCGGGGGCGGGTCTGTGCAGGCTGGTGGCTCTCTG<br>CGCCTCTCTTGCACCGCAAGCGGATACGTGTCCTGTGACTACTTCCTGCCGTCT<br>TGGTACAGACAAGCGCCCGGTAAAGAGCGCGAGTTCGTTTCCGTCATTGATGGC<br>ACCGGGAGCACTTCCTACGCAGCCAGCGTAAAGGGCAGATTCACGGCTTCTCAA<br>GACAAGGGCAAGAATATCGCGTACCTCCAGATGAACTCTCTGAAGCCCGAGGAC<br>ACCGCGATGTACTATTGCAAGGCGAGCTGCGTGAGAGGCAGGGCCATCTCCGAA<br>TACTGGGGCCAGGGCACCCAGGTGACCGTGTCTAGCGGTGGCGGTAGCCAGGTA<br>CAGTTGCAGGAATCAGGCGGTGGATTGGTTCAGCGGGTGGAAGCCTGAGGCTT<br>AGCTGCACCGCCTCCGGGTTGACTTTCGACGATTCTGTAATGGGCTGGTTTCGC<br>CAGGCCCCTGGTAAGGGGAGGGAGGCTGTGAGCTGCATTTCTTCCAGTGGAGCC<br>AATGCTTTCTACGCGACTCCGTCAAGGGGAGATTCACCATCAGCCGCGACAAT<br>GCAAAAAACACTCTGTACCTCCAGATGAACTCCTTGAAGCCCGAGGACACTGCT<br>ACTTATTACTGTAAAAGAGGACACGCTTGTGCTGGCTACTATCCTATCCCTTAC<br>GATGACTATTGGGGTCAGGGCACTCAAGTGACCGTCTCCTCC |
| hIL27Ra_<br>VH<br>H5-<br>DR596 | 1302 | CAGGTGCAGTTGCAGGAGTCTGGAGGCGGAAGCGTCCAAGCCGGGGGTTCCCTG<br>AGACTCTCTTGCACCGCCTCCGGCTACGTATCCTGCGACTACTTCCTGCCCAGC<br>TGGTATCGCCAGGCTCCCGGTAAGGAGCGCGAGTTTGTCAGCGTGATCGACGGC<br>ACCGGCTCCACCTCTTATGCCGCTAGTGTTAAGGGCCGCTTTACTGCTCCTCCCAG<br>GACAAGGGCAAAAACATTGCCTACCTCCAGATGAACAGCCTGAAGCCCGAGGAC<br>ACCGCAATGTATTACTGCAAGGCGTCCTGCGTGAGGGGTCGTGCCATTTCTGAG<br>TACTGGGGCCAGGGGACCCAAGTCACCGTAAGTTCTGGGGCTCTGGCGGTAGC<br>GGAGGGAGTGGACAGGTGCAGCTCCAGGAGAGCGGCGGAGGCCTGGTGCAGCCT<br>GGTGGGTCACTGAGACTGTCCTGCACAGCTTCAGGCCTGACCTTTGACGATTCT<br>GTCATGGGGTGGTTCAGGCAAGCTCCGGGGAAAGGGCGCGAGGCCGTAAGCTGC<br>ATCAGTAGCTCTGGTGCCAATGCTTTCTACGCGGACTCCGTGAAGGGGCGCTTT<br>ACAATCTCTCGCGATAATGCTAAGAACACCTTGTATCTCCAAATGAACTCTTTG<br>AAGCCCGAGGACACCGCCACCTACTATTGTAAGAGAGGGCACGCATGTGCTGGG<br>TATTACCCTATCCCTTATGATGACTACTGGGGCAAGGAACACAGGTTACTGTG<br>TCTTCC |
| hIL27Ra_<br>VH<br>H6-<br>DR591 | 1303 | CAGGTGCAGCTCCAGGAGTCTGGAGGTGGCCTGGTGCAGCCCGGCGGAAGCCTT<br>CGCCTGAGTTGTGCGGCATCCGGCTTTTCCTTCTCATCTTACGCGATGAAGTGG<br>GTCCGCCAGGCCCCAGGGAAAGGCCTGGAGTGGGTGAGTACCATTTCATCCGGC<br>GGTAGCTCCACCAATTATGCTGACAGCGTGAAGGGTAGGTTCACCATCAGCCGC<br>GATAATGCCAAGAACACCCTCTACCTCCAGTTGAACTCCCTGAAGCATCGAAGAC<br>ACAGCTATGTATTACTGCGCCAAGGCCATCGTTCCCACTGGGGCACAATGGAG<br>AGGGGACAGGGACGCAGGTGACTGTTAGCTCCGGTGGGGCAGCCAAGTACAG<br>TTGCAGGAGTCTGGTGGCGGTTCCGTGCAGGCCGGGGCTCACTGCTCTGTCC<br>TGTACCGCTTCTGGTGCTATCGCCTCTGGATACATTGATTCTCGCTGGTGCATG<br>GCGTGGTTCAGGCAAGCCCCTGGTAAAGAAAGAGAGGGTGTGGCTGCCATCTGG |

TABLE 1B-continued

| Name | SEQ ID NO: | Sequence |
|---|---|---|
| | | CCAGGAGGCGGGCTCACTGTATACGCAGATTCTGTGAAGGGAAGATTCACTATC<br>TCACGGGATCACGCCAAAAATACGCTGTATTTGCAGATGAACAATTTGAAGCCG<br>GAGGACACCGCGATGTACTATTGTGCTGCGGGCTCTCCTCGTATGTGCCCCTCC<br>CTGGAGTTCGGATTCGATTATTGGGGCCAGGGCACGCAAGTTACCGTAAGCAGT |
| hIL27Ra_<br>VH<br>H6-<br>DR591 | 1304 | CAGGTCCAGTTGCAGGAGAGTGGTGGCGGTCTCGTGCAACCGGGAGGCAGCCTC<br>AGGCTGTCCTGCGCTGCCAGCGGGTTTTCCTTCAGCTCTTATGCGATGAAATGG<br>GTCCGCCAGGCTCCAGGCAAAGGTCTGGAGTGGGTGAGCACCATCAGCTCAGGA<br>GGCTCCAGCACGAACTACGCTGACTCCGTTAAGGGACGGTTCACTATCTCAAGA<br>GACAATGCAAAAAATACTCTGTATCTCCAGCTGAACTCCCTGAAGATCGAAGAC<br>ACTGCTATGTATTACTGTGCCAAGGCCATCGTTCCTACAGGCGCGACAATGGAG<br>CGTGGCCAGGGCACCCAGGTCACAGTGTCTTCAGGAGGCAGCGGTGGAAGCGGG<br>GGCTCTGGCCAAGTGCAACTCCAGGAGTCAGGCGGGGGCTCCGTGCAGGCAGGA<br>GGCAGCCTTCGCCTGTCCTGTACCGCATCAGGCGCTATTGCAAGCGGCTACATC<br>GACTCCCGGTGGTGCATGGCCTGGTTCCGCCAAGCGCCGGGCAAAGAGCGCGAG<br>GGCGTGGCTGCAATCTGGCCTGGTGGAGGCTTGACAGTGTATGCCGATAGTGTG<br>AAGGGCCGCTTCACAATCAGCCGGGATCACGCAAAGAATACCCTGTACCTCCAG<br>ATGAATAACCTGAAGCCTGAAGACACCGCCATGTACTATTGCGCAGCTGGCAGT<br>CCTCGCATGTGTCCCAGCCTGGAGTTTGGATTCGATTACTGGGGTCAAGGTACA<br>CAGGTGACTGTCTCATCC |
| hIL27Ra_<br>VH<br>H6-<br>DR592 | 1305 | CAAGTGCAGCTCCAGGAGTCAGGCGGGGGCCTTGTGCAGCCTGGTGGCTCTCTG<br>AGGCTGTCTTGTGCGGCTTCAGGCTTCTCCTTCTCCTCATACGCAATGAGTGG<br>GTACGTCAGGCCCCCGGCAAAGGCCTTGAGTGGGTCTCCACTATCTCTTCCGGT<br>GGCTCTTCCACCAACTACGCTGATTCAGTCAAAGGCCGGTTCACGATCTCTCGC<br>GATAACGCCAAGAACACGCTGTACCTCCAGCTGAACTCCCTGAAGATCGAAGAC<br>ACTGCCATGTACTATTGCGCCAAGGCCATTGTTCCCACCGGAGCCACTATGGAA<br>CGCGGCCAGGGCACCCAGGTCACCGTGTCCTCTGGAGGCGGTTCACAGGTCCAA<br>CTTCAGGAGAGCGGAGGCGGGTCCGTGCAGGCGGGAGGCTCCCTGCGTCTGTCC<br>TGTACCGCTCCCGGTTTCACCAGTAACTCCTGCGGCATGGATTGGTACAGACAG<br>GCCCCTGGTAAGGAAAGGGAATTTGTCAGCTCTATCAGCACCGACGGAACAACC<br>GGCTATGCCGATAGCGTGAAGGGACGCTTTACTATCTCAAAGGACAAGGCTAAG<br>GACACAGTGTACCTCCAGATGAACTCCCTCAAGCCCGAGGACACCGGCATGTAT<br>TCCTGCAAGACAAAAGACGGCACCATTGCAACTATGGAGCTGTGTGATTTTGGT<br>TATTGGGGCCAGGGAACACAGGTCACCGTCTCCAGC |
| hIL27Ra_<br>VH<br>H6-<br>DR592 | 1306 | CAGGTTCAGCTTCAGGAGTCTGGCGGAGGCCTGGTTCAGCCCGGAGGCAGTCTG<br>CGCCTTTCTTGCGCCGCGAGCGGCTTCTCATTCTCCAGCTACGCCATGAAGTGG<br>GTGCGCCAGGCTCCCGGAAAGGGACTGGAGTGGGTGTCCACAATCTCTTCAGGA<br>GGCTCCAGCACAAATTACGCCGACAGCGTGAAGGGCCGCTTCACGATCTCACGG<br>GATAACGCGAAGAACACTCTGTATCTTCAGCTCAACTCCCTGAAGATCGAGGAC<br>ACAGCTATGTATTACTGTGCTAAGGCTATCGTTCCTACCGGCGCTACTATGGAA<br>AGAGGGCAGGGCACCCAAGTGACTGTGTCTAGCGGAGGTAGCGGAGGGTCCGGT<br>GGAAGTGGTCAGGTACAGCTCCAGGAATCTGGTGGAGGCAGTGTTCAGGCTGGA<br>GGTTCTTTGAGACTGTCCTGCACAGCTCCTGGATTTACCAGCAACAGCTGTGGG<br>ATGGACTGGTATCGCCAGGCACCGGGCAAGGAAAGAGAGTTTGTCTCTAGCATC<br>TCTACCGACGGTACAACCGGCTATGCCGACTCTGTGAAGGGTAGGTTCACTATC<br>TCCAAGGACAAAGCAAAGGATACTGTGTACCTCCAGATGAACTCCTTGAAGCCC<br>GAGGACACCGGCATGTACTCATGTAAGACCAAGGATGGGACCATCGCTACTATG<br>GAGCTGTGTGACTTCGGATACTGGGGCCAGGGTACTCAGGTCACCGTGTCTTCT |
| hIL27Ra_<br>VH<br>H6-<br>DR593 | 1307 | CAAGTCCAGTTGCAGGAGTCCGGCGGGGGCCTGGTCCAGCCAGGAGGCAGCTTG<br>CGTCTGTCATGTGCTGCCTCTGGTTTCTCATTTTCCAGCTACGCCATGAAGTGG<br>GTGAGACAGGCTCCAGGAAAGGGCCTGGAGTGGGTGTCTACAATCTCCTCTGGA<br>GGGTCTTCCACTAACTATGCCGACTCCGTCAAAGGACGCTTCACAATTCACGC<br>GACAACGCGAAAAATACCTTGTACCTCCAGTTGAACTCACTCAAGATCGAAGAC<br>ACGGCCATGTATTACTGCGCCAAAGCCATCGTGCCCACAGGTGCTACTATGGAG<br>CGCGGCCAGGGCACCCAGGTTACCGTCAGCTCTGGCGGAGGCTCCCAAGTGCAG<br>CTGCAAGAGAGCGGCGGGGGCAGCGTCCAGGCCGGTGGCTCCCTGAGGCTCTCC<br>TGTGCTGCCTCCGGTTACCCATACTCCAATGGGTATATGGGCTGGTTCCGCCAA<br>GCCCCAGGCAAGGAGAGGGAAGGAGTGGCAACCATCTACACCGGCGATGGCCGC<br>ACATATTACGCAGACAGCGTCAAGGGCAGGTTTACCATTAGTCGCGACAACGCC<br>AAGAACACTGTGGACCTCCAGATGTCTTCCCTGAAGCCCGAGGACACAGCTATG<br>TATTACTGTGCGGCCAGGGCTGCACCGCTGTACTCCAGCGGTTCACCGCTGACA<br>CGCGCCCGGTACAACGTCTGGGGCCAGGGCACACAGGTTACGGTCTCTTCT |
| hIL27Ra_<br>VH<br>H6-<br>DR593 | 1308 | CAGGTCCAGCTCCAGGAATCCGGTGGGGGCCTGGTGCAGCCCGGTGGCTCCCTG<br>CGCCTGTCCTGCGCTGCATCCGGCTTCAGCTTCAGCTCTATGCTATGAAGTGG<br>GTCCGGCAAGCGCCTGGCAAGGGACTGGAGTGGGTGAGTACAATCAGCTCCGGG<br>GGCTCCTCTACCAACTATGCCGATAGCGTGAAGGGTAGGTTCACCATTAGCCGC<br>GACAACGCCAAGAACACTCTGTACCTTCAGCTGAACTCCCTGAAAATCGAAGAC<br>ACAGCGATGTATTACTGCGCGAAGGCCATCGTGCCTACTGGTACTATGGAA<br>AGAGGGCAAGGCACACAGGTGACCGTTAGCTCCGGTGGCTCCGGCGGAAGCGGT<br>GGGTCAGGTCAGGTTCAGCTCCAAGAAAGCGGCGGTGGCAGCGTGCAGGCTGGA<br>GGCTCCCTTAGACTCTCCTGCGCCGCATCTGGATACCCTTATAGCAACGGCTAC<br>ATGGGATGGTTTCGCCAAGCCCCTGGTAAGGAGCGCGAGGGCGTCGCTACTATT<br>TATACTGGGGATGGCCGCACTTACTATGCCGATTCTGTGAAGGGGCGCTTTACT |

TABLE 1B-continued

| Name | SEQ ID NO: | Sequence |
|---|---|---|
| | | ATCTCACGCGACAACGCAAAGAACACCGTGGACCTCCAGATGTCATCTCTCAAG<br>CCGGAAGATACCGCTATGTATTACTGTGCTGCCCGCGCAGCTCCCCTGTACTCT<br>TCCGGCTCCCCACTCACCCGTGCCCGCTATAACGTGTGGGGACAGGGCACTCAG<br>GTGACCGTCTCATCT |
| hIL27Ra_<br>VH<br>H6-<br>DR594 | 1309 | CAGGTGCAGTTGCAGGAGAGCGGGGGTGGGCTGGTCCAGCCCGGCGGATCTCTG<br>CGCCTCAGCTGCGCCGCAAGCGGCTTCTCCTTCTCCAGCTACGCTATGAAATGG<br>GTCCGCCAGGCCCCCGGTAAGGGGTTGGAGTGGGTGTCTACCATTTCCAGTGGC<br>GGTTCCAGCACCAACTACGCTGACAGCGTGAAGGGCAGATTCACGATCTCTCGC<br>GACAATGCTAAAAATACCCTGTACCTGCAACTCAACAGCCTGAAGATCGAGGAT<br>ACCGCCATGTATTACTGTGCCAAGGCCATCGTTCCTACTGGGGCCACTATGGAG<br>AGGGGACAAGGAACTCAGGTCACCGTCTCTTCCGGTGGGGGCAGCCAAGTCCAG<br>CTCCAAGAATCTGGCGGAGGCTCTGTGCAGGCTGGCGGATCACTCAGACTGTCC<br>TGTGTGGCCGTCCGCTTCCACCTATTGCACCTACGACATGCACTGGTATCGCCAG<br>GCCCCTGGCAAAGGCAGGGAATTTGTGTCTGCTATCGACAGCGACGGTACAACC<br>CGCTATGCCGATTCAGTGAAGGGTCGGTTCACCATCTCACAAGGCACCGCCAAG<br>AACACCGTGTACTTGCAGATGAACTCTCTGCAACCCGAGGACACTGCAATGTAT<br>TACTGCAAGACTGTGTGCGTGGTCGGAAGCAGATGGTCTGATTATTGGGGCCAA<br>GGCACACAGGTTACTGTGAGCAGT |
| hIL27Ra_<br>VH<br>H6-<br>DR594 | 1310 | CAGGTGCAGCTCCAGGAGTCCGGGGGAGGCCTGGTGCAGCCTGGTGGGTCTCTG<br>CGGCTGTCCTGTGCCGCTTCAGGATTTAGCTTCTCTTCCTATGCTATGAAGTGG<br>GTGCGCCAGGCTCCTGGTAAGGGACTGGAATGGGTGTCTACAATTAGTTCCGGC<br>GGGTCCTCTACCAACTATGCCGACTCCGTGAAGGGTAGATTCACGATCAGCAGA<br>GACAACGCCAAGAATACCCTCTACTTGCAGCTCAACTCCCTGAAAATTGAAGAC<br>ACCGCGATGTATTACTGTGCCAAGGCCATCGTGCCCACGGGCGCTACAATGGAA<br>CGCGGCCAGGGCACACAGGTGACCGTTTCTTCCGGTGGCAGCGGAGGCTCCGGG<br>GGCTCCGGCCAGGTGCAGCTCCAGGAGTCAGGAGGCGGGTCCGTGCAGGCCGGT<br>GGCAGTCTGCGTTTGTCCTGTGTGGCCAGCGCATCCACCTATTGTACCTACGAT<br>ATGCACTGGTATCGTCAGGCCCCAGGCAAGGGCAGGGAGTTCGTTAGCGCTATT<br>GACTCCGACGGCACCACTCGCTACGCTGACAGTGTCAAAGGCCGCTTCACTATC<br>TCTCAGGGGACTGCCAAGAACACCGTGTATCTCCAGATGAACTCCCTGCAACCA<br>GAGGACACAGCCATGTACTATTGCAAGACAGTGTGCGTTGTGGGCTCTCGCTGG<br>TCCGACTATTGGGGCCAGGGCACCCAGGTGACAGTGTCTTCC |
| hIL27Ra_<br>VH<br>H6-<br>DR595 | 1311 | CAAGTGCAGCTCCAGGAGTCTGGTGGAGGCCTGGTCCAGCCCGGTGGGAGCTTG<br>AGATTGTCTTGCGCAGCCTCTGGATTCTCTTTCTCCAGCTACGCCATGAAATGG<br>GTGCGGCAGGCACCAGGGAAGGGCCTGGAATGGGTGTCTACCATTTCTTCCGGC<br>GGTTCTTCCACTAATTACGCAGATCCGTGAAGGGCCGGTTCACCATTTCCCGT<br>GACAACGCTAAGAATACCCTGTACTTGCAGCTGAACTCCCTGAAGATCGAGGAC<br>ACGGCTATGTATTACTGTGCTAAAGCCATTGTCCCTACAGGGGCCACAATGGAA<br>CGCGGCCAGGGTACTCAAGTGACGGTCAGCTCTGGCGGGGGCAGCCAAGTGCAG<br>CTCCAGGAGAGCGGAGGTGGGTCCGTGCAGGCTGGTGGCTCCCTGACCCTGAGC<br>TGTGCCGCATCTGAATATGCGTATAGCACTTGTAATATGGGATGGTATCGCCAG<br>GCTCCTGGTAAGGAGCGCGAGCTGGTGAGCGCTTTCATTTCCGACGGTAGCACA<br>TATTACGCGGACTCCGTCAAAGGTCGCTTCACCATTACACGCGATAACGCCAAG<br>AATACCGTGTATTTGCAGATGAACTCACTCAAGCCAGAAGACACTGCCATCTAC<br>TATTGTTCAGCCAACTGTTATCGCAGACTCCGCAACTATTGGGGCCAGGGGACG<br>CAGGTAACCGTGTCCTCC |
| hIL27Ra_<br>VH<br>H6-<br>DR595 | 1312 | CAGGTGCAGCTCCAGGAATCTGGCGGTGGCCTGGTGCAGCCGGGCGGGTCCCTG<br>AGACTGAGTTGCGCTGCCAGCGGGTTTTCCTTCAGTTCCTATGCCATGAAGTGG<br>GTCCGCCAAGCTCCGGGGAAGGGCCTGGAATGGGTCTCCACTATTAGTTCCGGT<br>GGCTCTAGCACAAACTATGCGGATTCCGTGAAGGGACGCTTCACCATCTCTCGG<br>GACAACGCCAAGAATACCCTGTACCTCCAGCTGAATAGTCTCAAGATCGAAGAC<br>ACCGCGATGTACTATTGCGCCAAAGCCATCGTTCCTACTGGTGCTACAATGGAG<br>CGTGGCCAGGGCACCCAGGTGACCGTCTCCTCGGCGGATCTGGGGGTTCCGGG<br>GGCTCCGGCCAGGTCCAGTTGCAGGAAAGCGGCGGGGGCTCCGTTCAGGCCGGG<br>GGCAGTCTGACCCTGTCCTGTGCAGCCTCTGAGTACGCCTATTCCACCTGTAAC<br>ATGGGCTGGTACAGACAAGCGCCCGGAAAAGAGCGCGAATTGTCTCCGCCTTC<br>ATCTCCGATGGTAGCACTTATTACGCGGACTCTGTAAAAGGCCGTTTCACTATT<br>ACCCGCGACAACGCCAAGAACACCGTCTATCTCCAGATGAACAGCCTGAAGCCA<br>GAAGATACGGCCATTTACTATTGCTCCGCTAACTGCTACAGACGCTTGAGGAAT<br>TATTGGGGCCAGGGCACACAAGTGACTGTTTCCTCC |
| hIL27Ra_<br>VH<br>H6-<br>DR596 | 1313 | CAGGTGCAGCTGCAAGAGAGCGGTGGCGGTCTGGTACAGCCAGGTGGCAGCCTG<br>CGCCTGTCCTGCGCTGCATCAGGCTTCTCCTTCAGTTCCTATGCCATGAAGTGG<br>GTGCGCCAGGCTCCAGGCAAAGGATTGGAGTGGGTGTCTACCATTTCTTCCGGG<br>GGCTCATCCACAAACTACGCCGACAGCGTGAAGGGCCGCTTCACCATCTCCCGC<br>GACAACGCCAAGAACACTCTGTATCTTCAGCTGAACTCCCTGAAGATTGAGGAT<br>ACCGCTATGTATTACTGCGCTAAGGCCATCGTTCCCACAGGCGCTACGATGGAA<br>CGCGGTCAGGGGACACAAGTAACCGTAAGCAGTGGCGGTGGCAGCCAAGGTGCAG<br>CTCCAGGAGTCCGGCGGTGGCCTGGTGCAGCCGGGTGGGTCCCTGAGGCTGAGT<br>TGCACAGCCAGCCGGTCTGACCTTCGATGACTCCGTGATGGGGTGGTTCCGCCAG<br>GCACCTGGCAAGGGCCGCGAGGCTGTGTCCTGCATTAGCTCTAGCGGTGCCAAT<br>GCCTTCTACGCTGACTCAGTCAAGGGCCGCTTCACCATCTCCCGCGATAACGCC<br>AAGAACACCCTGTACTTGCAGATGAACTCCCTGAAACCCGAGGATACAGCAACA |

TABLE 1B-continued

| Name | SEQ ID NO: | Sequence |
|---|---|---|
| | | TACTATTGCAAGCGGGGCACGCCTGTGCAGGATACTATCCTATCCCCTATGAC<br>GATTATTGGGGTCAGGGCACCCAGGTCACCGTCAGCAGC |
| hIL27Ra_<br>VH<br>H6-<br>DR596 | 1314 | CAGGTGCAGCTCCAGGAGTCCGGCGGAGGTCTGGTTCAGCCCGGAGGCTCCCTT<br>CGCCTCTCCTGTGCTGCGTCAGGATTCCTCTTTAGCTCCTACGCTATGAAGTGG<br>GTGCGCCAAGCCCCCGGCAAGGGCCTGGAGTGGGTATCCACCATTTCCAGTGGC<br>GGTTCTTCAACCAACTATGCTGATTCCGTGAAAGGCCGCTTCACCATCTCCCGT<br>GACAACGCAAAAAATACCTTGTATTTGCAGCTGAACAGCCTGAAGATCGAGGAC<br>ACCGCGATGTACTATTGCGCCAAGGCCATCGTGCCTACTGGCGCAACAATGGAG<br>CGTGGACAGGGCACTCAGGTCACTGTGAGTAGCGGAGGGAGTGGCGGTTCCGGC<br>GGTTCAGGACAGGTGCAGCTCCAGGAGAGCGGGGGTGGGCTGGTACAGCCAGGT<br>GGCTCTCTCAGGCTGAGTTGCACGGCCTCAGGCCTGACCTTCGATGACAGCGTC<br>ATGGGCTGGTTCCGCCAGGCCCCAGGTAAAGGCCGTGAGGCTGTGTCCTGTATT<br>AGCTCATCTGGGGCCAATGCGTTCTATGCTGACAGTGTCAAAGGCCGCTTCACA<br>ATTTCCCGTGACAACGCCAAGAACACCCTGTATTTGCAGATGAACAGTCTGAAG<br>CCGGAAGACACCGCCACCTACTATTGTAAGCGCGGTCACGCTTGTGCAGGTTAT<br>TACCCTATTCCTTATGATGACTACTGGGGCCAGGGAACGCAGGTGACAGTGTCC<br>TCT |
| hIL27Ra_<br>VH<br>H7-<br>DR591 | 1315 | CAGGTCCAGTTGCAGGAGTCTGGAGGTGGCCTGGTGCAGCCGGGAGGTTCTCTG<br>CGGCTGTCCTGCGCCGCATCTGGATTCACCTTCAGTTCTTATCCAATGTCTTGG<br>GTCAGGCAAGCGCCGGGCAAGGGCCTGGAATGGATTAGCACTATTTCGCAGGT<br>GGCGATACCACTCTGTATGCCGATTCAGTGAAAGGCCGCTTCACCAGCTCTCGG<br>GATAACGCTAAGAACACCCTGTATCTCCAGCTGAATAGCCTTAAAACCGAAGAC<br>ACCGCAATCTATTACTGTGCTAAAAGGATTGATTGTAATTCTGGCTATTGTTAC<br>AGACGCAACTACTGGGGACAGGGCACCCAAGTGACCGTTTCCAGTGGGGGCGGG<br>AGCCAGGTACAACTCCAGGAGTCCGGTGGAGGTAGCGTGCAGGCCGGGGGCTCT<br>CTCCGTCTGTCCTGCACCGCATCCGGGGCTATCGCCTCTGGGTACATTGACAGC<br>CGCTGGTGCATGGCCTGGTTCCGTCAGGCCCCCGGCAAGGAACGCGAGGGCGTG<br>GCTGCCATCTGGCGGGCGGAGGGCTGACTGTGTATGCGGACTCCGTCAAGGGC<br>AGGTTTACCATCAGCCGCGACCATGCTAAGAACACCCTGTACCTCCAGATGAAT<br>AACTTGAAACCTGAAGCACCGCCATGTACTATTGCGCGGCTGGTTCCCCACGC<br>ATGTGCCCCTCACTTGAGTTTGGGTTCGATTACTGGGGCCAGGGCACCCAGGTG<br>ACTGTGTCCAGC |
| hIL27Ra_<br>VH<br>H7-<br>DR591 | 1316 | CAGGTCCAGCTTCAGGAGTCCGGCGGTGGCCTTGTCCAGCCAGGAGGCAGCCTG<br>CGGCTGTCCTGCGCCGCGAGCGGCTTCACGTTCTCATCCTACCCAATGTCCTGG<br>GTCCGTCAGGCCCCAGGGAAGGGCTGGAGTGGATCAGTACCATCTCCGCCGGT<br>GGCGATACCACTTTGTACGCCGACTCTGTGAAAGGGCGCTTTACCTCTTCCCGC<br>GATAACGCGAAAAACACATTGTACCTCCAGCTCAACTCCCTGAAGACTGAGGAC<br>ACTGCCATCTACTATTGCGCCAAGAGAATTGATTGCAACAGCGGGTATTGCTAC<br>CGGCGCAACTACTGGGGCAGGGAACCCAGGTGACGGTATCCTCTGGGGGCTCT<br>GGAGGTTCAGGAGGCAGCGGACAAGTGCAGCTCCAGGAATCAGGAGGCGGTTCT<br>GTGCAGGCGGGTGGCTCTCTGCGTCTGAGCTGCACTGCGTCTGGAGCCATCGCT<br>TCTGGTTACATCGACAGCAGATGGTGCATGGCATGGTTCCGTCAGGCTCCGGGA<br>AAGGAGAGGGAGGGAGTGGCCGCTATCTGGCCCGGAGGGGCTTGACAGTCTAC<br>GCTGATTCCGTGAAGGGAAGGTTCACGATCTCACGTGACCACGCTAAGAATACC<br>CTGTACCTTCAGATGAATAACCTGAAGCCCGAGGACACCGCAATGTACTATTGT<br>GCTGCCGGAAGCCCCAGGATGTGTCCCAGCCTGGAATTTGGCTTTGACTACTGG<br>GGTCAGGGCACTCAGGTCACAGTCTCCTCT |
| hIL27Ra_<br>VH<br>H7-<br>DR592 | 1317 | CAGGTGCAGTTGCAGGAGTCCGGCGGGGGCCTGGTGCAGCCAGGAGGGTCTCTG<br>AGGCTGAGTTGCGCCGCTAGTGGCTTCACCTTCTCCAGCTATCCCATGTCTTGG<br>GTGCGCCAGGCTCCCGGTAAAGGACTTGAGTGGATTAGCACGATCTCCGCTGGA<br>GGTGACACGACTCTCTACGCCGATAGCGTGAAGGGACGCTTCACCAGTTCTCGT<br>GACAACGCCAAGAATACCCTGTACCTCCAACTGAACAGCCTGAAGACGGAGGAC<br>ACCGCCATCTATTACTGTGCAAAGCGTATTGATTGTAACTCAGGATACTGCTAT<br>CGGCGCAACTATTGGGGACAGGGCACGCAGGTGACAGTTAGCTCCGGTGGCGGA<br>AGTCAGGTCCAACTTCAGGAAAGCGGAGGTGGCAGCGTTCAGGCTGGCGGTTCC<br>TTGCGCCTGTCTTTGTACCGCACCGGGCTTTACAAGCAACAGCTGCGGTATGGAC<br>TGGTATAGACAAGCTCCAGGCAAAGAAAGGGAGTTCGTGTCCAGCATTAGCACT<br>GACGGCACCACAGGCTATGCTGATTCCGTGAAGGGACGCTTCACTATCTCCAAA<br>GATAAGGCGAAGGACACTGTATACCTCCAGATGAACTCCCTGAAGCCTGAGGAT<br>ACCGGCATGTATAGTTGCAAGACCAAGGATGGCACCATCGCAACGATGGAACTC<br>TGTGACTTCGGCTATTGGGGCAGGGCACCCAGGTGACCGTGTCCTCT |
| hIL27Ra_<br>VH<br>H7-<br>DR592 | 1318 | CAGGTGCAGCTGCAAGAATCCGGGGCGGGCTCGTGCAGCCTGGGGGTTCCCTC<br>CGTCTGAGCTGCGCGGCTTCCGGCTTCACTTTCTCTTCCTATCCCATGTCCTGG<br>GTGAGGCAGGCCCCTGGCAAGGGCTTGGAATGGATTAGCACCATCAGCGCCGGG<br>GGCACACAACCCTGTACGCTGACAGCGTGAAGGGAAGATTCACGTCCAGCCGG<br>GATAACGCCAAGAACACCCTGTACCTCCAGTTGAACTCCCTGAAGACTGAAGAT<br>ACCGCCATCTATTACTGTGCCAAGCGCATTGATTGCAACAGCGGCTACTGCTAT<br>CGCCGGAACTACTGGGGCAGGGTACACAGGTAACGGTGTCCTCAGGGGGCTCC<br>GGCGGGAGTGGGGCAGCGGGCAAGTTCAGTTGCAGGAGAGCGGCGGGGGCTCC<br>GTCCAAGCAGGCGGAAGCCTTCGCCTCAGCTGCACCGCACCGGGTTTCACATCT<br>AATAGCTGCGGAATGGATTGGTATCGGCAGGCCCCCGGTAAGGAGCGCGAGTTC<br>GTGAGTTCCATCAGTACCGACGGCACAACCGGCTATGCTGACTCCGTGAAGGGT |

TABLE 1B-continued

| Name | SEQ ID NO: | Sequence |
| --- | --- | --- |
|  |  | CGCTTCACCATTTCTAAGGATAAGGCCAAAGACACCGTGTACCTTCAGATGAAC<br>TCACTGAAGCCAGAAGACACAGGAATGTACTCTTGTAAAACGAAGGATGGAACC<br>ATCGCTACGATGGAGCTGTGCGACTTTGGCTACTGGGGCCAGGGCACCCAGGTG<br>ACAGTAAGCTCT |
| hIL27Ra_VH H7-DR593 | 1319 | CAGGTCCAACTCCAGGAAAGCGGCGGTGGCCTGGTGCAGCCAGGTGGGTCTCTC<br>CGTCTGAGCTGTGCTGCATCCGGCTTCACTTTTAGCTCTTACCCGATGAGCTGG<br>GTGCGCCAGGCTCCGGGAAAGGGCCTTGAGTGGATCAGCACCATCTCAGCCGGG<br>GGCGATACAACCCTGTATGCAGACAGTGTTAAAGGCCGTTTTACCTCCTCTCGC<br>GACAATGCTAAAAACACCCTTTATCTTCAGCTCAATAGTCTGAAGACTGAGGAC<br>ACCGCCATTTATTACTGCGCTAAACGCATTGATTGCAACTCCGGGTACTGCTAC<br>AGACGTAACTATTGGGGCCAGGGAACACAGGTGACCGTGTCCAGTGGCGGAGGT<br>AGTCAGGTCCAGTTGCAAGAGAGCGGGGGAGGCAGCGTCCAGGCGGGTGGCTCC<br>CTGCGCCTGAGCTGCGCAGCCTCTGGTTACCCATACAGCAACGGCTACATGGGC<br>TGGTTCAGGCAAGCACCGGGTAAGGAGCGGGAAGGCGTGGCAACCATCTATACA<br>GGTGATGGTCGCACCTATTACGCAGATTCCGTCAAGGGCCGGTTCACTATCAGC<br>CGCGACAACGCAAAGAATACAGTCGATCTCCAGATGAGCAGTTTGAAACCTGAA<br>GACACGGCGATGTATTACTGCGCCGCTCGTGCTGCGCCACTCTACTCCTCTGGC<br>TCCCCTCTCACACGTGCTCGTTATAATGTATGGGGCCAGGGCACTCAAGTGACA<br>GTCTCCAGT |
| hIL27Ra_VH H7-DR593 | 1320 | CAGGTGCAGTTGCAGGAGTCCGGCGGTGGACTGGTCCAACCAGGCGGTAGTCTC<br>AGGCTGTCCTGTGCCGCTTCTGGTTTCACTTTCAGCTCCTACCCAATGTCCTGG<br>GTACGGCAAGCTCCTGGGAAGGGTCTGGAGTGGATCTCCACGATCTCCGCAGGC<br>GGGGACACTACCCTCTACGCCGACTCTGTGAAGGGCCGTTTCACTTCTAGCAGA<br>GATAATGCAAAAAACACTCTCTATCTTCAGCTGAACAGTCTGAAAACCGAAGAT<br>ACTGCGATCTATTACTGCGCCAAGCGCATCGACTGCAATTCTGGTTACTGTTAC<br>CGTCGCAATTACTGGGGCCAAGGAACCCAGGTCACGGTGTCCTCAGGTGGCAGC<br>GGAGGTTCCGGCGGGTCCGGTCAGGTCCAGTTGCAGGAAAGCGGCGGAGGTTCT<br>GTCCAAGCCGGAGGCAGCCTGAGGCTGTCTTGCGCTGCCAGTGGATACCCCTAT<br>AGCAACGGCTACATGGGCTGGTTCCGCCAAGCGCCAGGGAAGGAACGTGAAGGT<br>GTGGCCACCATCTACACCGGCGATGGCAGGACCTACTATGCTGACTCCGTGAAG<br>GGTAGGTTCACCATCTCTCGCGATAACGCCAAGAACACTGTGGACCTCCAGATG<br>TCTTCCTTGAAACCTGAGGACACCGCGATGTATTACTGCGCGGCCCGCGCCGCG<br>CCCCTCTACAGTTCAGGCAGCCCCCTGACCAGAGCAAGGTATAACGTGTGGGGT<br>CAGGGCACTCAGGTGACCGTTAGCAGT |
| hIL27Ra_VH H7-DR594 | 1321 | CAAGTTCAGCTCCAGGAATCGGCGGTGGCCTGGTCCAGCCAGGTGGCTCCCTG<br>CGCCTGAGTGTGCGGCTAGTGGCTTCACCTTCAGCTCCTACCCGATGAGTTGG<br>GTGCGTCAGGCTCCAGGGAAGGGTCTGGAGTGGATCTCTACCATCAGCGCCGGT<br>GGCGATACTACCCTGTATGCGGATTCCGTGAAGGGTCGCTTTACCAGCTCTCGG<br>GACAACGCCAAGAACACGCTCTACTTGCAGCTGAACAGTCTGAAGACCGAGGAT<br>ACCGCTATCTACTATTGTGCCAAGCGCATCGACTGTAACGGGTACTGCTAC<br>CGCCGTAACTATTGGGGCCAGGGAACACAAGTTACCGTGTCAAGCGGAGGCGGT<br>TCCCAGGTGCAGCTCCAGGAATCTGGCGGAGGCAGCGTACAGGCGGGAGGCTCA<br>CTGCGCCTGTCTTGTGTCGCATCAGCCAGCACCTACTGCACCTATGACATGCAC<br>TGGATCCGGCAGGCTCCCGGCAAAGGCCGCGAGTTCGTCAGCGCCATTGATTCC<br>GATGGCACCACGAGGTACGCCGATTCTGTAAAGGGCCGCTTTACTATCTCCCAG<br>GGTACTGCCAAGAACACCGTGTACCTCCAGATGAACAGTCTTCAGCCAGAGGAT<br>ACGGCTATGTATTACTGCAAGACTGTTTGTGTCGTTGGCTCCAGGTGGAGCGAC<br>TACTGGGGTCAGGGAACCCAGGTCACTGTGAGTAGC |
| hIL27Ra_VH H7-DR594 | 1322 | CAGGTCCAACTTCAGGAATCCGGCGGGGGTCTGGTGCAACCTGGCGGTAGCCTC<br>CGGCTTAGTTGCGCCGCAAGTGGATTCACCTTTTCCAGCTATCCCATGTCCTGG<br>GTGCGTCAAGCGCCGGGTAAGGGTCTCGAATGGATTTCAACAATCTCTGCCGGT<br>GGCGACACCACTCTCTACGCGGATTCCGTGAAAGGGCGCTTCACCTCCTCTCGT<br>GACAATGCCAAGAACACTCTGTATCTCCAGCTTAACTCCTTGAAGACAGAGGAT<br>ACTGCCATCTATTACTGCGCCAAGCGCATCGACTGTAACTCTGGCTATTGTTAC<br>CGCCGTAACTACTGGGGACAGGGCACTCAAGTCACCGTCTCCTCTGGAGGCAGC<br>GGAGGTTCCGGGGGCTCTGGCCAGGTTCAGCTCCAGGAGAGCGGAGGAGGGGAGC<br>GTGCAGGCAGGTGGAAGCCTGCGTCTGTCCTGTGTGGCCTCCGCTTCAACCTAC<br>TGCACCTATGATATGCACTGGATCGTCAGGCCCCGGCAAAGGTAGAGAGTTC<br>GTGTCCGCCATTGATTCCGATGGTACTACCAGATATGCCGACAGCGTAAAGGGA<br>CGTTTCACGATCTCTCAAGGCACCGCCAAGAACACCGTTTACCTCCAGATGAAT<br>AGCCTCCAGCCGGAAGATACTGCAATGTATTACTGCAAGACTGTTTGCGTGGTT<br>GGCAGCCGCTGGAGCGACTACTGGGGCCAGGGGACCCAGGTGACCGTCTCCTCT |
| hIL27Ra_VH H7-DR595 | 1323 | CAGGTCCAGTTGCAGGAATCCGGCGGAGGCCTGGTGCAGCCAGGGGGCTCTCTG<br>AGGCTGAGCTGTGCCGCGAGCGGCTTCACATTCTCCAGCTACCCCATGTCTTGG<br>GTGCGTCAGGCCCCTGGCAAGGGTCTGGAGTGGATCTCCACCATCTCTGCTGGC<br>GGTGACACCACTCTGTATGCCGACAGTGTTAAAGGGCGTTTCACGTCTTCCCGT<br>GACAATGCCAAGAACACTCTCTACCTCCAGTTGAACTCACTGAAAACCGAGGAT<br>ACCGCCATTTATTACTGCGCCAAGCGTATCGACTGCAACTCTGGCTACTGTTAT<br>CGCCGGAACTACTGGGGCCAGGGGACCCAGGTGACTGTCAGTTCTGGCGGGGGC<br>TCTCAGGTTCAGCTCCAGGAGTCAGGAGGCGGTTCAGTGCAAGCTGGAGGCTCC<br>CTGACACTCAGCTGTGCCGCGAGTGAGTACGCATACTCCACCTGTAACATGGGT<br>TGGTATCGCCAGGCTCCAGGTAAAGAGCGCGAGCTGGTCTCCGCCTTCATCTCC</td> |

TABLE 1B-continued

| Name | SEQ ID NO: | Sequence |
|---|---|---|
| | | GACGGCTCCACGTATTACGCCGATTCTGTGAAAGGCCGTTTCACAATCACACGC<br>GACAATGCAAAGAACACAGTGTATCTTCAGATGAACTCACTCAAGCCTGAAGAC<br>ACCGCGATCTATTACTGCTCCGCAAACTGTTACAGACGCCTCCGCAACTACTGG<br>GGGCAAGGCACTCAAGTGACTGTTTCCAGT |
| hIL27Ra_<br>VH<br>H7-<br>DR595 | 1324 | CAGGTACAGTTGCAGGAGTCAGGAGGTGGCCTGGTGCAGCCTGGTGGCAGCTTG<br>CGCCTGTCTTGCGCAGCCTCTGGCTTCACATTCAGCTCATACCCTATGTCTTGG<br>GTCAGGCAGGCTCCAGGTAAGGGGCTGGAATGGATTTCTACCATTAGTGCAGGC<br>GGTGACACAACCCTGTACGCCGACTCAGTCAAGGGCCGGTTTACGTCCAGCCGC<br>GACAATGCAAAGAACACTCTCTACTTGCAGCTCAACAGTCTGAAGACCGAGGAT<br>ACTGCCATCTACTATTGTGCTAAGAGAATTGATTGCAACAGCGGCTATTGCTAC<br>CGCAGAAATTACTGGGGCAGGGCACCCAGGTGACTGTTTCTTCCGGGGGCAGC<br>GGGGGTAGCGGTGGGTCCGGTCAGGTCCAGCTTCAGGAGTCCGGCGGAGGCAGC<br>GTGCAGGCCGGAGGCAGCCTCACCCTGTCTTGTGCCGCTTCTGAATACGCTTAT<br>TCTACTTGTAACATGGGCTGGTATCGGCAGGCTCCCGGTAAGGAGCGCGAGCTG<br>GTCAGCGCCTTCATCTCTGACGGATCTACTTATTACGCCGATTCCGTCAAGGGT<br>CGCTTCACCATCACCAGAGACAATGCCAAAAACACCGTCTATCTCCAGATGAAC<br>TCTCTCAAGCCGGAGGACACCGCGATTTACTATTGCTGCGAACTGTTACCGT<br>CGCCTCCGTAACTATTGGGGTCAGGGCACCCAGGTCACGGTGTCCAGC |
| hIL27Ra_<br>VH<br>H7-<br>DR596 | 1325 | CAGGTACAACTCCAGGAGTCCGGCGGGGGACTGGTGCAGCCGGGTGGCTCCCTT<br>CGTCTGAGCTGTGCTGCCAGCGGTTTCACCTTCAGCTCCTACCCAATGTCTTGG<br>GTCCGTCAAGCGCCTGGTAAGGGTCTTGAGTGGATTAGTACTATCAGCGCTGGT<br>GGCGATACCACGCTCTACGCTGATTCCGTCAAAGGCCGCTTTACTCTTCCAGG<br>GATAACGCAAAAAACACTCTTTACCTCCAGCTGAACTCCCTGAAGACCGAAGAT<br>ACCGCAATCTATTACTGTGCTAAACGGATTGATTGCAACTCCGGCTACTGTTAT<br>CGCCGTAATTACTGGGGCCAGGGTACACAGGTGACCGTGTCCTCAGGCGGGGGC<br>TCCCAAGTTCAGCTTCAGGAGAGTGGCGGTGGCCTGGTCCAGCCGGGCGGTTCC<br>CTTCGCCTGTCCTGCACCGCGTCCGGCCTTACCTTCGACGATAGCGTGATGGGT<br>TGGTTCCGCCAGGCTCCCGGCAAGGGCAGGAAGCCGTGAGCTGCATTTCATCC<br>TCAGGAGCCAACGCTTTCTACGCTGATTCTGTGAAGGGACGTTTTACTATCAGC<br>CGCGATAACGCCAAGAACACTCTGTACCTCCAGATGAACTCCCTGAAGCCTGAG<br>GATACGGCTACATATTACTGCAAGCGCGGTCACGCCTGCGCTGGATATTACCCG<br>ATCCCATACGATGACTACTGGGGCCAGGGAACACAGGTAACAGTCTCCTCT |
| hIL27Ra_<br>VH<br>H7-<br>DR596 | 1326 | CAGGTTCAACTGCAAGAGTCCGGCGGGGGACTTGTCCAGCCGGGAGGCAGTCTG<br>AGATTGTCCTGCGCAGCGTCCGGGTTCACTTTCAGCTCTTATCCAATGTCATGG<br>GTCCGTCAGGCCCCTGGCAAAGGGCTGGAGTGGATCAGCACCATTTCTGCTGGA<br>GGTGACACTACCCTGTACGCCGACAGCGTTAAGGGCCGCTTCACATCATCCAGG<br>GACAACGCCAAGAACACACTGTACCTTCAGCTGAACTCCCTGAAAACAGAGGAC<br>ACCGCTATCTATTACTGTGCGAAGCGCATTGACTGTAACAGCGGCTATTGTTAT<br>CGCAGGAACTATTGGGGACAGGGAACCCAGGTGACTGTAAGCTCCGGTGGCTCT<br>GGGGGGCTCCGGCGGTTCTGGTCAGGTGCAACTCCAGGAGAGCGGGGGTGGCCTG<br>GTGCAGCCTGGCGGGAGTCTGAGGCTTTCCTGCACCGCCAGCGGCCTTACCTTC<br>GATGACTCCGTGATGGGTGGTTCCGCCAAGCGCCAGGAAAAGGCCGCGAAGCC<br>GTCTCCTGTATCTCCTCAAGCGGCGCGAACGCCTTCTATGCCGACTCAGTGAAG<br>GGCCGTTTCACAATCTCCCGCGATAACGCCAAGAACACCCTGTATCTCCAGATG<br>AACAGCCTGAAGCCGGAAGACACGGCAACCTACTATTGTAAGAGAGGCCACGCT<br>TGCGCTGGGTATTACCCTATCCCTTACGACGATTACTGGGGACAGGGTACTCAG<br>GTGACCGTTAGCTCT |
| hIL27Ra_<br>VH<br>H8-<br>DR591 | 1327 | CAAGTTCAGCTTCAGGAGTCAGGTGGCGGATCAGTGCAAGTCGGAGGCTCCCTG<br>CGCCTGTCTTGCGCTGCCTCCGGCTTTACATTCTCTTCCTACCCCATGTCCTGG<br>GTAAGGCAGGCTCCCGGCAAAGGCCTGGAGTGGATTAGCACAATCTCTGCCGGT<br>GGCGACACCACTCTGTACGCTGATTCCGTGAAAGGTCGTTTCACGTCTAGCAGA<br>GACAACGCTAAGAACACCCTCTACCTTCAGCTCAACAGCCTGAAGACGGAGGAC<br>ACCGCTATTTATTACTGTGCGAAGCGCATCGACTGTAACTCTGGATACTGCTAT<br>CGGCGCAACTATTGGGGTCAGGGTACTCAGGTTACAGTGTCATCCGGGGGCGGA<br>TCACAAGTGCAACTGCAAGAATCCGGCGGGGGTAGCGTGCAGCCCGGTGGCTCA<br>TTGCGTCTGTCCTGCACCGCCTCTGGCGCTATCGCTTCTGGCTATATCGACAGT<br>CGGTGGTGCATGGCCTGGTTCCGCCAGGCCCCTGGGAAGGAGCGCGAGGGTGTG<br>GCCGCGATCTGGCCCGGTGGGGGCCTCACAGTGTATGCAGACTCCGTAAAAGGC<br>CGCTTCACAATTAGCCGCGACCACGCTAAGAACACCCTTTACTTGCAGATGAAC<br>AATCTGAAGCCAGAAGACACTGCAATGTACTATTGCTGCGGGTTCCCCTCGT<br>ATGTGCCCAAGTCTTGAGTTCGGTTTTGATTACTGGGGCAGGGCACCCAGGTC<br>ACCGTGTCCAGT |
| hIL27Ra_<br>VH<br>H8-<br>DR591 | 1328 | CAGGTACAACTCCAGGAATCTGGCGGAGGCTCCGTTCAGGTGGGTGGGTCTCTG<br>AGACTGAGCTGCGCTGCCAGCGGATTTACTTTCAGCTCCTACCCCATGAGTTGG<br>GTGAGGCAGGCTCCCGGTAAGGGCCTGGAATGGATTAGCACTATTAGCGCTGGC<br>GGGGACACCACTCTGTACGCTGACAGTGTCAAGGGGCGCTTTACTAGCTCCCGC<br>GACAACGCCAAGAACACTCTGTATCTCCAGCTCAACAGCCTCAAAACTGAGGAC<br>ACAGCTATCTATTACTGTGCTAAGCGCATTGACTGTAACTCAGGCTATTGTTAC<br>CGCCGGAACTACTGGGGACAAGGGACCCAAGTGACAGTTTCCTCTGGCGGTAGC<br>GGCGGATCTGGGGGCTCTGGCCAGGTCCAGCTTCAGGAGTCCGGGGGAGGCTCC<br>GTCCAGGCCGGTGGCTCTTTGAGGCTGTCATGCACAGCTTCCGGTGCCATCGCA<br>AGTGGATATATTGACAGTCGCTGGTGCATGGCCTTGGTTCCGGCAAGCCCCCGGA |

TABLE 1B-continued

| Name | SEQ ID NO: | Sequence |
|---|---|---|
| | | AAGGAGAGAGAGGGCGTTGCTGCAATCTGGCCGGGTGGGGGCTTGACCGTCTAT<br>GCTGATTCTGTGAAGGGCCGTTTTACCATCAGTAGAGACCACGCTAAAAACACC<br>CTGTACTTGCAGATGAATAACTTGAAACCCGAAGACACCGCCATGTATTACTGC<br>GCCGCTGGCTCTCCCCGTATGTGCCCCAGCTTGGAGTTCGGCTTTGATTATTGG<br>GGTCAGGGAACTCAGGTCACTGTGTCCAGC |
| hIL27Ra_VH H8-DR592 | 1329 | CAGGTGCAGCTCCAGGAGTCTGGCGGTGGAAGCGTGCAAGTAGGAGGCTCTCTG<br>AGGCTGTCATGCGCAGCGAGCGGCTTCACCTTCAGCTCTTATCCAATGTCTTGG<br>GTTCGCCAGGCCCCCGGTAAGGGTCTGGAGTGGATCTCAACTATCAGCGCAGGC<br>GGGGATACAACCCTTTACGCCGATAGTGTGAAGGGACGCTTTACCTCTAGCAGA<br>GATAACGCTAAGAACACTCTGTACTTGCAGCTTAACTCCCTTAAAACCGAGGAC<br>ACCGCGATCTATTACTGTGCCAAGCGCATTGACTGCAACTCTGGTTACTGCTAT<br>AGAAGGAACTACTGGGGCCAGGGTACGCAGGTGACGGTTAGTTCCGGTGGAGGC<br>TCACAAGTGCAGCTTCAGGAGTCCGGGGGTGGCTCTGTGCAGGCTGGCGGGTCC<br>CTGCGGCTTTCCTGCACAGCCCCCGGCTTCACGTCTAACTCCTGTGGCATGGAC<br>TGGTATCGCCAGGCCCCTGGTAAAGAGCGTGAGTTCGTGAGCAGTATTTCTACC<br>GATGGAACGACCGGCTATGCTGACTCCGTGAAGGGTCGCTTCACCATCTCCAAG<br>GACAAAGCCAAAGACACCGTTTATTTGCAGATGAACTCCCTCAAGCCAGAGGAC<br>ACTGGCATGTATAGTTGCAAGACCAAGGACGGCACTATTGCGACGATGGAGCTG<br>TGTGACTTCGGCTACTGGGGCCAGGGAACCCAGGTGACGGTGTCTTCT |
| hIL27Ra_VH H8-DR592 | 1330 | CAGGTGCAGCTCCAAGAGTCTGGTGGGGGAAGCGTTCAAGTCGGGGGCAGCCTG<br>AGACTGTCCTGTGCAGCTTCTGGCTTCACCTTTTCTAGCTACCCTATGTCCTGG<br>GTGCGCCAGGCCCCCGGCAAAGCCTGGAATGGATCTCCACCATCAGTGCGGGA<br>GGTGACACAACTCTGTACGCGGATTCTGTGAAGGGCCGCTTCACATCTAGCCGT<br>GATAACGCCAAGAATACTTTGTATCTCCAGCTCAACTCTCTGAAGACTGAAGAT<br>ACAGCAATTTATTACTGCGCAAAACGGATTGATTGTAATAGCGGGTACTGTTAC<br>CGCAGGAACTACTGGGTCAAGGCACTCAGGTTACGGTGTCTTCCGGCGGATCT<br>GGAGGTAGCGGTGGCAGCGGTCAGGTGCAGCTCCAGGAGTCAGGGGGCGGTTCC<br>GTGCAGGCTGGCGGGTCCCTGCGCCTCTCTTGTACTGCCCCTGGGTTTACATCC<br>AACTCCTGTGGTATGGACTGGTATAGGCAAGCTCCGGGAAAGGAGCGCGAGTTC<br>GTGTCTTCCATCAGCACCGATGGCACCACTGGTTACGCCGATTCCGTGAAGGGA<br>CGCTTTACAATTAGCAAGGACAAGGCCAAGGATACTGTGTACTTGCAGATGAAC<br>AGCCTGAAGCCTGAGGACACTGGGATGTACTCTTGCAAGACCAAGGACGGGACC<br>ATCGCCACGATGGAACTCTGCGACTTCGGATACTGGGGCCAGGGCACGCAAGTG<br>ACCGTAAGCTCT |
| hIL27Ra_VH H8-DR593 | 1331 | CAGGTACAGCTCCAGGAGAGCGGCGGTGGCTCCGTCCAAGTAGGGGGCAGCCTC<br>CGCCTTTCTTGTGCAGCCTCTGGTTTTACATTTTCCAGCTACCCAATGACTGG<br>GTCCGGCAAGCGCCTGGGAAAGGTCTGGAGTGGATTTCCACCATCTCCGCCGGG<br>GGCGACACTACCCTGTACGCAGATAGCGTAAAGGGTCGCTTTACCAGTTCTCGT<br>GATAACGCCAAGAACACTCTGTACCTTCAGCTGAATAGCCTCAAGACCGAGGAT<br>ACCGCCATCTACTATTGCGCTAAGCGCATCGACTGCAACTCTGGCTATTGTTAC<br>AGACGTAACTACTGGGGTCAAGGTACGCAGGTAACTGTATCCTCTGGAGGCGGT<br>TCTCAGGTACAGCTTCAGGAGAGCGGCGGTGGCAGCGTGCAGGCCGGAGGGTCC<br>CTGCGTCTCTCCTGCGCTGCCTCCGGCTACCCCTACTCCAATGGCTATATGGGT<br>TGGTTCAGACAGGCTCCTGGCAAAGAACGGGAGGGGGTGGCCACAATTTACACT<br>GGTGATGGCCGCACGTACTATGCCGACTCCGTGAAGGGGCGCTTTACCATTTCT<br>CGCGATAACGCTAAAAACACCGTGGACCTCCAGATGTCCAGCCTGAAGCCTGAA<br>GATACTGCAATGTATTACTGTGCCGCACGTGCTGCCCCACTGTACTCAAGTGGG<br>AGCCCACTGACTCGCGCTAGATATAACGTGTGGGTCAGGGCACTCAGGTGACC<br>GTCTCCTCC |
| hIL27Ra_VH H8-DR593 | 1332 | CAAGTACAACTCCAGGAATCTGGGGGCGGGAGTGTTCAGGTCGGTGGCAGCCTG<br>CGTCTCAGTTGCGCCGCGTCTGGCTTCACATTTTCTTCCTATCCGATGTCTTGG<br>GTGAGGCAAGCCCCTGGGAAGGGTCTCGAATGGATCTCCACAATCTCTGCTGGC<br>GGTGATACCACGCTCTACGCCGACTCTGTCAAAGGCCGCTTCACTTCTTCACGT<br>GATAACGCCAAAAACACCCTGTACCTTCAGCTCAACTCCCTGAAGACCGAAGAC<br>ACAGCAATCTATTACTGCGAAGCGGATTGATTGCAACTCCGGCTATTGTTAT<br>CGGAGGAACTACTGGGGCCAGGGCACCCAAGTGACCGTCTCCTCTGGCGGTTCC<br>GGTGGCTCCGGCGGTTCTGGACAAGTCCAACTCCAGGAGAGCGGCGGAGGCTCC<br>GTTCAGGCAGGCGGGTCCTTGAGGCTGAGTTGTGCTGCATCAGGCTACCCCTAC<br>TCAAACGCTATATGGGCTGGTTCAGACAGGCTCCGGGCAAGGAGCGCGAGGGA<br>GTGGCCACTATCTATACCGGCGACGGTCGCACTTATTACGCAGATAGCGTAAAG<br>GGTCGCTTCACCATCAGCCGCGATAACGCCAAGAACACGGTTGACCTTCAAATG<br>TCTAGTCTCAAACCTGAAGACACTGCCATGTACTATTGCGCCGCAAGAGCTGCC<br>CCTCTGTATTCCAGCGGGAGCCCCCTGACCCGTGCCCGCTACAACGTGTGGGGT<br>CAGGGCACCCAGGTGACTGTCAGCTCT |
| hIL27Ra_VH H8-DR594 | 1333 | CAGGTGCAACTCCAGGAGAGTGGCGGGGGCTCCGTACAGGTCGGGGGCTCTCTG<br>AGACTCTCCTGTGCGGCCAGCGGATTTACCTTCAGCAGTTACCCGATGTCTTGG<br>GTGCGTCAGGCCCCCAGGCAAGGGTCTGGAGTGGATTTCCACAATCAGCGCTGGC<br>GGTGACACTACACTCTACGCAGATTCCGTGAAGGGCGTTTCACCTCTAGCCGC<br>GACAACGCTAAGAACACCCTGTACTTGCAGTTGAACTCCCTGAAGACCGAGGAC<br>ACGGCCATCTACTATTGCGCGAAGCGCATCGACTGTAACAGCGGATACTGTTAC<br>AGGCGCAACTATTGGGGACAGGGGACCCAAGTAACCGTGAGTTCAGGTGGGGC<br>TCCCAGGTGCAGTTGCAGGAGTCAGGTGGAGGCAGCGTCCAGGCCGGGGGCTCT |

TABLE 1B-continued

| Name | SEQ ID NO: | Sequence |
|---|---|---|
| | | CTTCGCCTGTCCTGTGTGGCCAGCGCCTCTACTTACTGTACGTATGATATGCAC<br>TGGTATAGACAGGCCCCCGGTAAGGGAAGAGAGTTCGTCAGCGCTATTGATAGC<br>GATGGCACCACACGCTATGCGGATTCCGTAAAGGGTAGGTTTACAATCAGCCAG<br>GGAACCGCAAAAAACACTGTTTACTTGCAGATGAACAGCCTCCAGCCAGAGGAT<br>ACCGCCATGTACTATTGTAAGACTGTGTGTCGTGGGTTCCCGTTGGTCCGAT<br>TACTGGGGCCAGGGCACTCAAGTAACAGTTAGTAGT |
| hIL27Ra_<br>VH<br>H8-<br>DR594 | 1334 | CAAGTTCAACTGCAAGAGTCCGGTGGCGGAAGCGTCCAGGTGGGAGGCTCCCTT<br>CGCCTGAGCTGTGCTGCCAGCGGTTTCACATTCAGTTCCTATCCGATGTCCTGG<br>GTGCGTCAGGCCCCAGGCAAGGGTCTGGAGTGGATCTCTACCATCTCCGCTGGC<br>GGTGACACGACTCTGTACGCTGATAGCGTTAAGGGGCGCTTTACCTCCTCTCGC<br>GATAACGCTAAGAACACTCTCTACCTCCAGTTGAATAGCCTCAAGACTGAAGAT<br>ACCGCTATCTACTATTGCGCTAAGCGGATTGATTGCAACTCTGGGTACTGCTAC<br>CGCCGGAACTACTGGGGACAGGGAACCCAGGTGACTGTGTCCTCTGGTGGCTCT<br>GGAGGCTCCGGCGGTTCCGGGCAGGTCCAACTCCAGGAATCCGGCGGTGGCAGC<br>GTGCAGGCCGGTGGCTCCTTGCGTCTGTCCTGCGTGGCGAGCGCTTCCACCTAC<br>TGCACCTACGACATGCACTGGTATCGCCAGGCTCCGGGTAAGGGCCGTGAATTT<br>GTGTCTGCCATTGATTCTGACGGCACCACGCGGTACGCAGACTCTGTTAAGGGG<br>CGCTTTACCATCAGTCAGGGCACGGCTAAGAACACCGTGTACCTGCAAATGAAC<br>TCTCTCCAACCGGAGGCACTGCCATGTATTACTGTAAAACGTTTGTGTTGTC<br>GGCTCCCGCTGGTCCGATTACTGGGGCCAGGGAACCCAGGTGACAGTCTCAAGC |
| hIL27Ra_<br>VH<br>H8-<br>DR595 | 1335 | CAGGTTCAACTCCAGGAGAGTGGCGGTGGCTCAGTGCAAGTAGGGGGCAGTCTG<br>CGCCTGAGCTGTGCTGCATCCGGCTTCACCTTCTCTAGTTATCCCATGAGCTGG<br>GTACGTCAGGCTCCAGGCAAAGGTCTGGAGTGGATCAGCACCATTAGCGCTGGC<br>GGAGAGACACGACTCTCTATGCCGACAGCGTGAAGGGCCGCTTCACCTCCAGTCG<br>GACAACGCCAAGAACACGCTGTACCTTCAGTTGAACTCACTCAAGACTGAGGAT<br>ACCGCAATCTATTACTGCGCTAAACGCATCGACTGTAACTCCGGGTACTGTTAC<br>CGTCGCAACTACTGGGGTCAGGGGACTCAGGTCACCGTGTCTTCCGGGGGTGGC<br>AGTCAGGTGCAGCTTCAGGAATCCGGCGGAGGCTCTGTCCAGGCTGGCGGTTCC<br>CTGACTCTGTCTTGCGCAGCCTCAGAGTATGCCTACAGCACTTGTAACATGGGT<br>TGGTATCGCCAGGCTCCCGGCAAAGAACGTGAGCTTGTTAGCGCGTTCATCAGC<br>GATGGCAGCACCTATTACGCTGACAGCGTGAAGGGTCGCTTTACAATCACCAGG<br>GACAACGCGAAGAACACCGTGTATCTCCAGATGAACTCCCCTCAAGCCCGAGGAC<br>ACCGCCATCTATTACTGCTCCGCTAATTGCTACCGTCGGCTGCGCAACTACTGG<br>GGCCAGGGGACCCAGGTAACAGTCTCCTCT |
| hIL27Ra_<br>VH<br>H8-<br>DR595 | 1336 | CAGGTCCAGCTCCAGGAGTCCGGTGGGGGAAGCGTCCAAGTAGGGGGGATCTCTG<br>AGGCTGTCCTGTGCGGCCTCCGGCTTCACCTTCTCCAGCTACCCCATGTCCTGG<br>GTGAGACAAGCCCCTGGGAAAGGACTGGAATGGATTAGTACCATTTCAGCCGGG<br>GGTGACACAACCCTGTACGCAGACTCCGTGAAAGGACGTTTTACCAGTTCCCGT<br>GATAACGCCAAGAACACCTTGTACCTCCAGTTGAACTCCCTGAAGACAGAAGAC<br>ACAGCCATCTATTACTGTGCCAAGCGCATTGATTGCAACAGCGGATACTGTTAC<br>CGCAGAAACTATTGGGGCCAGGGCACCCAGGTGACAGTATCAAGCGGCGGTTCC<br>GGCGGTAGCGGCGGTAGCGGGCAAGTGCAGTTGCAGGAGAGCGGCGGTGGCTCC<br>GTTCAGGCAGGAGGCTCCCTGACTCTCTCCTGTGCTGCCTCTGAGTATGCGTAC<br>TCCACTTGCAATATGGGCTGGTACAGGCAGGCTCCCGGCAAGGAACGCGAACTG<br>GTGAGTGCATTCATCTCTGATGGCTCCACATATTACGCCGACAGCGTCAAGGGC<br>CGGTTTACCATCACTCGGGATAATGCCAAGAACACCGTCTACTTGCAGATGAAC<br>AGCCTGAAGCCAGAGGACACAGCCATCTATTACTGCTCTGCTAACTGCTACCGC<br>AGACTGCGCAATTACTGGGGCCAGGGAACCCAGGTGACTGTGTCTAGC |
| hIL27Ra_<br>VH<br>H8-<br>DR596 | 1337 | CAGGTGCAACTCCAGGAATCCGGCGGAGGCAGCGTGCAAGTTGGGGGCAGTCTT<br>CGTCTGTCATGTGCAGCCAGCGGGTTCACCTTCTCAAGCTACCCGATGAGCTGG<br>GTGCGGCAGGCTCCCGGAAAGGGCCTGGAGTGGATTTCCACTATCTCCGCTGGC<br>GGTGACACCACACTGTACGCTGACTCCGTGAAGGGCCGGTTCACGTCATCCCGT<br>GATAACGCTAAGAACACACTGTATCTCCAGCTGAACAGCCTCAAGACCGAGGAC<br>ACTGCAATCTACTATTGCGCTAAGAGAATTGATTGCAACTCCGGGTACTGTTAC<br>AGGCGTAATTACTGGGGGCAGGGCACACAAGTGACCGTGTCCAGTGGCGGTGGC<br>AGCCAGGTGCAGTTGCAGGAGAGTGGGGGTGGCCTTGTGCAGCCCGGTGGGAGT<br>CTGCGCCCTGTCCTGCACAGCCTCCGGGCTGACCTTCGACGATTCTGTAATGGGC<br>TGGTTCCGCCAGGCTCCGGGAAGGGCCGCGAGGCCGTCAGCTGTATCTCCAGC<br>TCTGGAGCCAACGCATTTTACGCGGACAGCGTAAAGGGTAGATTCACAATTTCA<br>CGTGACAACGCCAAGAACACCCTGTACCTCCAGATGAACAGCCTGAAGCCCGAG<br>GATACCGCCACCTACTATTGTAAGCGCGGCCACGCTTGCGCGGGTTACTATCCG<br>ATCCCATACGATGACTATTGGGGCCAGGGCACGCAGGTTACGGTGTCTTCC |
| hIL27Ra_<br>VH<br>H8-<br>DR596 | 1338 | CAGGTCCAACTGCAAGAGTCTGGCGGGGGTTCCGTTCAGGTCGGTGGCTCCTTG<br>CGGCTGAGCTGTGCTGCCTCCGGCTTTACTTTTAGTTCTTATCCGATGAGCTGG<br>GTGAGGCAGGCTCCTGGCAAGGGCCTGGAGTGGATCTCCACAATCAGCGCTGGC<br>GGGGACACCACATTGTACGCCGACTCCGTCAAGGGCAGGTTCACCTCCTCACGC<br>GATAATGCTAAGAACACTCTGTATCTCCAGCTTAACTCTCTCAAGACCGAGGAC<br>ACCGCCATTTATTACTGCGCGAAGAGAATTGATTGTAACTCCGGCTACTGCTAC<br>CGCCGTAATTACTGGGGTCAGGGAACCCAGGTTACGGTCAGCTCCGGTGGCAGT<br>GGCGGTAGCGGAGGCTCCGGCCAGGTGCAGTTGCAGGAGTCTGGCGGTGGCCTG<br>GTCCAGCCTGGAGGCAGCCTCCGGCTGAGCTGTACTGCTTCAGGCCTGACATTT<br>GACGATAGCGTGATGGGTGGTTCCGCCAAGCGCCGGGAAAGGGTCGCGAGGCC |

TABLE 1B-continued

| Name | SEQ ID NO: | Sequence |
|---|---|---|
| | | GTCTCTTGTATCAGTTCCTCTGGAGCCAACGCTTTCTATGCTGATAGCGTGAAG<br>GGCCGCTTCACAATTAGCCGGGACAATGCAAAGAACACCTTGTACCTGCAAATG<br>AACTCTCTGAAGCCCGAAGATACGGCTACCTACTATTGCAAGCGCGGCCATGCC<br>TGCGCAGGATATTACCCAATCCCCTACGACGATTATTGGGGTCAGGGCACCCAG<br>GTGACCGTGAGCAGC |
| hIL27Ra_<br>VH<br>H9-<br>DR591 | 1339 | CAGGTCCAACTCCAGGAGAGCGGGGGTGGCAGTGTGCAGTCTGGCGGTTCCCTT<br>AGGCTGAGTTGCGCAGCCAGCGGCTTCACATACAGCACCAGCAATTCATGGATG<br>GCGTGGTTCCGTCAGGCCCCCGGTAAGGAGCGGGAGGGCGTCGCCGCTATCTAC<br>ACAGTGGGTGGGTCCATCTTTTACGCTGATTCCGTGCGTGGCCGTTTCACCATC<br>TCCCAAGATGCGACAAAGAATATGTTCTACCTGCAAATGAACACACTCAAGCCC<br>GAAGATACCGCTATGTATTACTGCGCGGCAGCTTCTGGCCGCCTCCGTGGAAAG<br>TGGTTCTGGCCATACGAATATAACTATTGGGGCCAGGGAACTCAGGTGACAGTT<br>AGTAGCGGCGGTGGCTCTCAGGTGCAACTCCAGGAGTCCGGCGGGGGAAGCGTG<br>CAGGCGGGAGGGAGCCTGCGGCTGTCATGTACCGCCAGCGGAGCCATCGCCAGC<br>GGATACATTGATTCCCGCTGGTGTATGGCTTGGTTTCGCCAGGCCCCCGGCAAG<br>GAAAGGGAGGGAGTCGCCGCTATTTGGCCCGGTGGCGGTCTGACAGTGTACGCC<br>GACAGCGTAAAGGGTCGCTTCACTATCAGCCGTGACCACGCTAAGAACACCCTG<br>TACCTCCAGATGAATAACTTGAAGCCAGAGGACACCGCCATGTACTATTGCGCC<br>GCTGGCTCCCCGAGAATGTGCCCTTCTCTCGAATTTGGTTTTGACTACTGGGGG<br>CAGGGGACCCAGGTCACGGTTTCTTCC |
| hIL27Ra_<br>VH<br>H9-<br>DR591 | 1340 | CAGGTGCAACTCCAGGAGAGTGGCGGGGGTTCCGTCCAGAGCGGTGGCAGTCTG<br>AGGCTGTCCTGCGCCGCTTCCGGTTTCACATACTCCACCAGTAACAGCTGGATG<br>GCCTGGTTTCGCCAAGCCCCTGGGAAAGAGAGAGAAGGAGTCGCCGCAATCTAC<br>ACTGTAGGAGGCTCCATTTTCTACGCAGACTCTGTCAGAGGCCGTTTCACCATT<br>AGCCAGGATGCCACTAAGAATATGTTTTACCTCCAGATGAATACACTGAAGCCA<br>GAAGACACCGCTATGTATTACTGTGCTGCGGCTTCCGGCAGGCTGCGCGGCAAG<br>TGGTTCTGGCCTTACGAGTATAACTATTGGGGCCAAGGCACCCAGGTCACCGTG<br>TCAAGCGGGGGTTCCGGTGGCAGCGGAGGGAGCGGCCAGGTGCAGCTGCAAGAG<br>TCTGGTGGCGGTTCCGTCCAGGCTGGGGGCTCTCTCCGGCTGTCTTGTACGGCC<br>AGCGGTGCCATCGCTAGTGGCTACATCGACAGCCGGTGGTGCATGGCCTGGTTC<br>CGTCAGGCTCCTGGAAAGGAACGGGAAGGCGTCGCCGCTATTTGGCCAGGTGGC<br>GGACTGACGGTCTATGCTGACTCTGTCAAGGGACGCTTCACCATCAGTCGCGAT<br>CACGCTAAGAACACCCTCTACCTCCAGATGAATAACCTGAAGCCCGAGGATACG<br>GCCATGTATTACTGCGCCGCTGGTTCCCCAAGAATGTGTCCCAGCCTGGAGTTC<br>GGGTTCGACTATTGGGGACAGGGCACCCAGGTAACCGTGTCATCA |
| hIL27Ra_<br>VH<br>H9-<br>DR592 | 1341 | CAGGTCCAGCTCCAGGAGAGCGGAGGCGGTAGTGTCCAGTCCGGTGGCTCCCTG<br>CGTCTGAGTTGCGCAGCCAGTGGCTTCACTTATTCCAAGCAACTCTTGGATG<br>GCATGGTTTCGCCAGGCCCCTGGGAAGGAACGCGAGGGTGTCGCTGCCATCTAC<br>ACAGTGGGCGGTTCCATTTTCTACGCAGACTCCGTTAGAGGTAGGTTTACTATC<br>AGCCAGGATGCTACCAAGAATATGTTCTACCTTCAGATGAACACACTCAAGCCC<br>GAAGACACCGCCATGTATTACTGTGCCGCAGCCTCTGGCCGCCTGCGCGGTAAG<br>TGGTTCTGGCCTTACGAGTACAATTACTGGGGTCAGGGCACCCAGGTGACAGTT<br>TCCAGTGGTGGAGGCTCCCAGGTTCAGCTTCAGGAGTCTGGAGGGGGCTCCGTG<br>CAGGCAGGAGGCTCTCTGAGACTCAGCTGCACCGCCCCAGGTTTTACCTCCAAC<br>AGCTGCGGCATGGACTGGTATCGCCAGGCCCCCGGCAAGGAACGCGAGTTCGTG<br>AGTTCTATCTCCACCGATGAACAACGGGTTACGCCGATTCTGTGAAGGGCCGG<br>TTTTACAATCTCCAAGGATAAGGCCAAGGACACTGTGTACCTCCAGATGAACTCT<br>TTGAAACCAGAAGACACAGGCATGTATAGCTGTAAGACCAAGGATGGGACCATC<br>GCGACTATGAACTGTGTGACTTCGGATACTGGGGCCAGGGGACCCAGGTCACA<br>GTGTCCTCC |
| hIL27Ra_<br>VH<br>H9-<br>DR592 | 1342 | CAGGTCCAGCTGCAAGAGAGCGGAGGCGGTAGTGTGCAGAGCGGCGGAAGCCTG<br>CGCCTCAGCTGCGCCGCGTCCGGCTTTACCTACAGCACAAGTAACTCTTGGATG<br>GCCTGGTTCCGGCAGGCTCCCGGCAAGGAAAGGGAAGGCGTGGCCGCAATCTAC<br>ACGGTCGGAGGTTCTATTTTCTACGCCGATAGCGTCAGAGGCCGCTTCACAATC<br>TCTCAGGACGCAACCAAAAATATGTTCTACTTGCAGATGAACACACTCAAGCCC<br>GAGGACACCGCGATGTATTACTGTGCCGCTGCATCCGGGCGGCTGAGAGGAAAG<br>TGGTTCTGGCCTTATGAGTACAATTATTGGGGTCAGGGCACTCAGGTGACTGTG<br>TCCTCTGGTGGCTCCGGTGGCAGTGGGGGCAGCGGTCAGGTGCAGCTTCAGGAG<br>TCCGGTGGAGGGAGCGTCCAGGCTGGCGGTTCCCTCAGGCTGTCCTGCACAGCA<br>CCGGGCTTCACTACAACAGCTGCGGTATGGATTGGTATCGCCAGGCACCGGGT<br>AAGGAGCGCGAATTTGTCTCATCTATCAGCACCGATGGGACAACCGGGTACGCT<br>GATAGCGTGAAAGGTAGGTTCACCATCTCCAAGGACAAGGCAAAAGATACCGTG<br>TACCTCCAGATGAACTCTCTCAAGCCCGAGGACACCGGAATGTATAGCTGCAAG<br>ACAAAGGACGGCACCATTGCAACAATGGAGCTTTGTGACTTTGGCTATTGGGGC<br>CAGGGCACCCAGGTAACGGTCTCTTCA |
| hIL27Ra_<br>VH<br>H9-<br>DR593 | 1343 | CAGGTCCAGCTTAAGAATCCGGCGGGGGCTCCGTACAATCAGGAGGGTCACTC<br>AGGCTGAGTTGCGCAGCCTCTGGATTCACGTACTCCACAGCCAATTCCTGGATG<br>GCCTGGTTTAGACAGGCACCCGGCAAGGAGCGTGAGGGGGTGGCTGCCATCTAC<br>ACTGTGGGTGGCTCCATCTTTCTATGCGGACAGTGTTCGCGGGCGTTTTACAATC<br>TCCCAGGACGCCACCAAGAATATGTTCTACTTGCAGATGAACACACTGAAACCG<br>GAGGACACCGCCATGTATTACTGTGCAGCCGCGTCAGGCCGCCTGCGGGGGAAG<br>TGGTTCTGGCCATACGAGTACAACTACTGGGGTCAGGGCACCCAAGTGACCGTG |

TABLE 1B-continued

| Name | SEQ ID NO: | Sequence |
|---|---|---|
| | | AGTTCCGGGGGAGGTTCCCAGGTTCAGCTTCAGGAGTCCGGTGGCGGGTCTGTG<br>CAGGCCGGTGGCTCCCTTCGGCTCTCCTGCGCCGCGAGTGGCTATCCTTATTCC<br>AACGGCTACATGGGCTGGTTCCGTCAGGCACCCGGCAAGGAACGGGAAGGCGTC<br>GCTACCATCTATACAGGTGATGGGCGGACTTATTACGCAGACTCCGTGAAGGGC<br>CGCTTTACTATCAGTCGCGACAACGCAAAGAATACAGTGGACTTGCAAATGAGT<br>TCCCTCAAGCCTGAGGACACTGCTATGTACTATTGTGCTGCCCGTGCAGCGCCA<br>CTGTATAGTTCCGGCTCACCGCTGACCCGCGCTAGGTATAACGTATGGGGTCAG<br>GGCACACAAGTGACGGTGTCAAGC |
| hIL27Ra_<br>VH<br>H9-<br>DR593 | 1344 | CAGGTGCAACTCCAGGAGTCCGGCGGAGGCAGTGTGCAATCCGGGGGTTCTCTG<br>CGCCTCTCTTGCGCTGCCTCTGGGTTTACATATTCCACATCCAACTCCTGGATG<br>GCCTGGTTCCGCCAGGCTCCCGGCAAGGAGAGAGAGGGGGTGGCCGCGATCTAC<br>ACCGTTGGTGGCTCTATCTTCTATGCCGACAGCGTTCGGGGCCGCTTTACCATT<br>AGCCAGGATGCAACTAAGAATATGTTCTACCTTCAGATGAACACACTGAAGCCA<br>GAGGATACTGCAATGTATTACTGCGCCGCAGCTTCTGGCAGACTGCGCGGAAAA<br>TGGTTCTGGCCTTATGAGTACAATTATTGGGGCAGGGCACCCAGGTCACAGTA<br>AGCTCCGGTGGCTCCGGCGGTAGCGGAGGCTCCGGCCAAGTCCAACTTCAGGAA<br>AGCGGTGGCGGGTCTGTGCAGGCCGGTGGCTCCCTCCGCCTGTCTTGCGCGGCT<br>TCCGGCTATCCATACAGTAACGGCTACATGGGTTGGTTCCGGCAGGCCCCTGGC<br>AAGGAGCGTGAGGGCGTTGCTACGATCTATACAGGTGACGGAAGGACTTACTAT<br>GCTGACAGCGTAAAGGGGCGCTTCACCATTTCTCGTGACAACGCAAAGAACACA<br>GTGGACCTCCAGATGAGCAGTCTGAAGCCTGAGGACACCGCGATGTACTATTGT<br>GCCGCTCGGGCCGCTCCTCTGTATTCCAGCGGCAGCCCTCTGACTAGGGCTAGA<br>TACAACGTCTGGGGACAGGGCACTCAGGTGACTGTGAGCAGC |
| hIL27Ra_<br>VH<br>H9-<br>DR594 | 1345 | CAGGTGCAACTCCAGGAGTCTGGAGGGGGCTCCGTGCAGAGTGGCGGAAGCCTG<br>AGGTTGTCCTGTGCCGCGAGTGGATTCACCTACTCCACCTCCAACAGCTGGATG<br>GCCTGGTTTAGACAGGCTCCAGGTAAGGAAAGAGAGGGCGTGGCCGCGATCTAC<br>ACCGTAGGGGCTCCATCTTCTATGCAGATAGCGTGAGGGCCGCTTCACAATC<br>AGTCAGGATGCCACCAAAAATGTTTTACCTCCAGATGAACACACTGAAGCCA<br>GAGGACACCGCCATGTACTATTGCGCCGCTGCCTCTGGTAGGCTGAGGGGCAAA<br>TGGTTCTGGCCCTATGAATATAACTACTGGGGCAGGGCACCCAGGTAACGGTG<br>TCAAGCGGTGGGGGCTCTCAGGTGCAGCTCCAGGAGTCCGGCGGGGGCAGCGTA<br>CAGGCTGGAGGTAGTCTGCGCTTGAGTTGCGTCGCGTCAGCCTCTACCTATTGC<br>ACATACGACATGCACTGGTATAGACAGGCCCCAGGCAAGGGAAGGGAGTTCGTG<br>TCCGCAATCGACTCTGATGGCACAACCAGATACGCAGACTCCGTAAAGGGTCGC<br>TTCACCATCAGCCAGGGCACAGCGAAGAACACAGTGTACCTCCAGATGAACTCC<br>TTGCAGCCTGAGGATACTGCCATGTACTATTGCAAGACTGTGTGCGTTGTCGGA<br>TCTCGCTGGTCAGACTACTGGGGCCAGGGAACACAGGTGACAGTGTCCTCC |
| hIL27Ra_<br>VH<br>H9-<br>DR594 | 1346 | CAGGTGCAACTCCAGGAGTCTGGAGGTGGCTCTGTCCAAAGCGGTGGCTCCCTT<br>CGCCTGAGCTGTGCCGCTAGTGGATTCACGTACTCTACGTCAAATAGCTGGATG<br>GCGTGGTTCAGACAGGCCCCTGGCAAGGAGAGGGAGGGTGTGGCCGCGATCTAT<br>ACTGTGGGCGGTTCCATCTTCTATGCCGATTCCGTGCGCGGTCGGTTTACCATC<br>TCTCAGGACGCTACCAAGAATATGTTTTACTTGCAGATGAACACTCTGAAGCCA<br>GAGGATACCGCGATGTACTATTGCGCAGCGGCCTCTGGTAGGCTGAGAGGCAAA<br>TGGTTCTGGCCTTATGAATACAACTATTGGGGACAGGGAACTCAGGTGACGGTC<br>TCTTCCGGTGGCTCTGGGGGCAGCGGTGGGAGCGGCCAAGTCAGCTTCAGGAG<br>TCTGGCGGAGGCAGCGTTCAAGCAGGCGGTAGCCTGAGACTCTCATGTGTAGCC<br>TCCGCTTCCACTTACTGCACCTACGACATGCACTGGTATCGTCAGGCTCCTGGC<br>AAGGGCCGCGAGTTTGTGTCCGCCATCGACTCCGACGGCACAACGCGGTACGCT<br>GACAGCGTGAAGGGCCGCTTTACCATTAGCCAAGGCACCGCCAAGAATACAGTG<br>TACCTGCAAATGAATAGCCTGCAACCGGAGGATACCGCGATGTACTATTGCAAG<br>ACGGTCTGTGTTGTGGGCAGTCGGTGGAGCGACTACTGGGGGCAAGGTACACAA<br>GTCACTGTGTCCTCC |
| hIL27Ra_<br>VH<br>H9-<br>DR595 | 1347 | CAGGTGCAGCTCCAGGAATCTGGAGGTGGCTCTGTGCAGAGTGGGGGCAGCCTT<br>CGCCTGTCCTGCGCTGCCAGCGGCTTCACATACAGTACGTCAAACTCCTGGATG<br>GCCTGGTTCCGTCAAGCGCCTGGAAAGGAACGCGAGGGAGTGGCTGCGATTTAT<br>ACCGTCGGCGGGTCTATTTTTTACGCCGACTCCGTCAGAGGACGTTTCACGATC<br>TCCCAGGACGCCACGAAGAATATGTTTTATCTCCAGATGAACACACTTAAACCC<br>GAAGACACCGCAATGTATTACTGCGCTGCCGCATCTGGCCGCCTCCGGGGCAAA<br>TGGTTTTGGCCTTACGAGTACAATTACTGGGGCAGGGAACACAGGTTACCGTG<br>AGCAGTGAGGCGGGTCCCAGGTTCAGTTGCAGGAGTCAGGCGGGGAAGCGTG<br>CAGGCCGGAGGTTCACTGACCCTGTCTTGTGCAGCGTCTGAATACGCCTACAGC<br>ACCTGTAACATGGGATGGTATCGCCAGGCTCCTGGAAAGGAAAGGGAGCTGGTG<br>TCTGCCTTTATCTCTGACGGCAGCACTTATTACGCTGACTCCGTGAAGGGACGC<br>TTTACCATCACCCGCGACAACGCGAAGAACACTGTATCTTCAGATGAACTCC<br>CTGAAGCCCGAAGACACCGCGATCTACTATTGCTCCGCTAATTGTTACCGTCGC<br>CTCCGCAACTATTGGGGCCAAGGGACCCAGGTGACCGTTAGTTCC |
| hIL27Ra_<br>VH<br>H9-<br>DR595 | 1348 | CAAGTCCAGCTTCAGGAGTCCGGCGGTGGCAGCGTGCAGTCTGGAGGCTCCCTG<br>CGCTTGTCCTGCGCCGCTTCCGGTTTCACGTATTCCACAAGTAATAGTTGGATG<br>GCTTGGTTTAGACAGGCCCCCGGCAAAGAGCGCGAGGGTGTGGCTGCCATCTAT<br>ACCGTCGGTGGGAGCATCTTTTACGCCGATTCCGTGCGTGGCCGCTTCACCATC<br>AGCCAGGATGCCACAAAGAATATGTTTACTTGAGATGAACACCCTGAAGCCC<br>GAAGACACCGCTATGTACTATTGCGCGGCAGCTTCTGGACGGCTGCGCGGTAAG |

TABLE 1B-continued

| Name | SEQ ID NO: | Sequence |
|---|---|---|
| | | TGGTTTTGGCCATACGAGTACAACTATTGGGGCCAGGGCACTCAGGTGACCGTG<br>TCTTCCGGGGGCTCCGGCGGGAGCGGTGGCTCTGGCCAGGTGCAGCTCCAGGAG<br>TCCGGGGGTGGCTCTGTCCAGGCTGGAGGCAGTCTGACCCTGTCCTGTGCCGCG<br>TCTGAGTACGCCTACTCCACTTGTAATATGGGCTGGTATCGTCAGGCACCTGGC<br>AAAGAACGCGAACTGGTGTCCGCATTTATTTCCGACGGTAGTACCTATTACGCT<br>GATTCCGTGAAGGGACGCTTCACCATCACACGGGATAACGCCAAGAACACTGTG<br>TATCTTCAGATGAACTCCTTGAAGCCCGAAGCACCGCTATCTACTATTGCAGC<br>GCCAACTGCTACAGACGGCTGCGTAACTACTGGGGCCAGGGCACTCAGGTGACT<br>GTCTCCTCT |
| hIL27Ra_<br>VH<br>H9-<br>DR596 | 1349 | CAGGTGCAGCTTCAGGAATCCGGCGGGGGCAGCGTCCAGAGCGGCGGTTCCCTC<br>CGCCTCAGCTGTGCGGCTTCTGGATTCACCTATTCTACAAGCAATTCATGGATG<br>GCGTGGTTTCGCCAAGCGCCGGGCAAAGAGCGTGAGGGCGTTGCGGCTATTTAC<br>ACTGTCGGAGGCTCCATCTTCTACGCAGACTCAGTGCGTGGCCGTTTCACTATC<br>TCCCAGGACGCCACTAAGAATATGTTCTATCTCCAGATGAATACCCTCAAACCA<br>GAAGACACCGCAATGTATTACTGCGCTGCCGCATCTGGCCGTCTGAGAGGTAAG<br>TGGTTTTGGCCTTACGAGTACAACTACTGGGGACAAGGCACTCAGGTCACAGTC<br>TCCTCAGGCGGTGGCTCCCAGGTGCAGCTCCAAGAGTCAGGCGGGGGTCTGGTC<br>CAGCCTGGCGGGTCCCTTAGGCTTAGCTGTACCGCGTCCGGTCTCACCTTCGAT<br>GACAGCGTCATGGGATGGTTCCGCCAGGCCCCAGGCAAGGGAGGGAGGCAGTG<br>AGCTGCATCTCCAGCTCCGGCGCTAACGCCTTTTATGCGGACAGTGTCAAAGGC<br>AGGTTCACGATTTCTAGGGATAACGCTAAGAACACCCTGTACCTCCAGATGAAC<br>AGCCTCAAACCGGAGGATACCGCGACTTACTATTGCAAACGTGGTCACGCCTGC<br>GCTGGTTATTACCCCATCCCGTATGATGACTATTGGGGCCAAGGCACCCAGGTG<br>ACTGTTTCTTCC |
| hIL27Ra_<br>VH<br>H9-<br>DR596 | 1350 | CAGGTCCAGTTGCAGGAGTCAGGCGGGGGCTCTGTGCAGTCTGGAGGCAGTCTC<br>AGACTGTCTTGCGCGGCTTCCGGCTTCACATACTCCACTTCCAACAGTTGGATG<br>GCCTGGTTCAGGCAAGCGCCGGGCAAGGAGAGAGAGGGTGTAGCGGCAATCTAT<br>ACTGTCGGCGGTTCAATTTTTTACGCGGACTCTGTTCGTGGCAGATTCACCATT<br>TCCCAGGACGCCACAAAAAATATGTTCTACCTCCAAATGAACACCCTCAAGCCT<br>GAGGACACTGCTATGTATTACTGTGCGGCTGCCTCAGGCCGTCTGCGGGGTAAG<br>TGGTTTTGGCCCTACGAGTACAACTACTGGGGCCAGGGGACGCAGGTGACAGTC<br>AGCTCAGGGGGCAGCGGCGGGTCCGGCGGGAGTGGCCAGGTGCAGCTCCAGGAA<br>TCTGGCGGAGGTCTTGTCCAGCCTGGCGGGTCTTTGCGTCTGTCCTGTACCGCA<br>AGTGGTCTGACCTTCGATGACTCAGTTATGGGATGGTTCAGACAAGCGCCTGGT<br>AAGGGCCGCGAGGCGGTGTCATGTATCTCTTCCAGCGGAGCCAACGCTTTTTAC<br>GCCGACTCCGTGAAAGGCAGGTTTACGATTAGTCGGGATAATGCCAAGAACACC<br>TTGTACCTCCAGATGAACAGCTTGAAGCCCGAAGCACTGCTACCTATTACTGT<br>AAGCGCGGTCACGCCTGCGCGGGCTATTACCCAATCCCCTACGATGACTACTGG<br>GGCCAGGGAACCCAGGTGACAGTTTCCAGC |
| hIL27Ra_<br>VH<br>H10-<br>DR591 | 1351 | CAGGTGCAGCTGCAAGAATCCGGCGGTGGCTCCGTTCAGGCCGGAGGCTCATTG<br>CGTCTCTCCTGTCGTGCGTCTGGGTCCACCTACTCTAACTATTGCCTGGGGTGG<br>TTCCGGCAGATTACGGGTAAGGAACGCGAAGGAGTTGCCGTGATTAACTGGGTC<br>GGTGGAATGCTGTACTTTGCTGACTCCGTCAAGGGTCGCTTCACCGTCTCCCAG<br>GACCAGGCTAAGAACACCCTGTACTTGCAGATGAACTCCCTCAAGCCTGAGGAC<br>ACCGCAATGTATTACTGTGCCGCTGAGTCAGTCAGCTCCTTCTCCTGCGGCGGG<br>TGGCTCACTCGCCCCGACAGAGTCCCCTATTGGGGGCAGGGAACCCAGGTGACT<br>GTCTCTAGCGGTGGGGGCTCCCAGGTGCAGTTGCAGGAATCTGGTGGGGGCTCC<br>GTCCAAGCCGGTGGCTCACTTAGGCTGTCCTGTACGGCAAGCGGGGCCATCGCC<br>TCTGGTTATATCGACTCACGGTGGTGTATGGCATGGTTCAGACAGGCTCCAGGG<br>AAGGAGCGGGAGGGAGTCGCTGCCATCTGGCCGGGCGGGGGCCTCACCGTTTAC<br>GCAGATAGCGTGAAGGGTAGGTTTACCATTCTCTCGCGACCACGCCAAAAATACT<br>CTGTACCTCCAAATGAATAACCTGAAGCCCGAAGATACCGCCATGTACTATTGC<br>GCCGCTGGCTCCCCGCGCATGTGCCCTTCTCTGGAGTTCGGCTTCGATTATTGG<br>GGACAAGGAACCCAGGTGACAGTGTCTTCC |
| hIL27Ra_<br>VH<br>H10-<br>DR591 | 1352 | CAGGTACAGCTTCAGGAAAGCGGGGGAGGCTCAGTGCAGGCTGGCGGAAGCCTT<br>CGCCTGTCATGTCGGGCTCTGGTTCCACCTACAGTAACTACTGCCTGGGCTGG<br>TTCCGCCAGATCACTGGCAAGGAACGCGAGGGCGTCGCGGTCATCAACTGGGTC<br>GGCGGAATGTTGTACTTCGCAGATAGCGTCAAGGGCAGGTTCACGGTCTCCCAG<br>GATCAGGCCAAGAACACCCTGTATCTGCAAATGAACTCCCTCAAGCCTGAAGAT<br>ACCGCCATGTATTACTGCGCAGCCGAGTCTGTCTCTTCATTCTCTTGCGGGGGT<br>TGGCTGACCCGTCCTGACAGGGTGCCATACTGGGGCCAGGGTACACAAGTCACC<br>GTGTCTTCAGGAGGTTCCGGTGGGTCAGGAGGTTCCGGGCAAGTTCAGCTCCAA<br>GAGAGTGGTGGCGGTAGCGTGCAGGCAGGCGGTTCACTTCGTCTGTCTTGCACA<br>GCCAGTGGGGCTATCGCCTCCGGCTACATTGACAGCAGATGGTGTATGGCCTGG<br>TTCCGGCAGGCCCCAGGCAAAGAAAGAAGGGGTGGCAGCCATCTGGCCGGGT<br>GGGGGCCTGACGGTCTATGCTGACAGCGTGAAGGGCCGCTTCACTATCTCAAGG<br>GATCACGCCAAGAACACCTTGTACTTGCAGATGAACAATCTGAAGCCCGAAGAC<br>ACCGCAATGTATTACTGTGCCGCAGGTAGCCCCGCATGTGCCCATCCCTGGAG<br>TTTGGATTCGACTACTGGGGCCAGGGAACCCAGGTGACCGTTAGCTCT |

TABLE 1B-continued

| Name | SEQ ID NO: | Sequence |
|---|---|---|
| hIL27Ra_VH H10-DR592 | 1353 | CAGGTTCAGCTTCAGGAGAGCGGCGGTGGGTCCGTGCAGGCCGGTGGCTCCCTG<br>CGCCTGAGCTGCCGCGCCAGCGGAAGCACTTACAGCAATTATTGTCTTGGCTGG<br>TTCCGTCAGATCACAGGCAAAGAGCGCGAAGGCGTGGCCGTTATCAACTGGGTC<br>GGCGGTATGCTGTATTTCGCCGACTCTGTGAAAGGTCGCTTTACGGTCTCTCAG<br>GATCAGGCCAAGAACACGCTTTACTTGCAAATGAACTCACTGAAGCCCGAAGAC<br>ACCGCCATGTATTACTGTGCCGCAGAGTCTGTCAGCTCCTTTTCATGCGGAGGT<br>TGGTTGACTCGCCCCGACCGTGTTCCTTACTGGGGCCAGGGCACGCAAGTGACC<br>GTTTCCTCTGGAGGCGGAAGTCAGGTGCAGTTGCAGGAGTCCGGGGGCGGTAGC<br>GTGCAGGCCGGTGGCAGTCTGCGTCTGAGTTGTACTGCCCCCGGCTTCACCTCC<br>AACTCCTGTGGCATGGACTGGTATCGCCAGGCCCCCGGAAAAGAACGTGAGTTC<br>GTATCTAGCATCTCCACCGATGGGACCACAGGTTATGCTGATTCCGTAAAGGGT<br>AGGTTCACTATCAGCAAGGATAAAGCCAAAGATACCGTGTACCTCCAGATGAAT<br>AGCCTTAAACCAGAGGATACGGGAATGTATAGTTGCAAGACCAAGGATGGAACT<br>ATCGCGACAATGGAACTCTGCGACTTCGGCTACTGGGGCCAGGGAACTCAGGTG<br>ACCGTGTCCTCC |
| hIL27Ra_VH H10-DR592 | 1354 | CAGGTTCAGTTGCAGGAATCCGGGGGCGGAAGCGTGCAAGCAGGGGGTAGTTTG<br>CGCCTGTCATGCCGCGCCAGCGGCTCCACCTACAGCAATTATTGTCTTGGTTGG<br>TTCCGCCAGATCACTGGCAAGGAGCGCGAAGGGGTGGCCGTGATTAACTGGGTG<br>GGCGGTATGTTGTACTTCGCTGACTCCGTAAAGGGGACGCTTCACTGTCAGCCAG<br>GACCAGGCTAAGAACACTCTGTATCTCCAGATGAACTCACTGAAGCCTGAGGAT<br>ACCGCCATGTATTACTGCGCTGCCGAGTCCGTCTCCAGCTTTTCCTGCGGCGGA<br>TGGCTGACTCGCCCTGACCGCGTGCCGTACTGGGGGCAAGGCACTCAGGTGACA<br>GTGTCTAGCGGAGGGTCTGGGGGCTCTGGTGGAAGCGGGCAGGTGCAGCTTCAG<br>GAATCTGGCGGTGGGAGCGTACAAGCGGGCGGATCTCTTCGTCTGTCCTGTACC<br>GCTCCTGGCTTTACGTCCAATTCCTGTGGGATGGATTGGTACAGACAAGCCCCA<br>GGTAAGGAGCGCGAGTTCGTGTCCTCTATCAGCACCGACGGAACTACCGGGTAC<br>GCTGACTCAGTGAAGGGTCGCTTCACCATCAGCAAGGATAAGGCCAAGGATACC<br>GTGTACCTGCAAATGAACAGTCTGAAGCCAGAAGATACCGGCATGTACTCATGC<br>AAGACGAAAGATGGACTATCGCCACTATGGAACTGTGCGATTTTGGCTACTGG<br>GGGCAGGGCACTCAGGTGACTGTCTCAAGC |
| hIL27Ra_VH H10-DR593 | 1355 | CAGGTCCAGCTCCAGGAATCTGGTGGAGGTAGCGTTCAGGCCGGGGGCTCCCTC<br>CGCCTGTCATGCAGGGCCAGCGGCTCTACCTATTCCAATTACTGCCTCGGGTGG<br>TTCAGACAGATCACAGGAAAGGAGCGCGAGGGCGTGGCAGTCATCAACTGGGTA<br>GGCGGTATGCTGTATTTCGCGGATAGTGTGAAGGGAAGATTCACCGTGAGTCAG<br>GATCAGGCTAAGAACACCCTGTATCTCCAGATGAACTCCTTGAAGCCCGAGGAC<br>ACTGCCATGTATTACTGCGCAGCCGAATCTGTTAGCTCCTTCAGCTGTGGTGGC<br>TGGCTGACCCGCCCAGATCGCGTGCCATATTGGGGCCAGGGCACACAGGTTACT<br>GTCTCCAGTGGCGGGGGCAGCCAAGTGCAGTTGCAGGAGAGCGGAGGCGGAAGT<br>GTGCAGGCAGGCGGATCTCTGAGACTCTCTTGTGCTGCCTCCGGCTATCCATAT<br>TCTAATGGCTACATGGGATGGTTCCGCCAAGCACCGGGCAAAGAGAGAGAAGGG<br>GTTGCTACCATCTATACCGGCGATGGCAGAACCTATTACGCGGACTCCGTGAAG<br>GGACGCTTCACCATCAGCCGTGATAACGCCAAGAACACTGTGGACCTCCAGATG<br>TCTTCCCTGAAGCCTGAAGACACCGCTATGTACATTGTGCTGCACGCGCCGCG<br>CCACTTTACAGTAGCGGTTCTCCTCTTACCCGCGCTCGCTACAACGTCTGGGGC<br>CAGGGTACTCAGGTGACAGTTAGTAGC |
| hIL27Ra_VH H10-DR593 | 1356 | CAAGTGCAGTTGCAGGAAAGCGGAGGCGGGAGCGTACAGGCGGGCGGTTCTCTG<br>CGGCTGAGCTGCCGCGCATCTGGTTCCACATACAGCAATTATTGTCTGGGTTGG<br>TTTAGGCAGATCACTGGTAAGGAGAGGGAAGGGGTCGCAGTTATAAATTGGGTG<br>GGTGGGATGCTCTACTTCGCCGATTCAGTGAAGGGCCGCTTCACCGTGAGTCAG<br>GATCAGGCGAAGAATACTCTGTACCTCCAGATGAATAGCCTGAAGCCCGAGGAC<br>ACCGCCATGTATTACTGCGCCGCAGAGAGTGTCAGCTCCTTTAGCTGCGGGGGC<br>TGGCTGACCCGCCCGGACCGCGTGCCCTACTGGGGCCAGGGCACCCAGGTTACC<br>GTTAGCTCTGGCGGTAGCGGGGGCTCTGGAGGCAGCGGACAAGTCCAGCTGCAA<br>GAATCCGGGGGAGGCAGCGTACAGGCTGCGGGTCTCTGCGCCTGTCCTGCGCC<br>GCTTCAGGATACCCGTATAGCAACGGCTATATGGGTTGGTTCAGACAGGCCCCC<br>GGCAAGGAACGTGAAGGAGTGGCCACCATCTACACCGGCGACGGGCGCACCTAT<br>TACGCTGATTCTGTGAAGGGCCGCTTTACAATCAGCCGCGATAACGCTAAGAAC<br>ACCGTTGACCTTCAAATGTCCAGCCTGAAGCCGGAGGATACCGCCATGTATTAC<br>TGTGCAGCCCGCCGCACCACTCTACAGCTCCGGTTCTCCCCTCACAAGGGCT<br>CGGTACAATGTTTGGGGCCAGGGCACCCAGGTCACCGTCTCTAGC |
| hIL27Ra_VH H10-DR594 | 1357 | CAGGTGCAGCTCCAGGAATCAGGTGGGGGCAGCGTACAGGCAGGGGGTTCACTC<br>CGCCTGTCTTGCCGGGCCTCTGGCAGTACATACTCCAATTATTGCCTGGGTTGG<br>TTTCGCCAAATTACCGGCAAGGAGCGGGAGGGCGTCGCTGTAATCAACTGGGTG<br>GGCGGGATGCTCTATTTTGCTGACTCCGTTAAGGGTCGTTTCACGGTCAGCCAG<br>GACCAGGCCAAAAATACACTGTATCTCCAGATGAACTCCCTCAAACCCGAAGAC<br>ACCGCCATGTATTACTGTGCCGCGAGAGTGTCAGCTCTTTTCCTGCGGCGGG<br>TGGCTTACCCGCCCGGACCGTGTCCCATACTGGGGTCAAGGCACCCAGGTTACC<br>GTCTCATCCGGCGGAGGCAGCCAGGTGCAACTCCAGGAGAGCGGGGGCGGTAGC<br>GTGCAGGCAGGCGGAAGCCTGCGTCTCTCCTGTGTGGCTTCCGCGTCCACCTAC<br>TGTACCTATGATATGCACTGGTATCGCCAGGCTCCTGGAAAGGGCCGCGAGTTC<br>GTGAGTGCTATTGATTCCGATGGCACCACTCGCTACGCTGACTCCGTGAAGGGA<br>CGTTTCACCATCTCCCAGGGTACAGCTAAGAACACCGTGTACCTCCAGATGAAC |

TABLE 1B-continued

| Name | SEQ ID NO: | Sequence |
|---|---|---|
| | | TCCCTCCAGCCCGAGGATACCGCAATGTATTACTGCAAGACCGTTTGTGTAGTG<br>GGCTCACGCTGGTCCGACTATTGGGGCCAGGGGACCCAGGTGACTGTATCATCT |
| hIL27Ra_<br>VH<br>H10-<br>DR594 | 1358 | CAGGTCCAGCTTCAGGAAAGCGGTGGGGGCTCCGTGCAGGCCGGAGGCTCCCTG<br>CGTCTGAGCTGTCGGGCCTCTGGTTCCACCTACTCCAACTACTGTCTGGGCTGG<br>TTCCGCCAGATTACAGGCAAGGAACGCGAGGGTGTGGCCGTCATAAATTGGGTG<br>GGTGGAATGCTGTATTTCGCGGATAGCGTGAAAGGGCGCTTCACCGTGTCTCAG<br>GACCAGGCTAAGAACACACTGTACTTGCAGATGAACAGCCTGAAGCCCGAAGAC<br>ACTGCCATGTACTATTGTGCCGCTGAGTCTGTCTCCTCTTTCTCCTGCGGCGGA<br>TGGCTGACCCGCCCCGACAGGGTGCCTTACTGGGGTCAGGGCACCCAGGTGACG<br>GTTTCTAGTGGTGGCTCAGGTGGCTCCGGCGGTTCCGGCCAGGTCCAGTTGCAG<br>GAGTCTGGAGGTGGCAGCGTGCAGGCCGGTGGCAGCCTGCGCCTGTCATGTGTC<br>GCTTCTGCGAGCACCTATTGTACCTATGATATGCACTGGTATCGCCAGGCCCCA<br>GGCAAGGGTAGGGAGTTTGTGTCCGCGATTGACTCTGACGGCACCACGCGCTAT<br>GCGGATTCCGTGAAGGGGCGTTTTACAATCTCCCAGGGCACCGCTAAGAACACT<br>GTTTATCTTCAGATGAACAGCTTGCAGCCTGAGGACACCGCGATGTATTACTGT<br>AAAACTGTCTGTGTAGTGGGCTCCAGGTGGTCTGACTACTGGGGTCAGGGCACC<br>CAGGTGACGGTTTCCAGC |
| hIL27Ra_<br>VH<br>H10-<br>DR595 | 1359 | CAGGTGCAGTTGCAGGAATCTGGGGGTGGCTCTGTGCAGGCGGGCGGGTCCCTG<br>CGCTTGTCCTGCCGCGCTTCTGGTTCTACCTACTCCAACTATTGTCTGGGCTGG<br>TTTAGGCAGATCACCGGAAAGGAGCGCGAAGGTGTGGCTGTTATAAATTGGGTG<br>GGCGGGATGCTCTATTTTGCAGACTCCGTCAAGGGCCGCTTCACCGTCTCACAG<br>GATCAAGCCAAGAATACGCTGTATCTTCAGATGAACAGCCTGAAGCCCGAGGAT<br>ACAGCCATGTATTACTGCGCCGCAGAGTCTGTGTCTTCCTTTTCTTGCGGAGGC<br>TGGCTCACACGCCCGGACCGCGTGCCCTACTGGGGCCAGGGCACCCAGGTGACC<br>GTATCCAGCGGGGCGGTTCCCAAGTGCAGCTCCAGGAGTCTGGCGGAGGGTCC<br>GTGCAGGCTGGTGGGAGTCTGACCTTGAGTTGCGCAGCCAGCGAATACGCTTAC<br>TCCACTTGCAACATGGGTTGGTATCGTCAGGCTCCCGGTAAAGAGCGCGAGCTG<br>GTCTCTGCATTCATCTCAGATGGCTCTACTTACTATGCTGACTCCGTGAAGGGT<br>CGGTTTACTATCACCCGCGACAACGCCAAGAACACAGTGTACTTGCAGATGAAC<br>TCCCTGAAGCCCGAGGATACCGCCATTTACTATTGTTCCGCCAACTGTTACAGA<br>CGCCTGCGCAACTATTGGGGGCAGGGAACACAGGTTACTGTGTCCTCT |
| hIL27Ra_<br>VH<br>H10-<br>DR595 | 1360 | CAGGTGCAGTTGCAGGAGAGCGGAGGTGGCAGCGTCCAGGCCGGAGGTTCTCTG<br>CGTCTGAGCTGCCGTGCATCCGGTAGTACATACTCTAACTACTGTCTCGGCTGG<br>TTCAGGCAGATCACAGGCAAGGAAAGGGAGGGTGTTGCCGTAATCAACTGGGTT<br>GGCGGTATGCTCTACTTCGCTGACTCCGTGAAGGGTAGATTTACCGTGTCTCAG<br>GACCAAGCTAAGAACACCCTGTACTTGCAGATGAACAGCCTGAAACCGGAAGAT<br>ACCGCCATGTACTATTGCGCTGCCGAGTCCGTGTCCTCTTTCAGCTGCGGGGGT<br>TGGCTGACCAGACCTGATCGCGTTCCGTACTGGGGTCAAGGCACACAGGTTACC<br>GTGTCAAGCGGTGGCTCTGGAGGCTCCGGTGGGTCCGGTCAGGTCCAGTTGCAA<br>GAGTCTGGAGGTGGCAGCGTCCAGGCCGGAGGCTCCCTCACCCTGAGTTGTGCG<br>GCCAGTGAGTACGCCTACTCCACTTGCAACATGGGATGGTATCGCCAGGCCCCA<br>GGAAAGGAGCGCGAGCTGGTCTCCGCTTTCATCTCCGACGGATCTACCTATTAC<br>GCCGACTCTGTGAAGGGACGTTTTACTATCACTAGGGATAACGCGAAAAACACT<br>GTGTACCTCCAGATGAACTCTCTCAAGCCTGAGGACACCGGCCATCTACTATTGC<br>TCTGCGAACTGTTACAGACGGCTGAGAAATTATTGGGGACAGGGTACTCAGGTG<br>ACCGTTAGCAGC |
| hIL27Ra_<br>VH<br>H10-<br>DR596 | 1361 | CAGGTTCAGCTCCAGGAATCTGGGGGAGGCTCTGTCCAAGCTGGCGGTTCCTTG<br>CGTCTGTCTTGTAGGGCCTCTGGGAGCACCTACTCCAATTACTGTCTGGGGTGG<br>TTTCGGCAGATCACCGGCAAGAACGCGAGGGCGTGGCCGTCATCAACTGGGTG<br>GGCGGAATGCTGTACTTTGCCGACTCTGTGAAGGGCCGCTTCACGGTGTCACAG<br>GACCAGGCCAAGAATACCCTGTATCTTCAGATGAACTCTCTCAAGCCCGAGGAC<br>ACTGCTATGTATTACTGTGCTGCGGAGAGCGTCTCATCCTTCAGCTGTGGTGGC<br>TGGCTGACACGCCCGGACCGTGTCCCTTATTGGGGTCAGGGAACCCAGGTGACC<br>GTTAGCTCAGGAGGTGGATCTCAGGTGCAACTCCAGGAGAGCGGCGGTGGCCTG<br>GTGCAACCCGGAGGTAGCTTGCGCTTGTCCTGTACTGCCTCTGGACTCACCTTC<br>GATGACTCAGTAATGGGTTGGTTCAGACAGGCCCCCGGAAAGGGCAGGGAGGCA<br>GTGTCTTGTATTAGCTCCAGCGGGGCTAATGCGTTCTACGCCGATTCCGTCAAG<br>GGCAGGTTTACCATTAGTCGCGATAACGCCAAGAACACCCTTTACTTGCAGATG<br>AACAGCCTGAAGCCCGAGGACACAGCCACCTATTACTGTAAGAGAGGTCACGCC<br>TGTGCTGGCTATTACCCAATTCCTTACGATGACTACTGGGGACAGGGAACCCAA<br>GTCACTGTCTCTTCT |
| hIL27Ra_<br>VH<br>H10-<br>DR596 | 1362 | CAGGTCCAGCTTCAGGAGTCCGGGGGCGGTTCCGTCCAGGCCGGGGATCACTT<br>CGCCTGTCTTGTCGCGCCTCAGGCTCTACTTACTCCAATTATTGCCTCGGTTGG<br>TTCCGCCAAATCACCGGCAAGAACGGGAGGGAGTAGCCGTAATTAACTGGGTT<br>GGGGGAATGCTGTATTTCGCCGACAGTGTGAAGGGCCGCTTCACCGTGTCTCAG<br>GACCAGGCAAAGAATACCCTGTATCTCCAGATGAACTCCCTGAAGCCGGAGGAC<br>ACTGCCATGTATTACTGCGCCGCTGAGTCCGTGTCTCAGCTTCTCCTGGTGGC<br>TGGCTGACCCGCCCAGATCGTGTTCCTTATTGGGGCCAGGGCACTCAGGTCACA<br>GTCAGCTCTGGAGGCTCAGGAGGTTCTGGCGGTAGTGGTCAGGTTCAGCTCCAG<br>GAAAGCGGAGGCGGATTGGTTCAGCCTGGTGGAAGTCTGCGCCTCTCTTGCACC<br>GCCTCCGGCCTGACATTTGACGATAGCGTGATGGGCTGGTTCCGCCAGGCTCCG<br>GGAAAGGGTAGAGAGGCTGTGTCTTGTATCAGCTCTTCCGGGGCGAACGCCTTC TABLE 1B-continued

| Name | SEQ ID NO: | Sequence |
|---|---|---|
| | | TACGCCGACTCCGTGAAGGGCCGTTTCACCATCTCACGCGACAACGCAAAGAAC<br>ACTCTGTATCTCCAGATGAACAGTCTGAAGCCCGAAGACACGGCGACCTACTAT<br>TGCAAGCGCGGCCACGCCTGCGCCGGGTACTATCCCATCCCATACGATGACTAT<br>TGGGGCCAGGGAACCCAAGTGACCGTATCTTCA |
| hIL27Ra_<br>VH<br>H11-<br>DR591 | 1363 | CAGGTGCAGCTTCAGGAGAGTGGTGGAGGCTCCGTGCAGGCCGGTGGCAGCCTC<br>CGTCTCTCTTGCAGAGCCTCAGGAAGCACCTACAGCAATTACTGTTTGGGGTGG<br>TTTCGGCAGTCAACGGGCAAGGAGAGAGAGGGCGTGGCCGTTATCAACTGGGTG<br>GGCGGTATGCTGTACTTCGCCGACTCTGTGAAGGGTCGCTTCACAGTGAGCCAG<br>GACCACGCGAAGAATACAGTGACTCTCCAGATGAACTCCCTCAAGCCCGAGGAC<br>ACCGCCATGTACTATTGTGCGGCTGAGTCCGTATCCTCTTTTTCCTGCGGGGGC<br>TGGCTGACTAGGCCTGGCCGTGTCCCATACTGGGGGCAGGGCACTCAGGTCACA<br>GTCAGCAGTGGAGGCGGTAGTCAGGTCCAGTTGCAGGAAAGCGGCGGAGGTTCC<br>GTCCAGGCCGGAGGTTCCCTGCGCCTGAGCTGCACCGCTTCCGGCGCAATCGCC<br>TCTGGTTACATCGACTCCCGCTGGTGTATGGCCTGGTTCCGCCAGGCCCCTGGA<br>AAGGAGCGCGAGGGTGTCGCTGCGATCTGGCCTGGTGGAGGCCTGACTGTCTAT<br>GCTGATTCCGTAAAGGGCCGTTTCACTATCTCTCGCGATCATGCCAAAAACACC<br>CTGTACTTGCAGATGAATAACCTGAAGCCCGAAGACACTGCCATGTATTACTGT<br>GCCGCAGGCTCTCCTAGAATGTGCCCTTCCCTGGAGTTCGGGTTTGATTATTGG<br>GGGCAGGGCACCCAGGTTACTGTGTCTTCC |
| hIL27Ra_<br>VH<br>H11-<br>DR591 | 1364 | CAAGTCCAGCTCCAGGAGAGCGGGGGAGGCTCCGTGCAGGCCGGTGGCAGCCTC<br>CGCCTCAGCTGCCGTGCTTCAGGAAGCACCTACAGCAACTACTGCTTGGGTTGG<br>TTTCGTCAGAGCACCGGAAAAGAGCGCGAGGGTGTGGCTGTGATTAACTGGGTC<br>GGAGGGATGCTGTATTTTGCGGATAGCGTGAAGGGGCGCTTCACAGTGTCTCAG<br>GATCATGCCAAGAACACAGTGACCCTTCAGATGAACAGCCTCAAGCCTGAGGAC<br>ACCGCCATGTATTACTGCGCTGCCGAGTCCGTCAGCTCCTTCAGCTGCGGGGGC<br>TGGCTCACCCGCCCTGGCCGCGTGCCCTATTGGGGCCAGGGAACCCAGGTTACT<br>GTTTCCAGTGGAGGGTCCGGGGGCTCTGGAGGCAGCGGCCAGGTACAGTTGCAG<br>GAATCCGGCGGGGGCTCAGTCCAGGCGGGAGGTTCCTTGCGCCTGTCCTGTACC<br>GCGTCCGGTGCAATCGCCTCCGGCTATATTGATTCCAGATGGTGTATGGCATGG<br>TTCCGCCAGGCTCCGGTAAGGAACGGGAGGGGGTTGCGGCCATCTGGCCAGGA<br>GGGGGGTCTCACCGTGTATGCCGACAGTGTTAAGGGCCGTTTCACTATCAGCAGG<br>GACCATGCAAAGAACACGCTGTACCTCCAAATGAACAATCTGAAGCCGGAAGAC<br>ACCGCCATGTATTACTGTGCCGGTAGTCCTAGAATGTGTCCATCTCTGGAG<br>TTCGGTTTTGATTACTGGGGTCAGGGCACACAAGTTACCGTGTCTAGC |
| hIL27Ra_<br>VH<br>H11-<br>DR592 | 1365 | CAGGTACAACTCCAGGAGTCTGGTGGGGGCAGCGTACAGGCCGGAGGCTCTCTC<br>AGACTCTCATGTCGCGCGAGCGGCTCCACCTATAGCAACTATTGCCTGGGGTGG<br>TTCAGACAGAGCACTGGTAAGGAGCGTGAAGGTGTGGCAGTTATCAACTGGGTC<br>GGGGGAATGCTGTATTTCGCCGACAGCGTGAAGGGCCGGTTCACTGTGTCCCAG<br>GATCATGCCAAAAACACCGTCACCCTCCAGATGAACTCCCTGAAGCCCGAGGAC<br>ACAGCTATGTATTACTGTGCTGCGGAGAGCGTTAGCTCTTTCAGCTGTGGTGGC<br>TGGCTCACCCGGCCAGGCCGTGTCCCATATTGGGGACAGGGCACCCAGGTGACA<br>GTGTCTAGCGGCGGTGGCTCCCAGGTCCAGCTTCAGGAGTCCGGCGGTGGATCT<br>GTGCAGGCAGGCGGTTCCCTCAGGCTGAGTTGTACCGCCCCCGGCTTCACCAGC<br>AACAGCTGCGGTATGGACTGGTATCGCCAGGCTCCCGGAAAGGAGAGAGAGTTC<br>GTGAGTTCTATCTCCACTGATGGGACGACCGGCTACGCCGACTCCGTGAAGGGG<br>CGCTTCACTATCTCTAAAGATAAGGCTAAGGATACCGTCTACTTGCAGATGAAT<br>AGCTTGAAACCTGAAGATACCGGCATGTACTCCTGCAAGACCAAGGATGGGACC<br>ATTGCTACGATGAACTCTGTGACTTCGGCTACTGGGGACAGGGCACTCAGGTG<br>ACCGTCTCCAGT |
| hIL27Ra_<br>VH<br>H11-<br>DR592 | 1366 | CAGGTGCAGCTTCAGGAGTCTGGAGGCGGATCTGTGCAGGCAGGCGGTAGTCTG<br>CGTCTTAGCTGCCGTGCCTCTGGCTCAACCTATTCCAATTATTGCCTCGGCTGG<br>TTTCGGCAGTCCACCGGCAAGGAAAGGGAAGGCGTGGCGGTCATCAACTGGGTT<br>GGGGGTATGCTGTATTTCGCCGACAGCGTGAAGGGCCGTTTTACAGTGTCTCAA<br>GACCATGCTAAGAATACCGTTACCCTCCAGATGAACTCTCTCAAACCGGAAGAC<br>ACTGCTATGTATTACTGCGCAGCCGAATCCGTTTCTAGCTTCAGCTGCGGGGGT<br>TGGCTGACTAGGCCTGGGCGCGTGCCCTATTGGGGGCAGGGTACACAGGTAACC<br>GTTTCCAGCGGAGGCTCTGGCGGGAGTGGCGGATCTGGCCAGGTGCAGTTGCAG<br>GAATCGGAGGCGGATCTGTCCAAGCTGGGGGCAGCCTCCGTCTGTCATGTACC<br>GCCCCTGGGTTCACTTCCAACTCCTGCGGCATGGATTGGTATCGCCAGGCACCT<br>GGGAAGGAGCGCGAATTTGTAAGCTCAATCTCCACAGATGGCACCACTGGCTAT<br>GCTGACAGTGTTAAAGGCCGGTTCACCATCTCCAAGGATAAGGCTAAGGATACT<br>GTATACCTTCAGATGAACTCTCTGAAACCTGAAGACACAGGAATGTATTCCTGT<br>AAGACGAAGGATGGCACCATCGCTACAATGGAGCTTTGCGATTTTGGCTATTGG<br>GGACAGGGCACACAGGTGACGGTTAGTAGC |
| hIL27Ra_<br>VH<br>H11-<br>DR593 | 1367 | CAGGTGCAGCTCCAGGAGTCTGGTGGCGGTTCCGTGCAGGCCGGAGGCAGCCTG<br>CGCCTGTCCTGCCGCGCCTCTGGATCTACATACTCCAATTACTGTCTGGGGTGG<br>TTCAGACAGAGTACTGGAAAAGAGCGCGAAGGTGTAGCCGTCATAAATTGGGTC<br>GGCGGTATGCTGTACTTCGCCGACAGCGTGAAGGGAAGGTTTACTGTGTCCCAG<br>GACCATGCTAAGAATACCGTGACCCTGCAAATGAACTCCCTTAAACCCGAGGAC<br>ACCGCTATGTACTATTGCGCGGCTGAGTCCGTGTCCAGCTTTTCTTGCGGAGGC<br>TGGCTCACCCGTCCAGGCCGTGTTCCTTATTGGGGACAGGGCACCCAGGTGACG<br>GTCTCCTCTGGTGGAGGTTCCCAGGTGCAGCTCCAGGAGAGTGGAGGCGGGTCA |

TABLE 1B-continued

| Name | SEQ ID NO: | Sequence |
|---|---|---|
| | | GTACAGGCTGGCGGAAGCCTCCGCTTGAGCTGCGCTGCCTCCGGCTATCCCTAC<br>TCAAACGGCTATATGGGATGGTTTCGCCAGGCCCCCGGAAAGGAACGCGAGGGC<br>GTGGCCACCATTTATACTGGCGATGGCCGGACCTACTATGCTGACTCTGTGAAA<br>GGCCGCTTTACCATCAGCCGTGACAACGCCAAGAACACTGTTGATTTGCAGATG<br>TCTAGCCTGAAGCCCGAAGACACCGCTATGTATTACTGTGCAGCTCGGGCTGCC<br>CCTCTGTACTCCTCTGGAAGCCCCCTCACTCGGGCCAGATACAACGTGTGGGGA<br>CAGGGGACCCAGGTCACCGTGTCAAGT |
| hIL27Ra_<br>VH<br>H11-<br>DR593 | 1368 | CAGGTGCAGTTGCAGGAGTCTGGCGGTGGGTCCGTCCAGGCTGGCGGTTCCCTT<br>CGCCTGTCTTGCCGTGCCTCAGGCAGTACCTACAGCAACTACTGTCTCGGTTGG<br>TTCCGCCAGTCCACGGGCAAGGAGCGCGAAGGTGTGGCTGTTATCAACTGGGTG<br>GGAGGTATGCTGTACTTTGCCGACTCCGTTAAGGGGCGCTTTACCGTGAGCCAA<br>GACCACGCGAAAAACACGGTAACTTTGCAGATGAACTCTCTTAAACCCGAAGAT<br>ACCGCTATGTATTACTGCGCGGCAGAGTCTGTGTCTTCCTTCTCCTGTGGCGGA<br>TGGCTGACCAGGCCTGGGCGCGTCCCGTACTGGGGTCAGGGCACTCAGGTGACA<br>GTCAGCTCCGGCGGAAGCGGTGCTCCGGTGGCAGTGGGCAAGTGCAACTCCAG<br>GAGTCAGGAGGTGGGAGCGTTCAAGCGGGCGGTAGTCTTCGGCTGAGTTGTGCT<br>GCGAGTGGCTATCCGTACTCCAACGGCTATATGGGTTGGTTCGCCAGGCCCCT<br>GGCAAGGAGCGGGAGGGCGTGGCCACTATCTACACCGGCGATGGCCGTACCTAT<br>TACGCCGACTCCGTGAAGGGACGGTTTACCATCTCACGCGACAACGCGAAGAAC<br>ACAGTTGACCTCCAGATGTCCTCACTGAAGCCAGAGGATACTGCCATGTATTAC<br>TGTGCTGCCCGCGCAGCCCCTCTGTACTCTAGTGGTTCCCCTCTCACAAGAGCC<br>AGATACAACGTCTGGGGACAAGGCACACAGGTGACTGTGAGTTCC |
| hIL27Ra_<br>VH<br>H11-<br>DR594 | 1369 | CAGGTACAGCTCCAGGAGTCAGGTGGCGGTTCCGTCCAGGCAGGAGGTAGTTTG<br>CGTCTGTCCTGTCGTGCCAGCGGATCTACCTACTCTAACTACTGCCTGGGATGG<br>TTCCGCCAGTCTACCGGCAAGGAGAGAGAGGGGGTTGCTGTTATCAACTGGGTC<br>GGCGGGATGCTCTATTTCGCCGACTCTGTGAAAGGCCGCTTTACTGTGTCCCAG<br>GATCACGCTAAGAACACCGTAACGCTCCAGATGAACAGCCTGAAGCCTGAAGAC<br>ACAGCCATGTATTACTGTGCCGCTGAGAGCGTGTCCAGCTTCTCTTGTGGCGGA<br>TGGCTCACCCGCCCGGTCGTGTGCCCTACTGGGGGCAGGGAACCCAGGTCACA<br>GTAAGCTCCGGCGGTGGCAGCCAGGTGCAGTTGCAGGAGTCTGGTGGCGGGTCT<br>GTTCAGGCGGGAGGCTCCCTGAGACTTAGCTGTGTTGCGTCCGCATCCACCTAC<br>TGCACTTACGATATGCACTGGTATCGCCAGGCTCCTGGCAAGGGCCGTGAGTTC<br>GTGTCCGCTATTGATTCCGACGGCACCACTCGCTATGCCGATAGTGTCAAGGGG<br>AGGTTTACCATCTCCCAAGGTACAGCGAAAAATACAGTTTACCTCCAGATGAAC<br>AGCTTGCAGCCCGAGGACACGGCTATGTATTACTGTAAGACGGTGTGCGTCGTG<br>GGCAGTCGGTGGTCCGATTACTGGGGCCAGGGGACCCAGGTTACTGTCTCCAGC |
| hIL27Ra_<br>VH<br>H11-<br>DR594 | 1370 | CAGGTACAGCTTCAGGAGTCCGGCGGTGGCTCTGTCCAGGCTGGCGGTTCCCTC<br>AGGCTGTCTTGCAGGGCTTCTGGTTCCACCTACAGCAACTACTGTTTGGGATGG<br>TTCCGCCAGTCCACAGGTAAGGAGCGCGAGGGAGTGGCGGTCATCAACTGGGTA<br>GGAGGCATGTTGTACTTCGCCGACTCTGTGAAAGGCAGATTCACTGTCAGCCAG<br>GACCATGCCAAGAACACAGTCACTTTGCAGATGAACTCTCTGAAACCAGAGGAC<br>ACTGCTATGTATTACTGTGCTGCCGAGTCAGTCAGCTCCTTCTCCTGCGGAGGG<br>TGGCTCACCAGACCTGGCCGCGTGCCGTACTGGGGCCAGGGGACGCAGGTGACC<br>GTGTCCAGTGGCGGGAGCGGAGGTTCTGGTGGCTCAGGCAGGTTCAACTGCAA<br>GAGTCCGGTGGAGGTTCTGTGCAGGCCGGTGGCTCCCTGCGTCTCTCCTGCGTG<br>GCCTCTGCCTCCACTTACTGTACCTATGATATGCACTGGTATCGCCAGGCCCCA<br>GGCAAGGGCCGTGAGTTTGTGAGCGCCATTGACAGTGATGGCACCACTAGGTAT<br>GCCGATTCCGTGAAGGGTCGCTTCACCATCAGTCAGGGCACTGCCAAGAACACT<br>GTGTATCTCCAGATGAACAGCTTGCAGCCCGAGGACACCGCCATGTATTACTGC<br>AAGACCGTCTGCGTCGTGGGAAGCCGCTGGAGCGACTATTGGGGCCAGGGGACC<br>CAGGTGACCGTCTCATCC |
| hIL27Ra_<br>VH<br>H11-<br>DR595 | 1371 | CAGGTGCAACTGCAAGAGTCCGGCGGAGGCTCCGTTCAGGCTGGCGGGTCTCTG<br>CGGCTCTCCTGCCGCGCCAGCGGCTCTACTTATAGCAACTACTGCCTGGGATGG<br>TTCAGACAGAGTACAGGTAAGGAGAGGGAGGGAGTCGCTGTTATCAACTGGGTT<br>GGCGGTATGCTCTATTTCGCGGACTCCGTGAAGGGCCGGTTCACCGTGAGCCAG<br>GACCACGCCAAGAACACCGTGACACTCCAGATGAACAGCCTTAAACCTGAGGAC<br>ACCGCTATGTACTATTGCGCAGCCGAAAGTGTTAGCTCTTTTTCCTGTGGTGGC<br>TGGCTGACTCGCCCTGGGCGCGTTCCATATTGGGTCAGGGCACCCAGGTGACG<br>GTTTCATCCGGCGGAGGCAGTCAAGTGCAGCTTCAGGAATCCGGCGGGGGATCT<br>GTGCAGGCTGGGGGCAGTCTGACCCTGTCCTGTGCTGCCAGCGAGTACGCCTAC<br>TCCACTTGCAATATGGGATGGTATCGCCAGGCACCGGGAAGGAGCGTGAGCTG<br>GTCAGTGCATTTATCAGCGATGCCTCCACCTATTACGCCGATTCTGTTAAGGGC<br>CGCTTCACCATCACCCGCGACAACGCCAAAAACACCGTATATTTGCAGATGAAT<br>AGCTTGAAGCCCGAAGATACTGCCATTTATTACTGCTCTGCTAATTGCTACAGA<br>CGCTGCGCAACTATTGGGGCCAAGGCACACAGGTGACAGTAAGCTCC |
| hIL27Ra_<br>VH<br>H11-<br>DR595 | 1372 | CAGGTGCAGCTCCAGGAATCTGGCGGTGGGAGCGTCCAGGCGGGCGGGAGCCTC<br>CGCTTGAGCTGCCGCGCTAGTGGTAGCACCTACAGTAACTACTGCCTCGGCTGG<br>TTCAGGCAGTCCACCGGCAAGGAGCGCGAAGGCGTTGCCGTCATTAACTGGGTT<br>GGAGGTATGCTGTACTTTGCCGACAGCGTAAAGGGTCGTTTTACGGTAAGTCAA<br>GATCATGCTAAGAACACTGTGACATTGCAGATGAACAGCCTGAAGCCGGAGGAT<br>ACTGCCATGTATTACTGCGCGGCTGAGTCTGTAAGCTCTTTCTCATGCGGTGGA<br>TGGCTCACCCGTCCGGGTCGCGTTCCGTACTGGGGTCAGGGCACGCAAGTTACC |

TABLE 1B-continued

| Name | SEQ ID NO: | Sequence |
|---|---|---|
| | | GTTTCTAGCGGAGGCAGTGGGGGCTCTGGGGGTTCCGGCCAGGTCCAGCTTCAG<br>GAGTCTGGCCGGTGGCTCCGTTCAAGCCGGTGGCTCTCTGACACTGTCCTGTGCC<br>GCTTCTGAGTATGCGTACAGCACTTGCAACATGGGATGGTATCGCCAGGCCCCC<br>GGAAAAGAGCGCGAGCTGGTTTCCGCATTTATTTCCGACGGCAGCACCTATTAC<br>GCCGATTCCGTGAAGGGAAGGTTCACTATTACCCGCGACAACGCAAAGAATACC<br>GTCTACTTGCAGATGAACTCCCTGAAGCCCGAGGACACCGCTATCTACTATTGC<br>TCCGCAAATTGCTACCGGCGTCTCCGCAACTACTGGGGCCAGGGTACGCAGGTG<br>ACAGTCAGCTCC |
| hIL27Ra_<br>VH<br>H11-<br>DR596 | 1373 | CAGGTCCAGCTTCAGGAGAGCGGCGGTGGCTCCGTCCAGGCCGGAGGCTCTCTG<br>CGCTTGTCCTGCCGTGCCTCCGGTTCCACATACAGCAACTACTGTCTGGGGTGG<br>TTCCGTCAGAGCACTGGGAAGGAGAGAGAGGGCGTGGCTGTCATCAACTGGGTT<br>GGCGGGATGCTGTACTTTGCGGATTCAGTCAAGGGAAGGTTCACTGTTAGCCAG<br>GACCACGCTAAGAACACCGTAACTCTCCAGATGAACTCCCTGAAGCCCGAGGAT<br>ACAGCCATGTATTACTGTGCTGCCGAGTCCGTGTCCAGCTTCTCCTGTGGTGGC<br>TGGCTCACTCGCCCAGGGAGAGTCCCATACTGGGGACAGGGGACCCAGGTCACA<br>GTGAGTTCCGGCGGAGGCTCTCAGGTGCAGCTGCAAGAGTCTGGCGGAGGTCTT<br>GTGCAGCCTGGCGGTTCCCTGCGTCTGAGTTGTACCGCATCTGGTCTCACTTTT<br>GACGATAGCGTCATGGGATGGTTCCGCCAGGCACCGGGGAAAGGCCGCGAGGCC<br>GTCTCCTGTATTAGTTCCTCTGGTGCCAACGCTTTCTACGCTGATTCCGTGAAA<br>GGACGGTTTACCATCTCCCGCGATAACGCCAAAAACACCCTGTATCTCCAGATG<br>AACTCTCTGAAGCCAGAGGACACTGCGACCTATTACTGTAAACGCGGTCATGCT<br>TGTGCCGGATATTACCCCATCCCCTATGACGATTACTGGGGACAGGGCACCCAA<br>GTTACCGTGTCTAGT |
| hIL27Ra_<br>VH<br>H11-<br>DR596 | 1374 | CAGGTGCAGCTCCAGGAAAGCGGAGGGGGCTCAGTCCAGGCCGGAGGCTCTCTG<br>AGACTCTCTTGCCGTGCATCCGGCAGCACTTATTCCAACTATTGTCTGGGCTGG<br>TTTAGGCAGAGCACAGGCAAGGAGCGCGAAGGTGTCGCAGTGATTAACTGGGTC<br>GGCGGGATGTTGTACTTCGCCGATAGCGTCAAGGGGCGGTTTACAGTGTCCCAG<br>GACCACGCCAAGAACACCGTGACCCTTCAGATGAATAGCCTGAAGCCCGAAGAT<br>ACAGCAATGTATTACTGTGCGGCTGAGTCCGTGTCTTCCTTCAGCTGCGGGGGC<br>TGGCTGACCAGACCTGGCCGCGTTCCGTACTGGGGACAGGGAACTCAGGTGACC<br>GTTTCCTCTGGCGGATCAGGAGGCTCCGGCGGTTCTGGCCAGGTGCAGTTGCAG<br>GAGTCTGGTGGAGGCCTGGTACAACCCGGCGGTTCTTTGCGCCTCTCATGCACT<br>GCGAGCGGTCTTACATTTGATGACTCTGTAATGGGCTGGTTCCGTCAGGCTCCT<br>GGCAAGGGACGTGAGGCCGTGAGCTGCATTTCCAGCTCCGGCGCGAATGCCTTT<br>TACGCTGATTCCGTGAAGGGAAGATTCACCATTAGTAGAGACAACGCTAAGAAC<br>ACCCTGTATTTGCAGATGAACTCTCTGAAACCTGAGGATACAGCTACCTATTAC<br>TGCAAGCGCGGTCACGCTTGTGCTGGCTATTACCCGATCCCTTACGATGACTAC<br>TGGGGACAGGGCACCCAAGTGACAGTCTCTTCC |
| hIL27Ra_<br>VH<br>H12-<br>DR591 | 1375 | CAGGTGCAGCTTCAGGAGTCCGGCGGTGGCTCCGTGCAGGCGGGCGAATCCCTT<br>CGTCTGAGCTGCCGCGCTTCTGGCTCCACCTACTCTAACTATTGTCTGGGCTGG<br>TTTCGTCAGATCACCGGCAAAGAGCGCGAGGGAGTGGCCGTTATAAATTGGGTA<br>GGCGGTATGCTGTACTTTGCTGACTCCGTGAAGGGGCGGTTCACAGTTTCCCAG<br>GATCAGGCAAAGAATACTGTTTATCTGGAAATGAACTCCCTGAAGCCTGAGGAC<br>ACTGCTATGTATTACTGCGCCACCGAGTCCGTGTCCAGCTTTTCATGTGGCGGT<br>TGGCTGACCCGCCCTGATCGGGTCCCTTACTGGGGTCAGGGGACACAGGTAACA<br>GTGTCCAGTGGTGGCGGGTCCCAGGTGCAACTCCAGGAATCTGGGGGCGGTTCC<br>GTTCAGGCTGGCGGGTCCCTTCGCCTGTCCTGCACCGCGTCCGGTGCTATCGCT<br>TCAGGTTATATCGACTCCCGTTGGTGTATGGCTTGGTTTAGACAAGCTCCTGGC<br>AAAGAACGCGAGGGCGTCGCTGCCATCTGGCCAGGAGCGGTCTTACCGTCTAC<br>GCCGACAGCGTGAAGGGCCGGTTTACCATCTCACGTGACCACGCCAAGAACACA<br>CTGTACCTCCAGATGAATAACCTGAAGCCGGAAGATACGGCCATGTATTACTGT<br>GCAGCCGGAAGCCCCCGCATGTGCCCATCTCTTGAGTTCGGGTTTGACTATTGG<br>GGACAGGGAACCCAAGTCACTGTGTCCTCT |
| hIL27Ra_<br>VH<br>H12-<br>DR591 | 1376 | CAGGTCCAGCTCCAGGAGTCAGGAGGGGGCAGCGTACAGGCCGGAGAGTCCCTG<br>AGACTTAGTTGCCGCGCCAGCGGATCTACCTACTCTAACTACTGCCTCGGCTGG<br>TTCAGGCAGATCACCGGCAAGGAGAGAGAGGGTGTGGCCGTAATCAACTGGGTT<br>GGGGGAATGCTGTACTTCGCCGACTCCGTGAAGGGTAGGTTCACTGTTTCTCAG<br>GACCAGGCAAAGAATACTGTGTATCTGGAGATGAACTCCCTGAAACCCGAAGAT<br>ACTGCCATGTATTACTGTGCCACCGAGAGCGTGTCCTCTTTCTCCTGTGGAGGC<br>TGGCTCACGCGCCCTGATCGCGTGCCCTATTGGGGACAGGGTACTCAAGTCACC<br>GTGTCAAGCGGAGGCAGCGGGGGCTCTGGAGGCAGCGGTCAGGTCCAGCTGCAA<br>GAGAGCGGTGGAGGTTCAGTACAGGCTGGCGGGTCACTGCGTCTGAGTTGTACT<br>GCCAGTGGAGCCATCGCGTCTGGCTACATCGACTCTAGGTGGTGCATGGCCTGG<br>TTCCGGCAGGCTCCTGGGAAGGAGAGAGAGGGAGTGGCCGCGATTTGGCCAGGT<br>GGGGGCCTGACCGTCTACGCCGATAGCGTCAAGGGGCGGTTCACCATCAGCCGC<br>GATACGCTAAAAATACCCTGTACCTTCAGATGAATAACCTGAAGCCAGAAGAC<br>ACAGCTATGTACTATTGTGCCGCTGGGTCTCCCCGGATGTGTCCAAGTCTGGAA<br>TTTGGCTTCGACTACTGGGGCAGGGCACACAGGTTACTGTGAGTTCC |
| hIL27Ra_<br>VH<br>H12-<br>DR592 | 1377 | CAGGTCCAGTTGCAGGAGTCCGGCGGTGGCTCCGTGCAGGCCGGTGAGTCTCTG<br>AGACTGTCTTGCCGCGCTAGTGGGTCCACATACAGTAACTACTGCCTGGGCTGG<br>TTCCGCCAGATCACTGGTAAGGAAAGGGAAGGCGTTGCTGTTATCAACTGGGTG<br>GGCGGTATGCTGTACTTCGCTGACTCCGTCAAGGGGCCGCTTCACCGTCTCTCAG |

TABLE 1B-continued

| Name | SEQ ID NO: | Sequence |
|---|---|---|
| | | GATCAGGCTAAGAATACAGTCTATCTGGAAATGAACAGCCTGAAGCCCGAAGAT<br>ACTGCTATGTACTATTGTGCTACCGAGTCTGTCTCTAGCTTTTCTTGCGGAGGC<br>TGGCTGACCCGCCCGGACAGGGTCCCTTACTGGGGCCAGGGCACTCAGGTGACC<br>GTATCTAGCGGTGGCGGTTCACAGGTGCAACTCCAGGAGAGCGGTGGCGGATCT<br>GTGCAGGCCGGAGGCAGCCTTCGCTTGAGCTGCACGGCCCCCGGCTTTACCAGT<br>AACAGCTGTGGCATGGACTGGTATCGCCAGGCCCCCGGAAAGGAGCGCGAGTTC<br>GTCAGCTCCATCTCCACTGACGGAACTACCGGATATGCTGACTCTGTCAAAGGT<br>CGCTTCACCATCTCTAAGGATAAGGCAAAGGACACAGTCTATCTGCAAATGAAC<br>AGTCTCAAGCCAGAGGACACAGGTATGTACTCCTGCAAGACCAAGGATGGCACT<br>ATTGCCACAATGGAACTTTGTGATTTCGGCTACTGGGGACAGGGCACCCAAGTT<br>ACTGTTTCTAGC |
| hIL27Ra_<br>VH<br>H12-<br>DR592 | 1378 | CAGGTGCAACTTCAGGAATCAGGGGGTGGCTCCGTGCAGGCTGGTGAGTCACTG<br>CGTCTTTCTTGCAGGGCTCTGGGTCCACCTACTCCAACTACTGCCTGGGTTGG<br>TTCAGGCAGATCACCGGCAAGGAGAGAGAGGGCGTGGCCGTTATAAATTGGGTA<br>GGAGGTATGCTGTACTTCGCCGACAGCGTCAAGGGACGCTTCACTGTCAGTCAG<br>GATCAGGCCAAGAACACTGTGTACCTTGAGATGAACTCTCTGAAGCCTGAAGAC<br>ACAGCCATGTATTACTGTGCCACAGAGAGTGTCTCTAGCTGCAGCTGCGGTGGA<br>TGGCTGACCCGTCCTGACCGCGTTCCCTACTGGGGCCAGGGCACTCAGGTTACT<br>GTGTCTAGCGGAGGGAGCGGAGGGTCAGGTGGCTCTGGCCAGGTCCAGTTGCAG<br>GAGTCTGGTGGGGGCTCTGTGCAAGCTGGCGGGTCTCTGAGACTGTCCTGTACC<br>GCACCCGGCTTCACATCCAATAGCTGCGGCATGGACTGGTATAGACAAGCGCCT<br>GGGAAGGAGCGCGAGTTTGTTAGCTCCATCAGCACAGACGGCACAACGGGCTAT<br>GCCGACTCTGTGAAAGGGCGCTTTACCATTTCTAAGGACAAGGCCAAGGACACC<br>GTCTATCTCCAGATGAACAGCCTGAAGCCTGAGGACACAGGCATGTATAGCTGC<br>AAAAACGAAGGACGGGACCATCGCAACGATGGAGCTGTGTGACTTTGGGTACTGG<br>GGGCAGGGCACCCAGGTTACCGTCTCTTCC |
| hIL27Ra_<br>VH<br>H12-<br>DR593 | 1379 | CAGGTGCAACTCCAGGAGAGCGGTGGAGGTAGCGTGCAAGCTGGTGAGAGTCTG<br>CGCCTCAGCTGCCGCGCTTCCGGCTCAACTTACAGCAATTACTGCCTGGGTTGG<br>TTCCGTCAGATCACCGGAAAGGAGAGAGAGGGGGTAGCAGTCATCAACTGGGTC<br>GGCGGAATGCTCTATTTTGCCGACTCCGTTAAAGGACGCTTCACCGTGTCTCAA<br>GACCAGGCTAAGAACACAGTGTATCTGGAGATGAACTCTCTCAAGCCAGAGGAT<br>ACCGCCATGTACTATTGCGCCACTGAATCCGTGTCTTCCTTCTCATGTGGCGGG<br>TGGCTCACTCGTCCTGATCGGGTGCCATACTGGGGCAGGGCACCCAGGTCACC<br>GTCTCTAGTGGTGGAGGCAGCCAGGTCCAGTTGCAGGAGTCTGGGGGCGGTTCT<br>GTCCAAGCTGGTGGCTCACTCCGTCTGTCCTGCGCCGCGAGCGGGTATCCATAC<br>TCAAATGGCTACATGGGATGGTTCCGTCAGGCTCCAGGAAAGGAGCGTGAGGGG<br>GTCGCGACCATTTATACCGGCGACGGACGCACCTACTATGCCGACTCCGTGAAG<br>GGGAGGTTTACCATCAGTCGCGATAACGCCAAGAACACCGTGGATCTCCAGATG<br>AGTTCCCTGAAGCCTGAAGCACACCGCTATGTATTACTGCGCGGCACGTGCCGCA<br>CCGCTTTACAGTAGCGGCAGTCCCTGACCCGCGCGAGGTATAACGTGTGGGGC<br>CAGGGCACCCAGGTTACAGTGTCTTCT |
| hIL27Ra_<br>VH<br>H12-<br>DR593 | 1380 | CAGGTGCAGCTCCAGGAGTCTGGGGGCGGTTCTGTCCAAGCTGGCGAGAGCCTG<br>CGCCTGTCCTGCCGGGCTTCCGGTTCCACCTATTCTAACTATTGTCTGGGTTGG<br>TTTCGCCAGATCACTGGAAAGGAGAGGGAGGGGTGTGGCAGTTGCAGTCTGGGTG<br>GGTGGGATGCTCTATTTCGCCGATTCAGTTAAGGGACGCTTCACAGTGAGCCAA<br>GACCAGGCTAAGAACACAGTCTACCTGGAGATGAACAGCCTGAAACCGGAAGAC<br>ACGGCAATGTATTACTGCGCGACCGAGAGCGTGTCTAGTTTTAGCTGTGGGGGC<br>TGGCTGACGAGACCCGACAGGGTGCCTTACTGGGGCAGGGTACTCAGGTTACC<br>GTCTCTTCCGGTGGCAGTGGTGGCAGCGGAGGCAGCGGCCAGGTCAGCTGCAA<br>GAATCTGGCGGTGGCAGCGTTCAGGCGGGAGGTTCCCTTCGCCTGTCTTGTGCT<br>GCATCCGGCTACCCTTACTCTAACGGTTACATGGGCTGGTTTCGTCAAGCCCCC<br>GGCAAGGAACGTGAGGGGGTGGCGACAATTTATACAGGTGATGGCCGCACTTAT<br>TACGCTGACTCCGTTAAGGGACGCTTCACCATCTCCCGCGATAACGCCAAGAAT<br>ACGGTGGACCTCCAGATGTCCTCTCTCAAACCTGAGGACACCGCAATGTACTAT<br>TGCGCCGCTCGCGCCGCGCCGCTCTACAGTAGCGGCAGCCCACTGACTCGCGCC<br>CGCTACAATGTGTGGGGACAGGGAACCCAGGTGACCGTGAGCAGT |
| hIL27Ra_<br>VH<br>H12-<br>DR594 | 1381 | CAAGTGCAGCTCCAAGAGTCCGGTGGAGGCTCCGTGCAGGCTGGCGAGTCCCTG<br>CGTCTGTCCTGCCGCGCGTCTGGTAGTACTTACTCTAACTATTGTCTCGGTTGG<br>TTCAGGCAGATCACCGGCAAAGAGCGCGAAGGAGTTGCCGTTATCAACTGGGTG<br>GGCGGTATGCTCTATTTCGCCGACAGCGTGAAAGGGAGATTCACTGTGAGCCAG<br>GACCAAGCTAAGAACACAGTGTATCTTGAGATGAACAGCCTCAAGCCTGAGGAC<br>ACCGCTATGTATTACTGTGCCACAGAATCTGTGTCTTCCTTCTCATGGGGGGT<br>TGGCTCACCAGGCCGGACAGGGTCCCATACTGGGGCCAGGGCACCCAGGTGACC<br>GTGTCTAGCGGAGGTGGCAGCCAGGTGCAGTTGCAGGAGTCCGGTGGGGCTCC<br>GTGCAGGCTGGAGGCTCACTTCGGCTCAGCTGCGTGGCCTCAGCGTCTACCTAC<br>TGCACATACGATATGCACTGGTATCGTCAAGCACCCGGCAAAGGCCGCGAGTTC<br>GTCAGCGCCATTGATTCGACGGTACAACCCGTTACGCTGACTCCGTCAAGGGG<br>CGTTTTACCATTTCCCAGGGGACCGCTAAGAACACCGTTTATCTTCAGATGAAC<br>AGCCTCCAGCCGGAAGACACAGCCATGTATTACTGTAAAACCGTGTGCGTAGTG<br>GGCTCCAGATGGTCAGACTATTGGGGGCAGGGCACCCAGGTAACCGTGTCCTCT |

TABLE 1B-continued

| Name | SEQ ID NO: | Sequence |
|---|---|---|
| hIL27Ra_VH H12-DR594 | 1382 | CAGGTTCAGCTTCAGGAATCAGGAGGTGGCTCAGTGCAGGCAGGAGAGTCTCTC<br>CGCCTGTCCTGTCGTGCCAGCGGATCTACGTATTCCAACTACTGCCTCGGTTGG<br>TTCAGGCAGATCACCGGCAAAGAGCGCGAAGGAGTGGCGGTTATCAACTGGGTT<br>GGCGGAATGCTGTACTTCGCAGACAGTGTCAAGGGCAGATTCACTGTGTCCCAG<br>GACCAGGCCAAAAACACAGTGTACCTGGAGATGAATAGTTTGAAGCCGGAAGAT<br>ACAGCCATGTATTACTGCGCCACCGAGTCTGTCTCCAGCTTTTCTTGCGGAGGC<br>TGGCTGACCCGCCCAGACCGCGTCCCCTACTGGGGCCAGGGAACTCAAGTCACC<br>GTGTCTTCCGGTGGGAGTGGTGGCAGCGGGGGCTCCGGCCAGGTGCAGTTGCAG<br>GAGTCCGGTGGCGGAAGTGTCCAGGCCGGGGGCTCCTTGAGACTTTCATGCGTC<br>GCCTCTGCCTCCACCTACTGCACTTACGACATGCACTGGTATCGCCAGGCTCCG<br>GGTAAGGGACGGGAGTTCGTATCTGCCATCGACTCCGACGGGACCACACGCTAC<br>GCGGACAGCGTGAAAGGCAGGTTCACCATCAGTCAGGGGACCGCCAAGAATACG<br>GTTTACCTCCAGATGAACTCTCTTCAGCCGGAGGACACGGCTATGTATTACTGC<br>AAAACTGTGTGCGTGGTTGGAAGCAGATGGTCTGATTACTGGGGTCAGGGCACC<br>CAGGTGACTGTATCAAGC |
| hIL27Ra_VH H12-DR595 | 1383 | CAAGTGCAGCTGCAAGAAAGTGGCGGTGGCAGTGTGCAAGCTGGAGAGTCCCTC<br>AGACTGAGTTGTAGAGCCAGTGGTAGCACATATAGCAATTACTGCCTGGGTTGG<br>TTTCGTCAGATCACCGGCAAGGAGAGAAGGCGTGGCCGTCATAAATTGGGTC<br>GGCGGTATGCTGTACTTTGCAGATTCCGTCAAGGGCCGCTTTACGGTCAGCCAA<br>GATCAGGCCAAGAATACTGTGTATCTGGAAATGAACAGTCTGAAACCGGAGGAC<br>ACCGCTATGTATTACTGCGCTACTGAATCCGTCTCCTCTTTTAGTTGCGGTGGG<br>TGGCTCACCAGACCGGATCGCGTGCCCTATTGGGGCCAGGGCACCCAGGTGACG<br>GTGTCCTCAGGAGGCGGATCACAGGTGCAGCTCCAGGAGAGCGGGGGCGGGAGT<br>GTGCAGGCCGGTGGCAGCCTGACCTTGTCATGTGCGGCTAGTGAGTACGCCTAT<br>TCTACCTGTAATATGGGCTGGTATCGCCAGGCACCCGGAAAAGAGCGCGAGCTG<br>GTGTCCGCGTTCATTAGCGATGGGTCTACCTATTACGCCGATTCCGTGAAGGGC<br>AGGTTCACCATCACACGCGACAACGCTAAGAACACCGTATACCTCCAGATGAAC<br>AGCCTGAAGCCAGAAGCACGGCCATCTATTACTGCTCTGCTAATTGCTACCGC<br>AGGCTGCGCAACTACTGGGGACAGGGCACTCAGGTGACTGTGTCTAGT |
| hIL27Ra_VH H12-DR595 | 1384 | CAGGTGCAACTTCAGGAGTCCGGTGGCGGTAGTGTGCAGGCTGGCGAGTCTCTG<br>CGTCTGTCTTGCCGCGCGTCCGGCTCCACCTACTCCAACTACTGCCTGGGTTGG<br>TTCCGCCAGATTACCGGCAAAGAAAGGGAGGGCGTTGCGGTTATTAACTGGGTG<br>GGCGGGATGCTGTACTTCGCAGATTCTGTGAAGGGTAGGTTTACAGTCTCACAG<br>GACCAGGCTAAGAACACGGTGTACCTGGAAATGAACAGTCTCAAGCCCGAAGAC<br>ACCGCCATGTATTACTGCGCTACAGAGTCTGTTTCCTCTTTTAGCTGCGGTGGG<br>TGGCTGACCCGCCCTGACCGTGTGCCTTACTGGGGACAGGGGACCCAGGTCACT<br>GTAAGCTCTGGAGGGTCCGGTGGCTCCGGCGGGAGCGGCCAGGTACAGCTCCAG<br>GAGTCCGGCGGGGAAGTGTGCAGGCCGGAGGCAGCCTCACCCTGAGCTGCGCG<br>GCATCCGAGTACGCCTATTCTACCTGTAACATGGGTGGTACAGGCAGGCTCCG<br>GGCAAGGAGAGAGTTGGTTTCTGCTTTTATCAGTGATGGCAGTACCTATTAC<br>GCCGATTCCGTGAAAGGGAGATTCACCATTACACGTGACAACGCTAAGAACACC<br>GTTTATTTGCAGATGAACTCCCTCAAGCCCGAGGATACAGCCATTTACTATTGC<br>TCTGCCAACTGCTATCGTCGCCTGCGCAACTACTGGGGACAGGGGACACAGGTG<br>ACCGTGTCCAGT |
| hIL27Ra_VH H12-DR596 | 1385 | CAGGTCCAGCTCCAGGAGTCCGGGGGTGGCTCCGTGCAGGCTGGCGAATCTTTG<br>CGCCTCTCATGCAGAGCTTCCGGCTCCACCTATAGCAACTATTGTCTGGGTTGG<br>TTTCGCCAGATCACCGGCAAAGAGCGTGAAGGCGTCGCCGTCATCAACTGGGTC<br>GGCGGGATGCTGTACTTTGCGGACTCTGTTAAGGGTCGTTTCACAGTCAGTCAG<br>GATCAAGCGAAGAACACCGTGTACCTGGAGATGAACTCCCTGAAGCCGGAGGAC<br>ACCGCAATGTATTACTGTGCCACTGAATCTGTGAGCAGTTTTAGCTGTGGCGGT<br>TGGCTGACCCGCCCTGACCGCGTTCCCTACTGGGGCAGGGCACCCAAGTAACC<br>GTGTCTTCCGGGGGCGGGTCTCAGGTCCAGCTCCAGGAGTCTGGAGGGGGCCTT<br>GTCCAGCCCGGAGGCAGCCTGCGCCTGTCTTGCACGGCTAGTGGCCTGACATTC<br>GACGATAGCGTGATGGGCTGGTTCAGACAGGCTCCGGGGAAGGGCCGTGAGGCC<br>GTTTCTTGTATCTCTAGCTCTGGTGCTAACGCCTTCTATGCCGACTCCGTGAAG<br>GGCCGCTTCACAATCAGCCGTGACAACGCCAAGAACACGCTGTATCTTCAGATG<br>AACTCCCTGAAGCTGAGGATACCGCCACATATTACTGTAAGCGCGGTCACGCC<br>TGTGCAGGCTATTACCCCATCCCCTACGATGACTACTGGGGTCAGGGAACCCAG<br>GTTACGGTTTCATCT |
| hIL27Ra_VH H12-DR596 | 1386 | CAGGTGCAACTTCAGGAGAGCGGGGGTGGGAGCGTGCAGGCGGGCGAGAGCCTG<br>CGCCTGTCCTGCCGTGCGTCTGGCTCCACCTACAGTAACTACTGCCTCGGGTGG<br>TTTCGCCAGATTACGGGCAAGGAGCGCGAAGGTGTGGCCGTTATCAACTGGGTG<br>GGTGGAATGCTCTACTTTGCCGATTCTGTGAAAGGACGCTTTACCGTGTCTCAG<br>GATCAGGCTAAGAATACAGTTTACCTGGAGATGAACTCTCTCAAGCCTGAGGAT<br>ACAGCCGATGTACTATTGTGCAACCGAGTCCGTCTCTTCCTTCAGCTGCGGCGGG<br>TGGCTGACCCGTCCTGACCGCGTGCCATACTGGGGTCAAGGTACACAGGTGACA<br>GTCAGCTCTGGTGGCAGCGGCGGTAGCGGGGGCAGTGGCCAGGTCCAGTTGCAG<br>GAAAGTGGAGGCGGTCTGGTTCAACCTGGGGGCTCCCTGCGCCTGTCTTGCACA<br>GCCTCTGGACTGACGTTTGATGACTCCGTGATGGGCTGGTTCAGACAGGCTCCT<br>GGTAAGGGCCGCGAGGCCGTCAGCTGTATCAGTAGCTCCGGGGCCAACGCTTTC<br>TATGCAGACTCTGTCAAAGGCAGATTCACTATCAGCCGCGACAACGCCAAGAAC<br>ACACTGTATTTGCAGATGAACAGCCTGAAACCTGAAGATACTGCTACATACTAT |

TABLE 1B-continued

| Name | SEQ ID NO: | Sequence |
|---|---|---|
| | | TGTAAGCGCGGCCATGCCTGTGCTGGGTATTACCCTATCCCCTACGATGACTAC<br>TGGGGCCAGGGCACGCAGGTTACAGTAAGCAGT |
| hIL27Ra_<br>VH<br>H13-<br>DR591 | 1387 | CAGGTGCAGCTCCAGGAATCCGGTGGCGGGTCCGTGCAGGCTGGCGGTTCCCTC<br>CGTCTGTCCTGTGTGGCCTCCGGGTACGTCAGCTGTGACTACTTTCTGCCATCC<br>TGGTATCGCCAGGCCCCCGGTAAGGAGAGAGAGTTCGTGTCTATCATTGATGGC<br>ACTGGCAGCACTTCTTACGCCGCATCTGTGAAGGGCGCTTCACAGCCTCCCAG<br>GATAGAGGCAAAAACATTGCCTACCTTCAGATGAACTCTTTGAAACCCGAGGAT<br>ACTGCCATGTATTACTGCAAAGCGAGCTGTGTCCGGGGCCGCACCATCTCCGAA<br>TACTGGGGACAGGGAACCCAGGTCACGGTCTCCTCTGGTGGCGGGTCCCAGGTG<br>CAGCTTCAGGAGAGCGGGGGAGGTTCCGTGCAGGCCGGAGGCTCTCTCAGGCTC<br>AGCTGCACAGCGTCCGGCGCTATTGCCAGCGGATATATCGACAGTCGTTGGTGT<br>ATGGGCCTGGTTTCGCCAGGCTCCGGGCAAGGAGCGTGAGGGAGTCGCTGCCATT<br>TGGCCCGGCGGGGACTGACCGTGTATGCGGACTCTGTGAAAGGAAGATTCACC<br>ATCTCTCGGGATCACGCTAAGAATACCCTGTATCTCCAGATGAATAACCTGAAG<br>CCCGAGGACACCGCCATGTATTACTGCGCCGCAGGATCACCCCGCATGTGTCCG<br>TCTCTGGAGTTCGGTTTCGACTACTGGGGCAAGGCACCCAAGTCACTGTGTCT<br>TCT |
| hIL27Ra_<br>VH<br>H13-<br>DR591 | 1388 | CAGGTGCAACTCCAGGAGTCCGGGGTGGCTCCGTACAGGCTGGAGGCAGCCTC<br>CGTCTCAGTIGTGTTGCCAGCGGCTATGTAAGCTGCGACTATTTCCTGCCTTCT<br>TGGTATCGCCAGGCACCTGGGAAGGAGCGTGAGTTCGTGTCCATCATTGATGGC<br>ACAGGCAGCACCTCCTATGCCGCTTCAGTCAAGGGACGCTTTACAGCCTCCCAG<br>GACCGTGGCAAGAACATCGCCTACCTTCAGATGAACTCCCTGAAGCCTGAGGAC<br>ACAGCCATGTATTACTGTAAGGCTTCCTGTGTGCGTGGCCGGACCATCTCTGAA<br>TACTGGGGACAGGGCACGCAGGTGACGGTCAGCTCTGGGGGTAGTGGCGGGTCC<br>GGCGGGAGTGGACAGGTGCAGCTTCAGGAGAGCGGTGGCGGATCTGTCCAAGCC<br>GGTGGCAGCCTTAGGCTCTCTTGCACTGCCAGCGGGCCATCGCTTCAGGATAT<br>ATTGATAGCCGCTGGTGCATGGCCTGGTTCCGCCAGGCCCCAGGGAAAGAGCGT<br>GAAGGCGTGGCAGCCATCTGGCCGGGTGGCGGTCTGACCGTCTACGCCGACTCT<br>GTTAAAGGAAGATTTACCTTTCCCGCGATCACGCTAAGAACACTCTGTATCTT<br>CAAATGAATAACCTGAAACCTGAAGACACCGCTATGTATTACTGTGCTGCCGGT<br>AGCCCGAGGATGTGCCCAAGCCTTGAGTTCGGCTTCGACTATTGGGGCCAGGGA<br>ACTCAAGTGACCGTGAGCAGC |
| hIL27Ra_<br>VH<br>H13-<br>DR592 | 1389 | CAGGTGCAGCTCCAGGAGTCTGGTGGGGGTTCCGTCCAGGCTGGCGGTTCCCTG<br>AGGCTCTCATGCGTGGCCAGCGGTTACGTGTCTTGCGACTATTTCCTGCCCTCA<br>TGGTATCGTCAGGCCCCTGGCAAGGAGCGCGAGTTCGTGTCAATTATCGACGGC<br>ACAGGCAGTACCAGCTATGCAGCCAGCGTTAAGGGCCGTTTTACCGCCTCACAG<br>GATCGCGGGAAGAATATCGCCTACCTCCAGATGAACAGTCTGAAACCTGAAGAT<br>ACAGCGATGTATTACTGTAAGGCCAGCTGTGTGAGGGGTCGGACGATCTCTGAA<br>TACTGGGGCCAAGGAACCCAAGTAACTGTGTCCAGCGGAGGCGGATCTCAGGTG<br>CAGCTTCAGGAATCCGGCGGTGGCAGCGTCCAGGCCGGAGGGAGCCTGCGTCTT<br>TCCTGCACCGCTCCTGGCTTCACCAGCAACAGTTGCGGGATGGATTGGTATCGT<br>CAGGCTCCCGGCAAGGAACGGGAGTTCGTGTCCAGTATCAGCACTGATGGCACT<br>ACCGGATACGCTGATTCCGTTAAGGGTCGTTTCACCATCTCCAAAGATAAGGCC<br>AAAGACACCGTGTATCTCCAGATGAACTCCCTGAAACCAGAAGACACAGGTATG<br>TATTCTTGTAAGACTAAAGACGGCACCATCGCGACAATGGAGCTGTGTGATTTC<br>GGATACTGGGGTCAGGGAACACAGGTGACTGTGTCCTCT |
| hIL27Ra_<br>VH<br>H13-<br>DR592 | 1390 | CAAGTACAGTTGCAGGAGTCTGGCGGAGGCTCCGTGCAGGCGGGCGGGAGCCTG<br>AGGCTGAGTTGTGTGGCCTCAGGGTATGTGTCCTGTGACTACTTTCTCCCGAGC<br>TGGTATCGCCAGGCTCCAGGGAAGGAGCGTGAGTTCGTGTCTATTATCGACGGG<br>ACTGGATCTACCTCTTATGCCGCATCTGTCAAGGGCGCTTCACCGCCTCTCAG<br>GATCGCGGAAAGAACATCGCCTACTTGCAAATGAACAGCCTGAAGCCCGAGGAC<br>ACTGCCATGTATTACTGTAAAGCCTCTTGTGTGAGAGGCCGCACTATTTCAGAG<br>TACTGGGGACAGGGAACCCAGGTCACTGTCAGCAGTGGAGGTTCTGGCGGTTCT<br>GGTGGGTCAGGACAGGTACAGTTGCAGGAAAGCGGAGGCGGTTCCGTGCAGGCC<br>GGAGGCTCCCTGAGGCTGTCTTGCACAGCTCCTGGTTTCACATCTAACAGTTGC<br>GGCATGGACTGGTATCGCCAGGCCCCAGGGAAGGAGGGAATTTGTGTCTAGC<br>ATCAGCACCGACGGAACCACAGGATACGCCGACTCCGTCAAGGGTCGTTTTACT<br>ATCAGTAAGGACAAGGCTAAGGATACTGTCTACCTGCAAATGAACAGTCTGAAG<br>CCCGAGGACACCGGCATGTATAGCTGTAAGACTAAGGATGAACTATTGCGACT<br>ATGAGCTGTGTGACTTCGGGTATTGGGGCCAGGGTACACAAGTAACTGTGAGT<br>TCT |
| hIL27Ra_<br>VH<br>H13-<br>DR593 | 1391 | CAGGTACAGCTCCAGGAGAGCGGTGGCGGTTCCGTCCAAGCAGGCGGTTCCCTC<br>AGACTGTCATGCGTCGCAAGCGGCTACGTGTCATGTGATTACTTCCTGCCCCTCC<br>TGGTACAGGCAAGCGCCAGGAAGGAAAGGGAGTTTGTCTCCATTATCGACGGC<br>ACCGGAAGCACAAGTTACGCCGCGTCTGTTAAGGGCCGCTTCACCGCTTCTCAA<br>GATCGCGGCAAAAACATCGCCTACCTGCAAATGAACAGCCTCAAACCAGAGGAC<br>ACCGCGATGTATTACTGCAAGGCTTCTGTGTGCGTGGTCGGACGATTTCCGAA<br>TACTGGGGCCAAGGCACCCAGGTGACTGTTTCTAGCGGTGGGGGCAGCCAGGTC<br>CAGTTGCAGGAGAGTGGCGGTGGCAGCGTTCAGGCTGGCGGGAGCCTGAGACTC<br>AGCTGCGCTGCGTCTGGTTACCCCTATTCCAACGGCTATATGGGCTGGTTCAGA<br>CAGGCACCAGGGAAGGAGCGCGAGGGGTGGCACCATCTACACCGGCGATGGC<br>CGCACATATTACGCTGATTCAGTGAAGGGAAGATTCACTATCAGTAGGGACAAC |

TABLE 1B-continued

| Name | SEQ ID NO: | Sequence |
|---|---|---|
| | | GCTAAGAATACCGTGGATCTCCAGATGAGTTCACTGAAGCGGAGGATACCGCG<br>ATGTATTACTGCGCGGCTCGCGCAGCCCCTCTCTACAGTAGCGGCTCCCCTCTT<br>ACGCGGGCTAGATACAACGTGTGGGCCAGGGAACCCAGGTTACTGTGAGCAGT |
| hIL27Ra_<br>VH<br>H13-<br>DR593 | 1392 | CAGGTTCAGCTGCAAGAGTCCGGCGGGGGCTCCGTTCAGGCCGGAGGCTCTCTC<br>AGGCTGAGCTGTGTCGCCTCCGGCTATGTGAGCTGTGACTACTTTCTGCCATCC<br>TGGTATCGCCAGGCCCCTGGCAAGGAACGCGAGTTTGTCTCCATCATTGACGGC<br>ACCGGCTCCACATCCTACGCGGCTTCCGTGAAGGGGCGTTTCACCGCGTCCCAA<br>GATCGCGGGAAGAATATCGCCTACCTCCAAATGAACTCTCTCAAGCCGGAGGAC<br>ACTGCTATGTATTACTGTAAGGCATCCTGTGTTCGCGGGCGGACAATCAGCGAA<br>TACTGGGGCCAGGGCACCCAGGTAACTGTATCCAGCGGAGGCTCTGGAGGTTCT<br>GGTGGCTCCGGGCAGGTCCAGCTCCAGGAGTCTGGCGGTGGCTCCGTGCAGGCT<br>GGTGGCAGCCTTCGTCTGTCTTGCGCTGCCTCTGGTTATCCTTACTCCAATGGC<br>TACATGGGCTGGTTTCGCCAGGCCCCAGGGAAGGAGAGGGAGGGCGTGGCCACT<br>ATCTACACCGGCGATGGCCGCACCTACTATGCTGACAGCGTGAAGGGCAGATTC<br>ACCATCAGCAGGGATAACGCAAAGAACACAGTGGACCTTCAGATGAGTAGCCTG<br>AAGCCAGAGGACACCGCTATGTATTACTGTGCGGCCAGGGCAGCTCCGTTGTAC<br>TCTTCCGGTTCCCCTCTGACCAGAGCGAGATATAATGTGTGGGACAGGGCACC<br>CAGGTTACCGTCAGTTCC |
| hIL27Ra_<br>VH<br>H13-<br>DR594 | 1393 | CAAGTGCAGTTGCAGGAGAGCGGGGGTGGGTCCGTCCAGGCTGGGGGCTCACTG<br>CGTCTGAGCTGTGTGGCCTCTGGTTACGTGTCCTGTGACTATTTCCTGCCTTCT<br>TGGTATAGACAGGCCCCAGGCAAAGAAAGGGAGTTCGTGTCTATTATCGACGGC<br>ACCGGCAGCACTAGCTATGCGGCCAGCGTTAAGGGGCGTTTCACAGCCAGCCAG<br>GATCGCGGCAAGAACATCGCCTATTTGCAGATGAACTCCTTGAAGCCCGAGGAC<br>ACCGCCATGTACTATTGCAAGGCCAGCTGCGTGCGCGGCAGGACCATTTCCGAG<br>TACTGGGGCCAAGGCACTCAGGTGACAGTGTCTTCCGGTGGCGGTAGTCAGGTG<br>CAGTTGCAGGAGTCCGGGGAGGCAGCGTGCAGGCCGGTGGGTCCCTCCGCCTG<br>AGCTGTGTGGCGTCCGCAAGCACCTACTGTACCTATGATATGCACTGGTACAGG<br>CAAGCCCCTGGCAAGGGCCGCGAGTTTGTCTCTGCTATCGACTCAGACGGGACC<br>ACTGCTACGCTGACAGTGTAAAGGGGCGCTTCACTATTAGCCAGGGCACAGCC<br>AAGAACACCGTGTACCTCCAGATGAATAGCCTCCAGCCCGAGGACACTGCCATG<br>TATTACTGCAAGACCGTATGCGTGGTTGGGAGTCGCTGGTCAGATTACTGGGGT<br>CAGGGTACTCAGGTGACCGTCTCCAGC |
| hIL27Ra_<br>VH<br>H13-<br>DR594 | 1394 | CAGGTGCAGTTGCAGGAATCCGGCGGTGGCTCAGTCCAGGCCGGGGGCTCCCTG<br>AGGCTGTCATGCGTCGCCAGCGGATATGTGTCTTGCGACTATTTTCTGCCCTCC<br>TGGTATCGCCAAGCTCCCGGCAAGGAGAGAGAATTTGTTTCTATCATTGACGGG<br>ACAGGTTCCACTTCCTACGCTGCCAGCGTCAAAGGCCGCTTCACGGCCAGCCAG<br>GATAGGGGCAAAAACATCGCCTACCTGCAAATGAACTCTCTCAAGCCCGAGGAC<br>ACTGCCATGTATTACTGTAAAGCCAGCTGTGTGCGCGGTCGCACTATCTCTGAA<br>TATTGGGGCCAGGGCACCCAGGTGACCGTCTCCTCTGGAGGTTCAGGGGGCTCC<br>GGTGGCAGCGGTCAGGTCCAGCTCCAAGAGTCTGGGGGCGGTAGTGTGCAGGCG<br>GGCGGTTCCCTCAGACTCTCCTGCGTGGCCTCCGCCTCTACCTATTGCACCTAC<br>GATATGCACTGGTATCGGCAGGCTCCAGGAAAGGGCCGGGAGTTCGTGAGCGCG<br>ATTGACTCCGATGGCACTACCCGTTATGCCGATTCCGTTAAGGGACGGTTCACA<br>ATTAGCCAGGGAACCGCGAAGAACACCGTGTACCTGCAAATGAACTCTCTCCAG<br>CCCGGAGGATACTGCCATGTATTACTGTAAGACTGTGTGCGTCGTTGGGTCCAGG<br>TGGTCCGATTATTGGGGCCAGGGAACTCAGGTTACCGTGTCCAGC |
| hIL27Ra_<br>VH<br>H13-<br>DR595 | 1395 | CAAGTGCAGCTCCAGGAGTCTGGCGGTGGCTCTGTGCAAGCGGGCGGTTCTCTC<br>AGACTCAGCTGCGTGGCCAGCGGCTACGTGTCCTGCGATTACTTCCTGCCTAGC<br>TGGTATCGTCAGGCCCCCGGCAAGGAACGCGAGTTCGTCAGCATTATCGACGGG<br>ACTGGGGTCAACCTCCTATGCAGCCTCCGTAAAAGGCAGGTTCACCGCCAGTCAG<br>GATCGCGGCAAGAATATCGCGTACCTCCAGATGAACTCTTTGAAACCTGAGGAT<br>ACAGCTATGTATTACTGTAAGGCTAGTTGTGTGCGTGGGCGCACCATCTCCGAA<br>TACTGGGGCCAGGGAACTCAGGTCACTGTTTCAGTGGGGGCGGAAGTCAGGTG<br>CAGTTGCAGGAGTCTGGAGGCGGTTCAGTCCAGGCTGGCGGATCTCTGACGCTC<br>TCTTGTGCAGCCTCTGAGTATGCCTATAGCACCTGCAACATGGGATGGTACAGA<br>CAGGCTCCTGGTAAGGAGCGCGAATTGGTGAGCGCTTTCATCTCTGATGGTTCC<br>ACATATTACGCTGATTCCGTGAAGGGCCGCTTTACGATTACACGCGACAATGCG<br>AAAAACACAGTGTACCTCCAGATGAACTCCCTCAAACCAGAAGACACTGCAATC<br>TACTATTGTTCTGCTAACTGCTATCGCCGTCTGCGCAACTACTGGGGGCAAGGT<br>ACGCAAGTGACCGTCTCCAGC |
| hIL27Ra_<br>VH<br>H13-<br>DR595 | 1396 | CAGGTCCAGCTGCAAGAGAGCGGCGGTGGGTCTGTGCAGGCCGGAGGCAGCCTG<br>CGTCTCAGCTGCGTCGCTTCTGGATATGTCAGCTGTGACTACTTCCTCCCATCT<br>TGGTACAGACAAGCGCCGGGAAGGAACGCGAGTTCGTTAGCATTATCGACGGC<br>ACTGGAAGTACCTCTTATGCCGCTTCCGTTAAAGGACGCTTCACGGCCTCTCAG<br>GATCGCGGCAAGAATATCGCCTACCTTCAGATGAACAGCCTGAAGCCAGAGGAC<br>ACCGCTATGTATTACTGCAAGGCCAGCTGTGTGAGAGGCGCACCATCAGCGAA<br>TACTGGGGCCAGGGCACCCAGGTGACCGTATCTAGTGGCGGAGCGGTGGCTCC<br>GGTGGCAGTGGCCAGGTGCAGCTGCAAGAGAGTGGTGGGGGCAGTGTGCAGGCT<br>GGGGGTTCCCTGACGCTGTCCTGTGCGGCCAGCGAGTATGCTTACTCAACGTGC<br>AATATGGGTTGGTATCGCCAGGCCCCTGGTAAGGAGCGCGAACTCGTCTCTGCA<br>TTTATTAGCGACGGCTCCACTTATTACGCCGACAGCGTGAAGGGGAGATTCACT<br>ATTACCCGCGACAATGCCAAGAACACTGTGTACCTCCAAATGAACTCCCTGAAG |

TABLE 1B-continued

| Name | SEQ ID NO: | Sequence |
|---|---|---|
| | | CCCGAGGACACAGCCATCTATTACTGCTCCGCGAACTGCTATCGCCGTCTGCGT<br>AACTACTGGGGCCAGGGGACCCAGGTCACAGTCTCCTCT |
| hIL27Ra_<br>VH<br>H13-<br>DR596 | 1397 | CAGGTACAGCTCCAGGAGTCCGGCGGTGGCTCTGTGCAGGCAGGAGGCTCACTG<br>CGCTTGAGTTGCGTGGCCAGCGGCTACGTGTCCTGCGACTACTTCCTGCCATCC<br>TGGTATAGGCAGGCTCCGGGTAAGGAAAGGGAGTTCGTCTCCATTATCGACGGT<br>ACTGGCAGCACCTCTTACGCAGCCTCCGTGAAGGGGCGTTTCACCGCCAGCCAG<br>GATCGGGCAAGAACATCGCCTACTTGCAGATGAACTCCCTGAAGCCAGAGGAC<br>ACTGCAATGTATTACTGCAAAGCCAGCTGTGTGAGAGGACGCACCATCTCTGAG<br>TACTGGGGGCAAGGCACACAGGTCACGGTCTCTAGTGGCGGGGGTAGCCAGGTC<br>CAGCTCCAGGAAAGCGGAGGTGGCCTGGTTCAGCGGGAGGGTCACTGAGACTG<br>TCCTGTACCGCCAGCGGGCTGACCTTCGATGACAGCGTCATGGGTTGGTTCCGG<br>CAGGCCCCCGGTAAAGGAAGAGAGGCGGTGAGCTGCATCAGCTCCTCTGGAGCT<br>AACGCCTTCTATGCTGACTCCGTGAAGGGTCGCTTCACCATCTCCAGAGATAAC<br>GCTAAGAATACTCTCTACCTCCAGATGAACTCTCTGAAACCGGAGGACACCGCA<br>ACCTATTACTGCAAGCGCGGGCACGCCTGCGCGGGATACTATCCAATCCCATAC<br>GATGACTACTGGGGTCAGGGAACCCAGGTCACCGTGAGTTCT |
| hIL27Ra_<br>VH<br>H13-<br>DR596 | 1398 | CAGGTGCAGCTCCAGGAGAGCGGCGGTGGCTCTGTCCAGGCAGGCGGTTCCCTG<br>CGCCTCTCTTGCGTGGCGAGTGGCTATGTTAGTTGTGACTACTTCCTGCCCTCA<br>TGGTATCGGCAAGCTCCGGGAAAAGAGCGCGAGTTTGTCTCCATCATTGATGGA<br>ACAGGATCTACGTCCTATGCCGCAAGTGTCAAGGGGCGGTTCACCGTTCTCAG<br>GACAGAGGAAAGAATATCGCTTATCTCCAGATGAACTCCCTGAAGCCAGAAGAC<br>ACCGCTATGTACTATTGCAAGGCTTCTTGTGTGCGCGGCAGAACCATCTCTGAG<br>TACTGGGGCCAGGGCACCCAGGTGACCGTTAGTTCAGGAGGGAGCGGAGGCAGT<br>GGAGGCTCAGGTCAGGTGCAGCTCCAGGAATCTGGCGGAGGTCTGGTCCAGCCA<br>GGTGGGTCCCTGCGCCTCAGCTGTACTGCTCCGGTCTCACCTTCGATGACAGC<br>GTCATGGGCTGGTTCCGCCAAGCGCGGGTAAGGGGCGTGAAGCCGTGAGCTGC<br>ATTTCCTCTAGCGGAGCCAACGCTTTTTACGCCGACAGCGTGAAGGGTAGATTT<br>ACAATCTCTCGCGATAACGCGAAGAACACCCTGTATCTCCAAATGAACAGCCTG<br>AAGCCAGAGGACACCGCTACTTATTACTGCAAGAGGGGACATGCGTGTGCGGGG<br>TATTACCCCATTCCCTATGATGACTACTGGGGCCAGGGCACCCAGGTGACCGTT<br>AGTTCT |
| hIL27Ra_<br>VH<br>H14-<br>DR591 | 1399 | CAGGTGCAACTCCAGGAATCCGGCGGTGGCTCCGTGCAAGCCGGTGGCAGTCTT<br>AGGCTGTCCTGTGTGGCATCAGGGTATGTGTCCTGCGACTACTTCCTGCCTAGC<br>TGGTACAGACAAGCTCCCGGTAAGGAGAGAGAGTTCGTGTCAATCATTGATGGC<br>ACCGGCTCCACTTCCTACGCCGCTTCTGTGAAGGGACGTTTTACTGCCAGCCAA<br>GATAAGGGCAAGAACATTGCCTATTTGCAGATGAACTCCTTGAAGCCGGAGGAC<br>ACCGCTATGTATTACTGCAAGGCCTCCTGTGTACGTGGCCGGGCCATTTCCGAA<br>TACTGGGGCCAAGGAACGCAGGTCACAGTGTCCTCTGGAGGTGGGTCCCAGGTG<br>CAGTTGCAGGAAAGCGGCGGAGGGTCCGTCCAGGCTGGTGGCTCTCTGCGCCTT<br>TCCTGCACCGCCTCTGGGGCTATCGCCTCCGGCTACATTGATTCTCGCTGGTGC<br>ATGGCATGGTTCCGCCAAGCTCCTGGCAAGAACGCGAGGGAGTGGCCGCGATT<br>TGGCCCGGTGGGGTCTGACTGTCTACGCAGACTCTGTAAAGGGTCGCTTCACA<br>ATTTCCAGAGATCACGCGAAGAATACCCTCTACCTCCAGATGAACAATCTCAAG<br>CCCGAGGACACTGCCATGTACTATTGCGCCGCTGGATCTCCGCGCATGTGCCCT<br>AGTCTGGAATTTGGCTTCGATTACTGGGGCCAGGGTACTCAGGTGACAGTGTCT<br>AGC |
| hIL27Ra_<br>VH<br>H14-<br>DR591 | 1400 | CAGGTGCAGTTGCAGGAGTCAGGAGGTGGCAGCGTCCAGGCAGGAGGTAGCTTG<br>CGGCTCTCCTGCGTTGCGTCCGGCTATGTGAGTTGTGACTATTTTCTCCCATCT<br>TGGTATCGTCAAGCGCCAGGTAAGGAACGTGAATTTGTGTCCATCATTGATGGA<br>ACTGGCTCCACTAGCTACGCCGCGAGCGTGAAGGGCCGCTTCACGGCCTCTCAG<br>GATAAGGGGAAGAACATCGCATACCTCCAGATGAACTCCTTGAAGCCAGAGGAT<br>ACCGCCATGTATTACTGCAAGGCCTCCTGCGTCCGTGGTCGGGCGATCTCCGAG<br>TACTGGGGCCAGGGAACTCAGGTGACAGTCAGCTCTGGTGGCAGCGGAGGGTCC<br>GGCGGAAGCGGACAGGTGCAGCTCCAGGAAAGTGGAGGGGGAAGCGTGCAGGCA<br>GGGGGCAGCCTGCGGCTGTCTTGTACCGCATCGGGGCCATTGCTTCCGGCTAT<br>ATTGATTCCAGATGGTGCATGGCTTGGTTTAGGCAAGCGCCTGGCAAAGAGCGT<br>GAAGGTGTCGCCGCAATCTGGCCGGGCGGGGGTCTGACAGTGTACGCCGACTCT<br>GTGAAGGGTAGATTCACAATCAGCCGCGACCATGCTAAAAACACTTTGTACCTC<br>CAGATGAATAACCTGAAGCCTGAAGACACCGCCATGTATTACTGCGCTGCCGGA<br>AGCCCTCGCATGTGCCCCAGCCTGGAGTTTGGCTTCGATTACTGGGGCCAGGGG<br>ACCCAGGTGACGGTGAGCAGC |
| hIL27Ra_<br>VH<br>H14-<br>DR592 | 1401 | CAGGTACAGTTGCAAGAGAGCGGAGGCGGTTCTGTGCAGGCTGGAGGCAGCCTT<br>CGCCTGTCCTGCGTGGCCTCTGGATACGTGTCATGTGACTACTTCCTGCCGAGT<br>TGGTATCGCCAGGCTCCTGGGAAGGAGCGGAGTTCGTGAGCATTATCGACGGC<br>ACAGGCAGTACGTCCTACGCGGCCAGCGTGAAAGGTAGGTTCACTGCTTCCCAG<br>GATAAAGGCAAAAACATCGCGTACTTGCAGATGAACTCACTGAAGCCTGAGGAC<br>ACAGCCATGTATTACTGTAAGGCCAGCTGTGTGCGTGGCCGCTATCTCTGAG<br>TACTGGGGCAAGGCACTCAGGTCACTGTCAGCAGTGGAGGTAGCCAGGTC<br>CAGCTCCAGGAGTCAGGAGGCGGGTCCGTGCAGGCTGGTGGCAGCCTGCGCCTC<br>AGCTGCACCGCTCCCGGCTTCACTTCTAACAGCTGCGGCATGGACTGGTATAGG<br>CAAGCCCCAGGGAAGGAGCGCGAGTTCGTTTCCAGTATCTCCACCGATGGAACC<br>ACGGGCTATGCTGATTCCGTGAAAGGACGTTTCACTATTAGCAAGGACAAGGCG |

TABLE 1B-continued

| Name | SEQ ID NO: | Sequence |
|---|---|---|
| | | AAAGACACTGTGTATCTCCAGATGAACTCTCTGAAGCCTGAGGATACCGGCATG<br>TATAGCTGTAAAACAAAAGATGGGACCATCGCAACTATGGAACTTTGTGACTTC<br>GGCTATTGGGGCCAGGGTACTCAGGTAACCGTGTCCTCT |
| hIL27Ra_<br>VH<br>H14-<br>DR592 | 1402 | CAGGTTCAGTTGCAAGAAAGTGGTGGGGGCAGCGTGCAGGCGGGAGGCAGCTTG<br>AGGCTGAGCTGCGTGGCATCCGGCTACGTTTCCTGTGATTACTTTCTGCCCTCC<br>TGGTATCGCCAAGCGCCTGGAAAAGAGAGGGAGTTCGTTTCTATTATCGACGGC<br>ACAGGCTCCACGAGTTATGCGGCCTCTGTCAAGGGACGCTTTACTGCTTCCCAA<br>GACAAGGGGAAGAATATCGCCTATCTCCAGATGAACTCTCTGAAGCCTGAAGAC<br>ACCGCTATGTATTACTGCAAGGCCAGCTGTGTGAGAGGTCGCGCTATCTCCGAG<br>TACTGGGGACAAGGCACTCAAGTAACGGTTGTCATCCGGTGGCTCTGGAGGCTCC<br>GGCGGGTCTGGCCAAGTCCAGTTGCAGGAATCGGTGGAGGGTCTGTCCAGGCA<br>GGAGGCAGTCTGCGCCTGTCATGTACCGCGCCCGGATTTACCAGTAATAGCTGC<br>GGAATGGATTGGTATCGCCAGGCTCCTGGCAAGGAAAGAGAGTTCGTCTCTTCC<br>ATCAGCACTGACGGCACTACAGGCTACGCCGATTCTGTGAAAGGGCGCTTCACA<br>ATCTCCAAGGACAAAGCTAAGGATACCGTGTATCTGCAAATGAATAGTCTGAAG<br>CCTGAGGATACAGGAATGTACTCCTGTAAGACCAAGGACGGCACCATCGCTACA<br>ATGGAGCTGTGCGACTTTGGCTACTGGGGCCAGGGCACCCAAGTGACCGTCTCT<br>TCA |
| hIL27Ra_<br>VH<br>H14-<br>DR593 | 1403 | CAGGTGCAGCTCCAGGAGAGTGGTGGAGGGAGCGTGCAGGCTGGAGGCTCCCTG<br>CGTCTTAGCTGCGTTGCCAGCGGGTACGTCTCCTGCGACTACTTTCTGCCGTCC<br>TGGTATCGTCAAGCCCCTGGTAAAGAAAGAGAGTTCGTCTCCATCATTGATGGA<br>ACAGGCAGCACATCCTATGCGGCCTCCGTGAAGGGCCGCTTTACCGCAAGCCAA<br>GATAAAGGTAAGAATATCGCCTACCTCCAGATGAACAGTTTGAAGCCCGAGGAT<br>ACAGCCATGTATTACTGTAAGGCCAGTTGTGTGCGCGGGAGAGCCATCAGCGAG<br>TACTGGGGCCAGGGCACACAGGTGACTGTATCTTCCGGCGGTGGCTCCCAGGTG<br>CAGCTGCAAGAGAGCGGAGGCGGGTCCGTGCAGGCCGGAGGTAGCCTGCGCCTG<br>TCATGCGCGGCCTCCGGTTACCCTTACTCCAACGGCTACATGGGGTGGTTTAGA<br>CAGGCTCCAGGTAAGGAGCGGGAGGGGGTCGCCACAATCTACACGGGTGATGGC<br>AGGACTTACTATGCCGACTCAGTGAAAGGCAGGTTTACCATTAGTCGCGACAAC<br>GCCAAGAACACAGTTGACCTTCAGATGTCCTCACTGAAGCCTGAAGACACCGCC<br>ATGTATTACTGCGCTGCACGCGCCGCTCCGCTGTACTCCAGCGGCTCCCCATTG<br>ACTCGCGCACGCTACAATGTGTGGGGCAAGGAACCCAGGTGACGGTGTCCTCT |
| hIL27Ra_<br>VH<br>H14-<br>DR593 | 1404 | CAGGTGCAGCTCCAAGAGTCAGGCGGGGGTTCCGTTCAAGCCGGTGGGAGCCTG<br>CGCCTGTCATGTGTGGCATCTGGATACGTGTCTTGTGACTACTTCCTGCCATCC<br>TGGTATCGGCAGGCCCCTGGGAAGGAGCGCGAATTTGTGTCTATCATTGATGGA<br>ACCGGATCTACAAGCTACGCCGCATCCGTTAAGGGGAGGTTCACAGCCTCCCAG<br>GACAAGGGAAAGAACATTGCATACCTCCAGATGAACTCCCTCAAGCCCGAGGAT<br>ACTGCTATGTATTACTGTAAGGCCAGTTGTGTGCGTGGACGCGCCATCTCCGAG<br>TACTGGGGCCAGGGAACCCAGGTGACCGTGTCCAGCGGTGGCAGCGGCGGTTCC<br>GGCGGATCTGGACAGGTGCAGCTCCAGGAGTCTGGAGGCGGGTCCGTTCAGGCT<br>GGGGGCAGCTTGCGTTTGAGTTGCGCCGCTTCCGGCTACCCTTACTCTAACGGT<br>TACATGGGCTGGTTTCGCCAAGCACCGGGCAAGGAACGGGAAGGTGTCGCTACG<br>ATTTACACCGGCGACGGACGCACATATTACGCGGATAGCGTGAAGGGGCGCTTC<br>ACAATCTCTAGGGACAACGCGAAGAACACTGTGGACCTTCCAGATGTCAAGCCTG<br>AAGCCTGAGGATACCGCCATGTACTATTGCGCCGCTCGTGCTGCGCCCCTGTAT<br>TCTAGCGGCAGCCCTCTTACTCGGGCACGCTACAACGTGTGGGTCAAGGCACA<br>CAGGTGACCGTCTCCTCC |
| hIL27Ra_<br>VH<br>H14-<br>DR594 | 1405 | CAGGTGCAGCTTCAAGAATCAGGTGGGGATCTGTGCAGGCAGGCGGGTCACTT<br>CGCCTGTCCTGCGTGGCCTCCGGCTATGTCTCTTGTGATTACTTCCTGCCTAGC<br>TGGTATCGCCAGGCTCCAGGCAAGGAGAGAGTTCGTGAGCATCATTGACGGG<br>ACGGGCTCCACTTCTTACGCCGCAAGCGTCAAGGGGCGCTTCACCGCGTCCCAG<br>GACAAGGGAAAGAACATCGCGTACTTGCAGATGAACTCCCTGAAGCCAGAAGAC<br>ACAGCTATGTATTACTGTAAGGCGTCTTGCGTCCGTGGCCGTGCAATCTCTGAG<br>TACTGGGGCCAGGGCACTCAGGTGACTGTCAGCTCTGGCGGTGGCAGTCAGGTT<br>CAGCTTCAGGAATCGGCGGGGGCTCTGTGCAGGCAGGCGGTAGCCTGAGGTTG<br>TCCTGTGTGGCTTCCGCTTCTACCTACTGCACCTACGATATGCACTGGTATCGT<br>CAGGCCCCCGGTAAAGGGCGCGAGTTTGTGTCTGCTATTGATTCTGACGGCACC<br>ACACGTTATGCCGACTCTGTCAAAGGCAGGTTCACAATCTCTCAAGGTACTGCT<br>AAAAACACGGTATACCTTCAAATGAACTCTCTGCAACCTGAAGATACAGCGATG<br>TATTACTGTAAGACTGTGTGCGTTGTGGGTAGCAGATGGAGCGACTACTGGGGC<br>CAGGGTACACAGGTGACAGTCTCTTCT |
| hIL27Ra_<br>VH<br>H14-<br>DR594 | 1406 | CAGGTCCAGCTTCAGGAGTCTGGGGCGGTTCTGTGCAGGCTGGGGGCTCTCTC<br>CGGCTGAGCTGTGTGGCAGCGGTTATGTGTCATGCGACTACTTCTGCCCAGC<br>TGGTATCGCCAAGCTCCCGGCAAGGAGAGGGAGTTCGTGTCTATTATCGACGGG<br>ACAGGCTCCACCAGTTACGCGGCCTCAGTGAAGGGACGTTTCACTGCATCTCAA<br>GACAAGGGCAAGAACATCGCCTACTCCAGATGAATAGCCTGAAGCCTGAGGAC<br>ACAGCTATGTATTACTGTAAGGCCTCCTGTGTGCGCGGCGTGCTATCGCCGAG<br>TACTGGGGTCAGGGGACTCAAGTCACGGTCTCCTCAGGAGGGTCCGGGGGCAGC<br>GGAGGGTCAGGCAGGTGCAGTTGCAGGAATCGGAGGCGGTAGTGTTCAGGCC<br>GGTGGCTCTCTGCGCCTGTCCTGCGTCGCGAGTGCATCTACGTACTGTACCTAC<br>GATATGCACTGGTATCGGCAAGCCCTGGGAAGGGCCGTGAGTTTGTCAGCGCC<br>ATTGATTCTGACGGCACTACCCGCTACGCAGATAGCGTTAAAGGCCGCTTTACT |

TABLE 1B-continued

| Name | SEQ ID NO: | Sequence |
|---|---|---|
| | | ATCAGTCAGGGCACCGCCAAGAACACCGTCTACCTCCAGATGAACTCTCTCCAG<br>CCCGAGGATACCGCCATGTACTATTGCAAAACAGTGTGCGTCGTGGGCTCCCGG<br>TGGTCCGACTACTGGGGCCAAGGCACTCAAGTGACTGTTTCTTCC |
| hIL27Ra_<br>VH<br>H14-<br>DR595 | 1407 | CAGGTCCAGCTCCAGGAGTCTGGCGGGGGCTCCGTGCAAGCTGGTGGCAGCCTC<br>CGTCTGAGCTGCGTAGCCTCTGGTTACGTGTCATGCGACTACTTCCTGCCGTCC<br>TGGTATCGGCAGGCCCCCGGCAAGAACGTGAGTTCGTAAGCATCATTGATGGT<br>ACTGGGAGTACGTCCTATGCAGCCAGCGTGAAGGGCCGCTTTACCGCAAGCCAG<br>GACAAGGGTAAAAATATTGCTTATCTTCAGATGAACAGCCTGAAACCTGAAGAT<br>ACCGCAATGTATTACTGTAAGGCCAGCTGCGTAAGGGGCCGTGCCATTTCAGAA<br>TACTGGGGACAGGGTACACAGGTGACTGTGTCATCTGGCGGGGGTAGCCAGGTG<br>CAGCTCCAGGAGTCCGGCGGTGGGAGCGTGCAGGCAGGGGCTCCCTGACCCTG<br>TCCTGTGCGGCCAGCGAGTACGCCATAGCACCTGTAATATGGGGTGGTATCGT<br>CAGGCCCCTGGGAAAGAGCGCGAGCTGGTGTCTGCCTTCATCAGTGACGGCTCC<br>ACTTATTACGCCGACTCCGTCAAGGGCCGGTTCACCATTACCCGTGATAACGCC<br>AAGAATACCGTTTACCTCCAGATGAATAGCCTCAAACCCGAGGACACCGCGATT<br>TACTATTGCTCCGCTAACTGTTACCGCAGGCTGCGTAACTACTGGGGACAGGGC<br>ACTCAGGTGACTGTCTCTTCC |
| hIL27Ra_<br>VH<br>H14-<br>DR595 | 1408 | CAGGTCCAGCTCCAGGAGAGCGGCGGGGGTTCCGTCCAGGCCGGTGGCAGCCTG<br>CGTCTCTCTTGTGTGGCGAGCGGGTACGTCAGCTGCGATTACTTCCTGCCCTCC<br>TGGTATCGCCAGGCCCCTGGTAAGGAGAGGGAGTTCGTGTCTATCATTGATGGG<br>ACTGGATCAACTAGCTACGCTGCGTCTGTTAAAGGGCGGTTTACTGCAAGCCAG<br>GACAAGGGCAAGAACATTGCCTACCTTCAGATGAACAGCCTGAAGCCGGAGGAC<br>ACCGCCATGTATTACTGTAAGGCCTCTTGTGTACGCGGTCGCGCCATCTCCGAA<br>TACTGGGGTCAGGGTACACAGGTGACAGTCAGCTCAGGAGGTTCCGGTGGCTCC<br>GGGGGTTCCGGCCAGGTCCAGTTGCAGGAATCCGGTGGCGGAAGCGTGCAGGCT<br>GGTGGCTCCCTGACACTGTCTTGCGCAGCCAGCGAATATGCTTATAGTACTTGC<br>AACATGGGCTGGTATCGCCAGGCCCCCGGCAAGAACGCGAACTCGTGAGTGCC<br>TTCATCTCCGACGGTAGCACTTATTACGCCGATTCGTGAAGGGAAGGTTCACT<br>ATTACGCGCGACAACGCCAAGAACACCGTCTACTTGCAGATGAACTCCCTGAAG<br>CCCGAAGACACTGCCATCTACTATTGCTCCGCCAACTGCTACCGTCGCCTGCGG<br>AACTATTGGGACAGGGCACCCAGGTCACTGTCAGCTCC |
| hIL27Ra_<br>VH<br>H14-<br>DR596 | 1409 | CAAGTGCAGCTGCAAGAGAGTGGAGGTGGCTCCGTACAGGCAGGCGGGAGCCTC<br>CGCCTCAGCTGCGTAGCCAGCGGCTATGTCAGTTGCGACTACTTCCTCCCCTCT<br>TGGTACAGGCAGGCCCCAGGCAAGGAACGCGAGTTTGTGAGCATTATCGACGGC<br>ACAGGGGAGCACGAGTTACGCTGCCAGCGTCAAAGGCAGATTCACAGCCTCTCAA<br>GACAAAGGGAAAAACATCGCCTACTTGCAGATGAACTCTCTGAAGCCCGAGGAT<br>ACCGCCATGTATTACTGCAAGGCCTCTTGTGTGCGGGGCCGCGCTATCTCCGAA<br>TACTGGGGACAGGGGACCCAGGTGACTGTGTCCAGTGGAGGTGGCTCCCAAGTT<br>CAGCTCCAGGAGTCCGGTGGCGGGCTTGTGCAGCCGGGCGGTTCCCTGCGCCTG<br>TCCTGCACTGCATCTGGTCTGACTTTCACGATTCCGTAATGGGCTGGTTCCGC<br>CAAGCACCTGGCAAAGGTCGCGAGGCTGTATCCTGTATCTCTAGCTCTGGTGCC<br>AACGCATTCTACGCTGACTCCGTCAAAGGCCGTTTTACCATTAGTCGCGATAAC<br>GCTAAAAACACACTGTACCTGCAAATGAACTCCCTCAAACCGGAAGATACTGCC<br>ACCTACTATTGCAAGCGCGGGCACGCCTGTGCGGGCTATTACCCTATCCCATAC<br>GATGACTACTGGGGCCAGGGCACCCAGGTCACTGTTAGCTCC |
| hIL27Ra_<br>VH<br>H14<br>DR596 | 1410 | CAGGTCCAACTCCAGGAGTCCGGCGGGGGCAGTGTGCAGGCTGGCGGGTCTCTG<br>CGTCTGTCCTGCGTCGCGAGCGGCTACGTCAGCTGCGACTATTTCTGCCTAGC<br>TGGTATCGCCAGGCCCCAGGTAAGGAAAGAGAGTTCGTGAGCATTATCGACGGG<br>ACAGGTTCCACCTCCTACGCCGCGTCTGTGAAGGGCCGGTTTACTGCTTCCCAG<br>GATAAAGGTAAGAACATTGCATATCTGCAAATGAACTCTCTGAAGCCCGAGGAC<br>ACTGCTATGTATTACTGTAAAGCAAGTCGTGTGCGCGGCAGAGCAATTTCTGAA<br>TACTGGGGCCAGGGCACCCAGGTGACTGTGTCCAGCGGGGGCAGTGGTGGCAGT<br>GGAGGTAGCGGCCAAGTCCAGTTGCAGGAGAGTGGCGGTGGCCTGGTGCAGCCA<br>GGTGGCTCCCTCCGTCTGAGCTGCACAGCCAGCGGGCTGACGTTCGATGACTCT<br>GTGATGGGTTGGTTTCGCCAGGCTCCCGGCAAGGGCCGCGAAGCTGTTTCCTGT<br>ATCTCTTCCTCTGGCGCGAATGCTTTTTTACGCCGACTCCGTGAAGGGGAGGTTC<br>ACTATTTCCAGAGACAATGCCAAGAACACTCTGTACCTTCAGATGAACTCCCTC<br>AAGCCTGAAGACACCGCCACCTACTATTGTAAGCGCGGCCATGCCTGTGCCGGG<br>TACTATCCTATTCCTTATGATGACTACTGGGGCCAGGGCACTCAGGTGACCGTG<br>TCCTCC |
| hIL27Ra_<br>VH<br>H15-<br>DR591 | 1411 | CAGGTGCAGCTCCAGGAGAGCGGCGGTGGCTCCGTGCAGGCCGGTGGCTCCCTC<br>CGCCTCAGCTGCGTGGCCTCAGGTTACGTCAGCTGCGATTACTTTCTGCCAAGC<br>TGGTATCGCCAAGCGCCCAGGGAAGGAGCGCGAGTTTGTGTCTATTATCGACGGA<br>ACTGGCTCCACTAGCTATGCTGCCAGCGTGAAGGGACGCTTCACAGCTTCCCAG<br>GATAAGGGAAAAACATCGCCTACTCCAGATGAACACCCTGAAACCCGAGGAC<br>ACCGCCATGTATTACTGCAAGGCAAGCTGCGTGCGGGCAGAGCTATCTCCGAG<br>TACTGGGGCCAGGGAACCCAGGTTACCGTCAGCTCAGGCGGAGGTTCACAGGTT<br>CAGTTGCAAGAAAGCGGCGGTGGGAGCGTGCAGGCTGGTGGAAGCCTGCGTCTG<br>TCCTGCACAGCATCCGGCGCAATCGCTAGTGGATACATTGATAGCCGCTGGTGC<br>ATGGGCCTGGTTCCGCCAAGCTCCAGGTAAAGAGCGCGAGGGGGTGGCGGCCATC<br>TGGCCTGGCGGAGGCCTGACTGTTTACGCCGACTCAGTGAAGGGCGCTTTACC<br>ATCTCACGGGACCATGCTAAGAACACCCTGTACTTGCAGATGAACAATCTGAAA |

TABLE 1B-continued

| Name | SEQ ID NO: | Sequence |
|---|---|---|
| | | CCTGAGGACACCGCGATGTATTACTGCGCAGCGGGCTCACCTCGTATGTGCCCT<br>AGCTTGGAGTTTGGCTTCGACTACTGGGGCCAAGGCACCCAGGTGACTGTGAGC<br>AGC |
| hIL27Ra_<br>VH<br>H15-<br>DR591 | 1412 | CAAGTGCAGTTGCAGGAGAGTGGTGGGGGCTCTGTGCAGGCCGGGGGTTCCCTG<br>AGGCTCTCTTGCGTGGCCAGCGGATACGTGTCCTGTGACTACTTCCTGCCCTCT<br>TGGTATCGCCAAGCGCCAGGGAAGGAACGCGAGTTCGTGAGCATTATCGACGGC<br>ACTGGTTCCACCTCTTACGCAGCGTCTGTAAAGGGCCGTTTCACCGCCAGCCAG<br>GACAAGGGGAAGAACATCGCTTACCTTCAGATGAATACGTTGAAGCCTGAGGAC<br>ACTGCGATGTATTACTGTAAAGCGTCTTGCGTTCGTGGCCGTGCCATCTCCGAA<br>TACTGGGGCCAAGGCACTCAGGTAACTGTGTCCAGCGGCGGTTCCGGTGGCTCT<br>GGAGGTAGCGGTCAGGTGCAGCTCCAGGAATCTGGCGGTGGGAGTGTGCAGGCT<br>GGCGGTAGTCTCCGGCTGTCCTGTACCGCCAGTGGAGCTATTGCCAGCGGATAC<br>ATTGATTCCCGGTGGTGTATGGCATGGTTCCGGCAGGCCCCCGGCAAGGAACGC<br>GAGGGGGTCGCCGCTATTTGGCCCGGAGGCGGGCTGACCGTGTACGCGGACAGT<br>GTCAAGGGCCGCTTCACGATCAGTAGGGATCACGCCAAGAACACCCTCTACTTG<br>CAGATGAATAACCTCAAACCAGAGGACACTGCAATGTATTACTGCGCCGCTGGC<br>AGCCCGAGGATGTGCCCGTCCCTGGAGTTCGGCTTCGACTATTGGGGTCAGGGC<br>ACTCAGGTCACCGTGTCCTCC |
| hIL27Ra_<br>VH<br>H15-<br>DR592 | 1413 | CAGGTCCAGCTCCAGGAGAGCGGCGGAGGCTCTGTTCAGGCTGGGGGCAGCCTC<br>CGCCTGTCTTGCGTGGCCTCCGGCTACGTAAGCTGCGACTACTTCTTGCCCTTCC<br>TGGTATCGCCAGGCTCCGGGCAAAGAAAGGGAATTTGTATCCATTATCGACGGC<br>ACGGGTAGCACTTCCTACGCCGCTAGTGTAAAGGGTCGGTTCACCGCCTCTCAG<br>GACAAGGGCAAAAACATCGCGTACCTCCAGATGAACACACTGAAGCCAGAGGAT<br>ACCGCCATGTATTACTGCAAGGCTTCCTGCGTGCGCGGGCGGGCCATTAGCGAG<br>TACTGGGGACAAGGAACCCAAGTGACTGTGTCCAGCGGTGGAGGCTCTCAGGTC<br>CAGCTGCAAGAGTCTGGAGGCGGTTCAGTGCAGGCCGGTGGAAGCCTTAGGCTG<br>AGCTGCACCGCCCCTGGATTTACCTCTAACTCTTGCGGCATGGACTGGTATCGT<br>CAGGCCCCCGGCAAGGAACGCGAGTTCGTGTCTAGCATCTCCACCGATGGCACC<br>ACAGGCTATGCTGACAGTGTGAAAGGCCGTTTTACCATCTCCAAGGACAAAGCC<br>AAGGACACGGTGTACCTCCAGATGAACTCCTTGAAGCCTGAAGACACGGGTATG<br>TATTCTTGCAAGACTAAGGACGGCACCATCGCTACTATGGAGCTGTGCGACTTT<br>GGTTATTGGGACAGGGGACCCAGGTGACTGTATCTTCT |
| hIL27Ra_<br>VH<br>H15-<br>DR592 | 1414 | CAGGTGCAGCTGCAAGAGTCTGGAGGTGGGTCAGTCCAGGCTGGGGGCAGCCTC<br>AGGCTGTCCTGCGTCGCTTCTGGATACGTGTCCTGCGACTACTTCCTCCCCTCC<br>TGGTATCGCCAGGCCCCAGGTAAAGAACGCGAGTTCGTGTCCATCATTGATGGC<br>ACCGGGTCTACTTCCTATGCTGCCTCCGTGAAGGGCCGTTTTACCATCTCACAG<br>GATAAAGGAAAGAACATTGCTTACCTCCAGATGAACACACTCAAGCCGGAAGAC<br>ACCGCCATGTATTACTGTAAAGCGAGCTGTGTCCGTGGCAGAGCCATCAGTGAG<br>TATTGGGGCCAGGGAACTCAGGTGACCGTGTCCTCTGGAGGCAGCGGCGGTAGT<br>GGTGGCTCCGGGCAAGTTCAACTTCAGGAGAGTGGGGGTGGGTCCGTGCAGGCT<br>GGGGGTTCTCTCCGCCTCAGCTGTACCGCGCCCGGCTTCACCTCTAACAGCTGC<br>GGTATGGACTGGTATCGCCAAGCGCCGGGTAAAGAGCGTGAGTTCGTTAGCTCC<br>ATCTCCACCGACGGCACCACAGGATATGCCGATAGCGTTAAGGGACGCTTTACT<br>ATTAGTAAGGACAAGGCTAAGGATACCGTCTACCTCCAGATGAACTCTCTGAAA<br>CCTGAAGACACAGGCATGTACTCCTGTAAAAACCAAGGACGGCACCATTGCTACA<br>ATGGAGCTTTGTGATTTCGGCTATTGGGGCCAGGGTACACAGGTTACCGTGTCC<br>TCC |
| hIL27Ra_<br>VH<br>H15-<br>DR593 | 1415 | CAAGTGCAGTTGCAGGAGTCCGGCGGAGGTTCAGTTCAGGCTGGCGGGTCCCTG<br>AGACTGAGTGTGTGGCCTCCGGCTATGTGAGCTGCGACTACTTTCTGCCTTCT<br>TGGTACAGACAAGCACCAGGCAAAGAGCGGGAGTTCGTGAGTATCATTGATGGG<br>ACCGGCTCCACCAGCTATGCTGCCAGCGTGAAGGGTCGCTTTACCGCTTCTCAG<br>GACAAAGGCAAAAACATCGCTTACCTCCAGATGAATACATTGAAGCCTGAAGAC<br>ACCGCCATGTATTACTGTAAGGCATCATGTGTGCGTGGCCGCGCCATTTCTGAG<br>TACTGGGGCCAGGGAACTCAGGTGACAGTGTCTAGTGGCGGAGGCTCCCAGGTC<br>CAGTTGCAGGAGAGCGGCGGTGGATCTGTCCAGGCGGGTGGCAGCCTCCGTCTG<br>TCCTGTGCGGCCAGCGGGTATCCTTATTCCAACGGGTACATGGGGTGGTTCCGC<br>CAGGCCCCCGGTAAGGAACGCGAGGGCGTGGCCACTATTTACACAGGTGACGGG<br>CGTACCTATTACGCAGACTCTGTAAAGGGTCGCTTCACAATTTCCCGCGACAAC<br>GCCAAGAACACCGTCGATCTCCAGATGTCTAGTCTCAAACCTGAGGACACCGCC<br>ATGTATTACTGTGCCGCTCGCGCCGCGCCACTTTACAGCTCTGTTCTCCCCTC<br>ACACGCGCTCGCTACAATGTTTGGGGCCAAGGCACACAGGTGACCGTGAGCAGT |
| hIL27Ra_<br>VH<br>H15-<br>DR593 | 1416 | CAGGTGCAGTTGCAGGAATCTGGTGGAGGCTCCGTGCAGGCTGGGGGCTCCCTG<br>AGGCTTTCATGTGTGGCAAGCGGCTACGTGAGTTGTGATTACTTTCTGCCTTCC<br>TGGTATCGCCAGGCCCCTGGCAAGGAGCGGGAATTTGTCTCAATCATTGATGGT<br>ACTGGTTCCACTTCTTATGCGGCCAGTGTGAAAGGCGTTTTACTGCCAGCCAG<br>GATAAGGGCAAGAATATTGCTTACTTGCAGATGAACACCCTGAAGCCCGAAGAT<br>ACCGCTATGTACTATTGCAAGGCCAGTTGTGTAAGGGGTCGGGCGATTAGTGAG<br>TATTGGGGCCAGGGCACGCAGGTCACCGTGTCATCCGGGGGCAGCGGCGGGTCC<br>GGGGGTTCTGGCCAGGTGCAGCTCCAGGAGAGCGGTGGAGGCAGCGTGCAGGCC<br>GGTGGAAGCCTTCGTCTGTCCTGCGCCGCTTCAGGCTATCCTTACTCTAATGGC<br>TACATGGGTTGGTTTCGCCAAGCCCAGGGAAAGAGCGCGAGGGCGTTGCCACA<br>ATTTACACAGGTGATGGAAGGACCTACTATGCGGACAGCGTCAAGGGCCGCTTT |

TABLE 1B-continued

| Name | SEQ ID NO: | Sequence |
|---|---|---|
| | | ACAATCAGCCGTGATAATGCTAAGAACACCGTCGATCTCCAGATGTCCAGCCTG<br>AAGCCTGAGGATACTGCTATGTACTATTGCGCTGCCCGCGCAGCCCCACTCTAC<br>AGCTCCGGCAGTCCCCTGACGAGGGCTCGCTATAACGTGTGGGGTCAGGGCACA<br>CAGGTCACCGTGTCCAGC |
| hIL27Ra_<br>VH<br>H15-<br>DR594 | 1417 | CAGGTGCAACTCCAGGAATCCGGGGGAGGCAGCGTGCAAGCCGGTGGCTCCCTG<br>CGCCTGTCCTGCGTCGCCAGCGGCTACGTCAGCTGCGACTACTTTCTGCCCTCC<br>TGGTATCGCCAGGCTCCTGGGAAAGAGCGCGAGTTTGTTTCCATCATTGATGGA<br>ACCGGCAGCACATCCTATGCCGCGAGCGTTAAGGGCAGATTTACCGCCTCTCAA<br>GACAAGGGTAAGAACATCGCCTACCTCCAAATGAACACCCTGAAGCCTGAGGAC<br>ACGGCAATGTATTACTGTAAAGCAAGCTGTGTGCGGGGTCGGGCCATCAGCGAG<br>TACTGGGGTCAGGGCACCCAGGTCACTGTAAGCTCCGGGGAGGGTCCCAGGTG<br>CAGCTCCAGGAGTCAGGCGGAGGCTCCGTGCAGGCCGGAGGCTCCTTGCGTTTG<br>AGCTGCGTGGCGTCTGCGTCTACCTACTGCACTTACGACATGCACTGGTATCGC<br>CAGGCTCCGGGGAAGGGCCGCGAGTTCGTGAGCGCTATCGACTCCGATGGCACA<br>ACTCGCTACGCCGACAGCGTGAAGGGGCGTTTTACCATTTCCCAGGGCACCGCC<br>AAGAACACCGTGTATCTCCAGATGAACTCTCTGCAACCGGAGGATACAGCTATG<br>TATTACTGCAAGACAGTCTGTGTGGTTGGTAGCCGCTGGTCTGACTACTGGGGC<br>CAGGGCACCCAGGTCACGGTGTCCTCT |
| hIL27Ra_<br>VH<br>H15-<br>DR594 | 1418 | CAGGTGCAGCTTCAAGAGTCTGGTGGCGGGTCCGTCCAGGCGGGTGGCAGTTTG<br>AGACTCAGTGTGTGGCCAGTGGCTACGTCAGCTGTGACTATTTCTGCTAGC<br>TGGTATCGCCAGGCACCCGGTAAAGAGAGGGAGTTCGTGAGCATCATTGATGGG<br>ACAGGGTCTACATCTTATGCTGCCTCCGTGAAAGGGCGGTTCACAGCTTCCCAG<br>GATAAGGGCAAGAACATTGCGTATCTCCAGATGAACACCCTCAAGCCGGAGGAT<br>ACCGCGATGTATTACTGTAAGGCGTCTTGTGTGCGCGGGCGTGCTATTAGCGAG<br>TATTGGGGACAGGGGACGCAAGTGACGGTCTCCTCAGGCGGGTCTGGTGGCTCT<br>GGCGGGTCCGGGCAGGTCCAGCTCCAGGAGTCTGGCGGTGGCTCCGTCCAAGCC<br>GGAGGCAGCCTCCGTCTCTCCTGTGTTGCATCAGCCTCCACGTACTGCACCTAT<br>GATATGCACTGGTATCGGCAAGCGCCCGGCAAGGGCCGCGAGTTTGTGTCTGCC<br>ATCGACAGTGATGGTACAACGCGGTACGCTGATAGCGTGAAAGGCCGCTTCACC<br>ATCAGTCAGGGCACGGCCAAAAACACAGTGTATCTCCAGATGAACTCTCTCCAG<br>CCTGAAGATACAGCCATGTACTATTGTAAGACGGTCTGCGTCGTGGGCAGCCGG<br>TGGTCCGACTACTGGGGCCAGGGAACCCAAGTGACTGTCTCAAGT |
| hIL27Ra_<br>VH<br>H15-<br>DR595 | 1419 | CAGGTGCAGTTGCAGGAGAGCGGCGGAGGCTCTGTGCAGGCAGGAGGCTCACTG<br>AGACTGTCCTGCGTGGCAAGCGGCTATGTGAGCTGCGACTACTTTCTGCCAAGT<br>TGGTATCGTCAGGCTCCTGGCAAAGAAAGGGAGTTTGTGAGCATCATTGATGGA<br>ACCGGAAGCACAAGTTATGCGCCTCCGTGAAGGGTCGCTTCACAGCTCCACAG<br>GATAAGGGCAAGAACATTGCTTACCTCCAGATGAACACACTCAAGCCTGAAGAC<br>ACCGCGATGTACTATTGTAAAGCAAGTTGTGTGAGAGGCCGCGCCATTAGCGAG<br>TATTGGGGCCAGGGCACTCAGGTGACCGTCAGCTCTGGCGGGGAAGCCAGGTA<br>CAACTCCAGGAGAGTGGTGGAGGCTCAGTGCAGGCCGGGGGAAGCCTGACCCTG<br>TCCTGTGCCGCTTCCGAGTACGCATACAGCACTTGCAACATGGGCTGGTATCGC<br>CAAGCCCCTGGCAAAGAACGGGAACTCGTGTCCGCCTTCATCTCCGATGGTTCT<br>ACCTATTACGCTGATAGCGTGAAAGGACGCTTCACCATTACCCGTGATAACGCT<br>AAGAACACAGTTTACTTGCAGATGAACTCTCTGAAGCCCGAAGACACCGCCATT<br>TATTACTGTAGCGCCAACTGTTATCGCAGGCTTCGGAATTACTGGGGACAGGGG<br>ACCCAGGTGACAGTGAGTAGC |
| hIL27Ra_<br>VH<br>H15-<br>DR595 | 1420 | CAGGTGCAGTTGCAGGAGTCTGGGGGCGGTAGCGTCCAGGCTGGCGGATCACTG<br>CGCCTGAGTTGTGTCGCGTCCGGCTACGTCAGCTGCGACTATTCTTGCCCTCC<br>TGGTATCGCCAGGCCCCTGGCAAGGAACGTGAGTTCGTAAGCATCATTGACGGC<br>ACTGGTAGCACTTCCTACGCCGCTAGTGTGAAGGGCCGGTTCACCGCAAGCCAG<br>GACAAGGGGAAGAACATCGCCTACCTCCAGATGAACACACTGAAGCCCGAGGAC<br>ACGGCCATGTACTATTGCAAAGCCTCTTGCGTGCGGGGCGTGCGATCTCTGAA<br>TATTGGGGCCAGGGAACTCAGGTGACCGTGTCTAGTGGTGGCAGTGGTGGGTCC<br>GGCGGGAGCGGTCAGGTTCAGTTGCAGGAGAGCGGCGGTGGCTCCGTTCAGGCC<br>GGGGGCTCTCTGACGCTGTCTTGCGCGGCCAGCGAATACGCTTACTCAACTTGT<br>AATATGGGTTGGTATCGTCAGGCACCCGGCAAGGAGCGGGAGCTGGTCTCCGCT<br>TTCATCAGCGACGGCTCCACCTATTACGCAGACAGCGTTAAGGGTCGCTTTACT<br>ATCACGCGCGACAACGCCAAGAACACCGTGTACCTCCAGATGAACTCTCTGAAA<br>CCCGAGGATACCGCCATTTACTATTGCTCTGCTAACTGCTACCGCAGGTTGAGA<br>AATTACTGGGGCCAAGGAACTCAGGTGACGGTCTCAAGC |
| hIL27Ra_<br>VH<br>H15-<br>DR596 | 1421 | CAGGTGCAGCTCCAGGAATCTGGCGGTGGCTCCGTACAGGCTGGCGGTTCCCTG<br>AGGCTCTCTTGTGTCGCCAGCGGCTACGTCAGCTGTGACTATTTCCTCCCTTCT<br>TGGTATCGTCAGGCCCCAGGGAAGGAGCGCGAGTTCGTGTCCATTATCGACGGG<br>ACCGGAAGCACCTCCTATGCTGCATCAGTGAAAGGCCGGTTTACCGCGTCTCAG<br>GACAAGGGAAAGAACATTGCATATCTGCAAATGAACACACTCAAGCCAGAGGAC<br>ACCGCTATGTACTATTGTAAGGCCTCCTGTGTGAGAGGTCGCGCAATTTCTGAA<br>TATTGGGGCCAGGGAACCCAGGTGACCGTGTCCTCTGGGGGTTCTCAGGTC<br>CAACTTCAGGAAAGCGGTGGCGGGCTCGTGCAACCCGGTGGCAGCCTTCGGCTG<br>TCTTGTACTGCCTCCGGTTTGACATTCGATGACTCTGTGATGGGATGGTTTAGG<br>CAGGCTCCTGGCAAAGGCCGCGAGGCAGTATCTTGTATCAGTTCTTCCGGCGCT<br>AACGCATTTTATGCCGACAGTGTGAAGGGCCGTTTCACAATCTCCCGCGATAAC<br>GCCAAGAACACCCTCTACCTCCAGATGAACTCCCTGAAGCCTGAGGACACCGCC |

TABLE 1B-continued

| Name | SEQ ID NO: | Sequence |
|---|---|---|
| | | ACTTATTACTGCAAGCGGGGTCATGCCTGTGCTGGCTATTACCCTATTCCATAC<br>GATGACTACTGGGGACAGGGCACCCAAGTTACCGTGTCTAGC |
| hIL27Ra_<br>VH<br>H15-<br>DR596 | 1422 | CAGGTGCAGCTTCAGGAGTCAGGAGGTGGCTCAGTGCAGGCTGGTGGCAGTCTG<br>CGCCTGTCCTGTGTCGCCAGTGGATATGTCAGTTGTGACTATTTTCTCCCCAGT<br>TGGTATCGCCAAGCGCCCGGTAAAGAGCGGGAGTTTGTCTCAATCATTGACGGC<br>ACCGGCAGCACCTCCTACGCCGCTTCCGTGAAGGGTCGCTTCACCGCGTCCCAG<br>GACAAAGGCAAGAACATCGCGTATCTTCAGATGAACACCCTCAAGCCCGAAGAT<br>ACAGCTATGTATTACTGCAAGGCCTCCTGCGTGCGGGGACGCGCGATCTCTGAA<br>TACTGGGGCCAGGGCACACAGGTCACCGTCTCTTCAGGGGGTTCCGGTGGCTCC<br>GGTGGCTCCGGCCAGGTGCAGTTGCAGGAAAGCGGTGGCGGGCTGGTGCAGCCG<br>GGCGGGAGTCTCCGCCTGTCCTGCACAGCGTCAGGGCTGACTTTTGATGACTCT<br>GTTATGGGCTGGTTTAGGCAGGCTCCGGGTAAGGGCAGAGAGGCCGTTAGCTGC<br>ATCTCTTCCAGCGGGGCTAACGCCTTCTATGCCGACAGCGTGAAGGGTCGCTTC<br>ACAATTAGCCGGGACAACGCTAAGAACACTCTGTACCTTCAGATGAACTCCCTG<br>AAGCCCGAAGATACTGCTACTTACTATTGCAAGAGAGGTCATGCTTGCGCCGGA<br>TACTATCCAATCCCTTACGATGACTACTGGGGCCAAGGCACCCAAGTTACCGTG<br>TCTTCT |
| hIL27Ra_<br>VH<br>H16-<br>DR591 | 1423 | CAGGTGCAGTTGCAGGAAAGTGGCGGTGGATCTGTGCAGGCAGGCGGAAGTCTG<br>AGACTGAGCTGCCGGGCCAGCGGTTCAACTTATAGCAATTACTGTCTGGGTTGG<br>TTCAGGCAGATTACTGGTAAGGAACGCGAAGGCGTTGCTGTTATCAACTGGGTT<br>GGGGGAATGCTGTACTTTGCTGACTCCGTTAAGGGCAGATTCACTGTCAGCCAG<br>GACCAGGCCAAGAATACCGTGTACTTGCAGATGAACAGCCTGAAGCCCGAGGAT<br>ACAGCCATGTATTACTGTGCTGCCGAGTCAGCCTCCTCTTTCTCATGTGGGGGA<br>TGGCTTACAAGGCCCGACCGCGTTCCATATTGGGGCCAGGGCACCCAGGTGACT<br>GTAAGCTCCGGTGGAGGCAGTCAGGTCCAGCTCCAGGAGAGCGGCGGAGGCTCT<br>GTTCAGGCTGGAGGTAGCCTGCGCCTTAGCTGCACAGCCTCAGGTGCCATCGCC<br>AGCGGTTATATTGATTCACGCTGGTGTATGGCCTGGTTTCGCCAGGCCCCTGGG<br>AAGGAGAGGGAAGGTGTGGCTGCCATTTGGCCCGGAGGCGGTCTGACAGTCTAC<br>GCAGACTCCGTGAAGGGCCGCTTTACCATCAGCCGGGACCACGCGAAGAACACT<br>CTGTATTTGCAAATGAATAACCTCAAACCCGAGGACACCGCAATGTACTATTGT<br>GCCGCTGGCTCTCCTCGTATGTGTCCATCTCTGGAGTTCGGCTTTGACTACTGG<br>GGCCAGGGGACCCAGGTGACTGTGAGTAGC |
| hIL27Ra_<br>VH<br>H16-<br>DR591 | 1424 | CAAGTGCAGTTGCAGGAGTCTGGTGGCGGTTCCGTGCAGGCTGGTGGAAGCCTG<br>AGGCTGTCTTGTCGTGCATCTGGAAGCACCTATTCCAACTATTGTCTTGGGTGG<br>TTCAGACAGATCACTGGCAAAGAGAGAAGGGGTTGCGGTTATCAACTGGGTG<br>GGCGGTATGCTGTACTTCGCTGATTCCGTGAAGGGCCGCTTCACGGTATCCCAG<br>GACCAAGCAAAGAATACCGTCTATTTGCAGATGAACAGCCTGAAACCGGAGGAT<br>ACCGCCATGTACTATTGTGCAGCCGAGAGCGCCAGCTCCTTCTCTTGTGGCGGT<br>TGGCTGACTCGTCCAGATCGCGTGCCCTACTGGGGCCAAGGGACCCAGGTGACA<br>GTCAGCTCCGGCGGTAGCGGTGGCTCTGGGGGCTCCGGGCAGGTGCAGCTCCAG<br>GAAAGTGGGGGCGGTTCAGTGCAGGCAGGTGGCAGTCTGCGTCTGTCCTGCACC<br>GCAAGCGGCGCAATCGCTTCCGGTTATATTGATTCTGCTGGTGCATGGCTTGGG<br>TTTTCGCCAGGCCCCCGGCAAGGAACGCGAGGGGGTGGCAGCCATCTGGCCGGGA<br>GGGGGACTGACCGTTTACGCTGACAGCGTGAAGGGCCGCTTCACGATCAGTAGG<br>GATCACGCGAAGAACACCCTTTACCTCCAGATGAATAACCTGAAGCCAGAGGAC<br>ACAGCGATGTATTACTGCGCCGCTGGTTCTCCCCGGATGTGTCCATCCCTGGAG<br>TTCGGGTTCGATTACTGGGGCCAGGGGACGCAAGTGACAGTTAGCTCC |
| hIL27Ra_<br>VH<br>H16-<br>DR592 | 1425 | CAGGTACAGCTGCAAGAAAGCGGCGGAGGGTCCGTGCAGGCTGGCGGTTCTCTT<br>CGTCTGTCTTGCCGCGCCTCCGGTAGTACCTACTCCAACTACTGCTTGGGCTGG<br>TTCCGCCAGATCACAGGCAAGGAGCGTGAGGGGGTGGCCGTAATAAATTGGGTG<br>GGCGGTATGCTGTATTTCGCAGATTCCGTGAAAGGCCGCTTTACCGTCTCCCAG<br>GACCAGGCCAAAAACACCGTGTACCTCCAGATGAACTCTCTGAAGCCGGAGGAC<br>ACAGCGATGTACTATTGTGCTGCCAAAGCGCTTCTAGTTTTAGCTGTGGCGGT<br>TGGCTGACCCGTCCTGATCGCGTTCCATACTGGGGACAGGGTACTCAGGTCACC<br>GTGTCTTCCGGCGGTGGCTCCCAGGTTCAGCTCCAGGAATCTGGCGGTGGGAGT<br>GTCCAGGCTGGAGGTAGTCTGCGCCTGTCATGTACCGCCCCGGTTTTACCTCT<br>AACTCTTGCGGTATGGACTGGTATCGCCAGGCTCCCGGTAAGGAGAGGGAGTTC<br>GTCAGCTCTATCAGTACTGACGGCACTACAGGATACGCCGACTCTGTGAAGGGC<br>CGTTTCACCATCTCTAAGGACAAGGCTAAAGACACCGTCTACCTCCAGATGAAC<br>AGTCTCAAGCCCGAGGACACGGGTATGTATTCCTGCAAAACAAAGGATGGGACT<br>ATTGCCACAATGGAGCTTTGTGACTTTGGCTACTGGGGACAGGGAACACAGGTG<br>ACTGTCTCAAGC |
| hIL27Ra_<br>VH<br>H16-<br>DR592 | 1426 | CAGGTGCAGTTGCAGGAGTCAGGAGGTGGGTCCGTGCAGGCCGGTGGCAGCCTG<br>CGGCTCTCTTGTCGGGCCAGTGGCAGCACTTATAGTAACTACTGTCTGGGGTGG<br>TTCGCCAGATCACTGGTAAAGAGCGGGAGGGGTGGCTGTCATTAACTGGGTC<br>GGCGGTATGCTGTACTTCGCCGATTCCGTGAAGGGCCGTTTCACAGTGTCCCAA<br>GACCAGGCCAAGAACACAGTTTACCTTCAGATGAACTCTGAAGCCAGACGAA<br>ACCGCCATGTACTATTGCGCCGCAGAATCTGCTTCTAGCTTCAGCTGCGGCGGT<br>TGGCTGACACGCCCGGACCGCGTGCCGTACTGGGGCAGGGCACACAGGTAACC<br>GTGTCCTCTGGCGGGAGTGGCGGGTCCGGCGGTAGCGGCCAAGTCCAGCTCCAG<br>GAGTCAGGCGGAGGCTCCGTCCAGGCTGGTGGCAGCTTGAGGTTGTCCTGCACT<br>GCTCCTGGTTTTACATCTAACTCCTGCGGCATGGATTGGTATCGCCAGGCTCCC |

TABLE 1B-continued

| Name | SEQ ID NO: | Sequence |
|---|---|---|
| | | GGAAAGGAGCGCGAGTTCGTGTCCTCTATTAGTACCGATGGCACTACCGGGTAT<br>GCCGACTCTGTTAAGGGTCGTTTCACAATCAGTAAAGATAAGGCCAAGGACACA<br>GTGTACTTGCAGATGAACTCACTGAAACCAGAGGATCAGGCATGTATAGCTGT<br>AAGACCAAAGACGGGACCATCGCAACTATGGAGCTGTGCGATTTCGGCTACTGG<br>GGCCAGGGCACCCAGGTAACCGTCAGCTCA |
| hIL27Ra_<br>VH<br>H16-<br>DR593 | 1427 | CAGGTACAGTTGCAGGAGTCCGGCGGGGGAAGCGTGCAGGCTGGAGGTAGCCTG<br>CGTCTGAGCTGTCGCGCCAGCGGCTCCACCTACTCAAACTACTGTCTTGGATGG<br>TTCCGTCAGATTACTGGCAAGGAGAGGGAAGGGGTCGCCGTTATCAACTGGGTG<br>GGCGGTATGCTGTACTTTCGCCGACTCTGTTAAAGGCCGTTTCACAGTGAGCCAG<br>GATCAGGCCAAGAACACCGTCTACCTTCAGATGAACTCTTTGAAGCCTGAAGAT<br>ACGGCCATGTATTACTGTGCAGCCGAGTCTGCCTCCAGCTTCTCCTGCGGGGGC<br>TGGCTCACACGCCCCGACCGTGTGCCTTATTGGGACAGGGGACACAAGTCACT<br>GTCCTCCTCTGGAGGGGGATCTCAAGTGCAGCTGCAAGAGTCTGGAGGCGGTAGC<br>GTGCAGGCTGGCGGGTCCCTCAGACTGAGCTGTGCTGCCTCCGGTTACCCCTAC<br>TCCAACGGATATATGGGCTGGTTCCGCCAGGCACCAGGCAAGGAGCGCGAGGGC<br>GTGGCTACATCTATACAGGTGATGGCCGCACCTATTACGCTGATTCCGTGAAG<br>GGTCGCTTCACCATCAGCCGCGACAATGCTAAGAACACCGTGGACCTTCAGATG<br>TCTAGCCTCAAGCCTGAGGACACTGCAATGTATTACTGTGCTGCACGGGCAGCG<br>CCCCTTTATTCCTCTGGCTCCCTCTCACCCGCGCACGTTACAACGTATGGGGT<br>CAAGGCACCCAGGTGACTGTCTCCAGC |
| hIL27Ra_<br>VH<br>H16-<br>DR593 | 1428 | CAGGTCCAGCTCCAGGAGAGTGGTGGCGGGTCAGTGCAGGCGGGAGGCTCACTG<br>CGTCTGTCCTGTCGGGCCTCCGGCTCCACTTACTCTAACTATTGCTTGGGCTGG<br>TTCAGGCAGATTACAGGTAAGGAGCGCGAAGGGGTGGCTGTTATCAACTGGGTA<br>GGGGGTATGCTGTATTTCGCCGATTCAGTTAAGGGCCGTTTCACAGTGAGTCAG<br>GATCAGGCCAAAAACACTGTTTATCTTCAAATGAACTCCCTGAAGGTCCCGAGGAC<br>ACCGCGATGTACTATTGCGCAGCCGAGAGCGCCTCTAGCTTCAGCTGTGGGGGT<br>TGGCTGACACGGCCTGACCGCGTCCCTTATTGGGGCCAGGGAACCCAAGTGACC<br>GTGTCTAGCGGAGGCTCCGGCGGATCTGGAGGTTCCGGTCAGGTGCAGTTGCAA<br>GAGTCCGGCGGAGGCTCTGTGCAGGCGGGTGGCAGCCTGCGCCTGTCCTGCGCG<br>GCCTCTGGATATCCGTACAGCAACGGCTACATGGGCTGGTTCAGACAAGCACCG<br>GGGAAAGAGAGAGGGCGTGGCCACCATCTACACCGGGGACGGGCGTACTTAC<br>TATGCCGACAGTGTAAAGGGGCGCTTCACTATCTCACGCGACAATGCGAAAAAC<br>ACAGTGGACCTCCAGATGTCAAGTTTGAAGCCGGAGGACACTGCAATGTATTAC<br>TGTGCTGCCAGAGCCGCACCTCTGTACTCCAGCGGCTCTCCTCTGACTCGTGCC<br>CGCTACAACGTGTGGGTCAGGGCACTCAGGTCACAGTCAGCAGT |
| hIL27Ra_<br>VH<br>H16-<br>DR594 | 1429 | CAAGTGCAGCTCCAGGAATCTGGAGGCGGAAGCGTCCAGGCGGGCGGTTCTCTG<br>CGTCTGTCTTGTCGGGCCAGCGGCTCTACTTACTCTAATTACTGTCTGGGTTGG<br>TTCCGCCAGATCACTGGTAAGGAGAGAGAGGGGGTGGCCGTTATCAACTGGGTC<br>GGCGGGATGCTGTACTTTGCTGATTCAGTGAAAGGCCGGTTCACAGTAAGCCAG<br>GATCAGGCCAAGAACACAGTTTACCTCCAGATGAACTCTTTGAAGCCTGAGGAC<br>ACCGCCATGTACTATTGTGCGGCAGAATCCGCCTCTAGCTTCAGCTGTGGCGGT<br>TGGCTGACCCGTCCTGACAGAGTGCCATACTGGGGCCAGGGCACCCAGGTGACA<br>GTGTCCTCTGGCGGAGGCTCCCAGGTGCAGCTCCAGGAATCAGGGGGAGGCAGT<br>GTGCAGGCGGGTGGCTCCCTGAGATTGTCCTGTGTCGCCAGCGCGTCCACCTAT<br>TGCACCTACGATATGCACTGGTACAGACAGGCACCCGGAAAGGGCCGTGAGTTT<br>GTGAGTGCTATTGATTCCGACGGTACAACTCGCTACGCGGATTCAGTGAAAGGG<br>AGATTCACGATTTCTCAAGGCACGGCCAAGAATACTGTGTACCTCCAGATGAAC<br>AGCCTCCAGCCAGAAGACACGGCTATGTACTATTGCAAGACCGTGTGTGGTC<br>GGCAGCAGGTGGTCCGACTATTGGGGCCAGGGTACACAGGTGACCGTGAGCAGC |
| hIL27Ra_<br>VH<br>H16-<br>DR594 | 1430 | CAAGTGCAACTCCAGGAGAGCGGCGGTGGCTCCGTGCAGGCGGGCGGAAGCCTC<br>CGCCTTAGTTGCAGAGCGAGCGGCAGCACCTACTCCAACTACTGCTTGGGCTGG<br>TTTAGACAGATTACGGGCAAGGAACGTGAGGGTGTCGCCGTAATCAACTGGGTT<br>GGCGGTATGCTCTACTTTGCTGACTCCGTTAAGGGACGCTTTACTGTTTCTCAG<br>GATCAGGCGAAGAACACCGTCTACCTTCAGATGAACTCCCTCAAACCCGAGGAC<br>ACCGCTATGTACTATTGCGCAGCCGAATCTGCAAGCTCTTTCTCATGCGGTGGG<br>TGGCTGACCCGCCCGGACCGTGTGCCTTACTGGGGCCAGGGGACACAGGTGACC<br>GTTAGCTCCGGGGGCTCCGGGGGTTCAGGTGGATCTGGGCAGGTTCAGCTGCAA<br>GAGTCAGGTGGGGCTCTGTCCAAGCCGGGGATCTCTGAGACTGTCATGCGTG<br>GCCTCCGCATCAACCTACTGCACCTATGATATGCACTGGTATCGCCAAGCTCCG<br>GGTAAAGGCAGGGAGTTTGTGAGCGCCATCGACAGCGATGGAACGACCCGCTAC<br>GCCGATAGCGTGAAGGGGAGATTTACTATTTCCCAAGGAACAGCCAAAAACACA<br>GTCTACCTTCAGATGAACTCCCTGCAACCCGAAGACACAGCCATGTATTACTGC<br>AAGACAGTTTGCGTGGTTGGTTCCCGTTGGAGCGACTACTGGGGCCAGGGCACC<br>CAGGTGACTGTCTCCTCT |
| hIL27Ra_<br>VH<br>H16-<br>DR595 | 1431 | CAGGTCCAGCTGCAAGAATCAGGCGGTGGGTCCGTGCAAGCTGGTGGATCTCTC<br>CGTCTGTCTTGCCGCGCTTCTGGAAGCACTTATTCAAATTATTGCCTGGGCTGG<br>TTTAGGCAGATTACTGGGAAGGAGCGCGAGGGCGTCGCCGTGATAAATTGGGTC<br>GGTGGGATGCTGTATTTCGCGGACAGCGTGAAGGGCCGGTTCACAGTCTCCCAA<br>GATCAGGCTAAGAACACAGTGTACTTGCAGATGAACTCCCTGAAGCCAGAGGAC<br>ACTGCCATGTACTATTGCGCGGCTGAAAGCGCCTCTTCCTTCTCCTGTGGGGGC<br>TGGCTCACACGCCCAGATCGCGTACCATACTGGGTCAGGGCACACAGGTGACC<br>GTGTCATCTGGTGGCGGGAGCCAGGTGCAGCTCCAGGAGTCAGGAGGCGGGTCC |

TABLE 1B-continued

| Name | SEQ ID NO: | Sequence |
|---|---|---|
| | | GTACAGGCTGGTGGCTCCCTGACCCTGTCTTGCGCTGCATCAGAGTACGCCTAC<br>TCCACCTGCAACATGGGTTGGTATCGTCAGGCTCCCGGCAAAGAAGGGAACTC<br>GTGAGTGCCTTCATTAGCGATGGATCAACCTATTACGCGGACTCCGTGAAGGGC<br>CGCTTCACCATCACCCGCGACAACGCGAAAAATACGGTCTACTTGCAGATGAAT<br>AGTCTGAAACCAGAGGACACAGCCATCTATTACTGCTCTGCCAACTGTTACCGT<br>CGCCTGCGGAATTATTGGGGCCAGGGCACCCAGGTGACTGTCTCCTCT |
| hIL27Ra_<br>VH<br>H16-<br>DR595 | 1432 | CAGGTCCAGTTGCAGGAGTCCGGGGGTGGCTCTGTCCAAGCAGGTGGCAGCCTG<br>CGGCTGTCTTGCCGCGCGAGCGGGTCCACTTATAGTAACTATTGCCTGGGCTGG<br>TTTCGTCAGATCACAGGCAAGGAGCGCGAAGGCGTCGCCGTTATCAACTGGGTG<br>GGCGGGATGCTGTATTTCGCCGACAGCGTGAAGGGACGTTTTACAGTGTCACAG<br>GACCAGGCCAAGAACACCGTCTACCTCCAGATGAACTCCCTGAAGCCTGAAGAC<br>ACTGCCATGTACTATTGTGCCGCAGAGTCAGCCAGCTCCTTCAGCTGCGGCGGA<br>TGGTTGACCCGCCCGGACAGGGTTCCCTACTGGGGTCAGGGCACTCAGGTTACG<br>GTGAGCAGTGGTGGCTCTGGTGGCTCTGGAGGCTCCGGCCAGGTGCAGCTTCAG<br>GAGAGTGGCGGTGGAAGTGTGCAAGCGGGAGGTAGTCTGACCCTCTCTTGCGCT<br>GCCTCTGAATACGCATACAGTACATGCAATATGGGATGGTATCGCCAGGCCCCT<br>GGCAAAGAGCGTGAACTCGTGAGCGCCTTCATCTCAGATGGGAGCACCTATTAC<br>GCTGACTCTGTCAAGGGCAGGTTCACGATTACCCGCGATAACGCAAAGAACACC<br>GTGTATTTGCAGATGAACTCCCTGAAGCCTGAAGACACAGCCATTTATTACTGC<br>TCCGCCAACTGTTATCGCAGACTGCGGAACTATTGGGGCCAGGGCACCCAGGTC<br>ACCGTGTCTTCC |
| hIL27Ra_<br>VH<br>H16-<br>DR596 | 1433 | CAGGTGCAGTTGCAGGAGTCTGGAGGTGGCTCCGTCCAGGCTGGTGGCTCTCTG<br>CGGCTGAGCTGCCGCGCGAGTGGCAGCACCTACTCCAACTACTGCCTGGGCTGG<br>TTTCGCCAGATTACAGGAAAGGAGAGAGAGGGAGTGGCCGTCATCAACTGGGTG<br>GGCGGGATGTTGTATTTCGCTGACAGTGTGAAGGGAAGATTTACCGTTAGTCAG<br>GACCAGGCTAAGAACACCGTATACCTCCAGATGAACTCTCTGAAGCCAGAGGAT<br>ACAGCCATGTACTATTGTGCCGCAGAGTCTGCCTCCTCTTTTTCATGCGGCGGG<br>TGGTTGACTCGCCCAGACAGAGTACCATACTGGGGCCAGGGGACCCAAGTGACC<br>GTCTCCAGCGGCGGGGGCAGCCAGGTCCAGCTCCAGGAGTCAGGTGGCGGGCTG<br>GTCCAGCCTGGCGGTTCTCTGCGCCTGTCCTGCACCGCCAGTGGGCTCACCTTC<br>GATGACTCCGTGATGGGTTGGTTCCGGCAGGCTCCGGGTAAGGGACGTGAGGCT<br>GTGTCCTGTATTTCTTCCAGCGGAGCCAACGCATTTTATGCGGACAGTGTAAAG<br>GGTCGCTTTACCATCAGTCGTGACAACGCCAAGAACACCCTCTATCTTCAGATG<br>AACTCCCTGAAGCCAGAGGATACTGCCACGTATTACTGCAAGCGTGGTCATGCG<br>TGCGCAGGCTATTACCCCATCCCCTACGACGATTATTGGGGCCAAGGCACGCAG<br>GTGACCGTTTCCTCC |
| hIL27Ra_<br>VH<br>H16-<br>DR596 | 1434 | CAGGTGCAGCTTCAGGAGTCCGGTGGGGGCAGCGTGCAAGCTGGAGGCAGTCTG<br>AGGCTGAGCTGTCGTGCGTCAGGGTCTACCTACTCCAACTATTGTCTGGGCTGG<br>TTTCGCCAGATCACTGGTAAGGAGCGCGAGGGCGTTGCCGTTATCAACTGGGTC<br>GGAGGTATGCTGTACTTCGCTGACTCCGTGAAGGGACGTTTCACTGTGAGCCAG<br>GATCAGGCCAAGAACACCGTGTACCTCCAGATGAACAGCCTGAAGCCTGAAGAT<br>ACCGCCATGTATTACTGTGCAGCCGAATCCGCCTCTTCCTTTAGCTGTGGGGGC<br>TGGCTGACTAGGCCTGACCGCGTGCCTTACTGGGGCCAGGGGACCCAAGTAACC<br>GTCAGCTCTGGTGGCAGCGGAGGTAGCGGTGGGAGTGGCCAGGTTCAGCTTCAG<br>GAGAGCGGTGGAGGTCTGGTGCAGCCAGGGGGTAGTCTGCGCCTTAGCTGCACT<br>GCCTCCGGTCTGACCTTCGATGACAGTGTGATGGGTTGGTTTCGTCAGGCTCCA<br>GGCAAGGGGCGCGAAGCAGTGTCTTGTATCAGCTCCAGCGGCGCTAATGCCTTT<br>TACGCCGATTCCGTGAAAGGCCGCTTTACGATTAGCCGCGATAACGCCAAGAAC<br>ACACTGTATTTGCAGATGAACAGCCTCAAACCCGAAGACACGGCCACCTACTAT<br>TGTAAGCGGGTCATGCCTGCGCTGGGTATTACCCAATTCCCTACGATGACTAT<br>TGGGGGCAGGGCACCCAGGTTACTGTCTCCTCC |
| hIL27Ra_<br>VH<br>H17-<br>DR591 | 1435 | CAGGTTCAGTTGCAGGAAACGGGAGGTGGCTTGGTGCAGCCCGGTGGCTCTCTC<br>CGTCTGTCTTGCGCGGCCAGTGGGTTCACATTCTCCCTGAGCGGAATGTCTTGG<br>GTGCGTCAGGCCCCAGGCAAAGGTCTGGAATGGGTTAGCGCGATCAGCTCTGGT<br>GGCGCTTCCACCTACTATACGGACAGCGTTAAGGGCAGATTTACTATTTCTCGC<br>GACAACGCCAAGAACATGCTTTACCTCCAGTTGAACAGCCTGAAGACCGAAGAT<br>ACCGCTATGTATTACTGTGCCAAGGGTGGGTCCGGCTACGGCGATGCCTCCCGT<br>ATGACATCCCTGGCAGCCAGGGCACTCAAGTGACCGTGTCCAGCGGCGGTGGC<br>AGTCAAGTCCAGCTCCAGGAGTCTGGGGGTGGATCTGTCCAGGCCGGGGGCTCC<br>CTCCGCCTGAGTTGCACTGCGAGCGGTGCTATCGCCAGCGGCTACATCGACTCC<br>AGGTGGTGCATGGCCTGGTTCCGCCAGGCTCCGGGAAAAGAGCGTGAGGGTGTT<br>GCCGCTATCTGGCCCGGAGGCGGGCTGACCGTCTATGCCGACTCCGTAAAGGGC<br>CGGTTCACCATCAGCCGCGACCATGCCAAGAACACCCTGTACCTTCAGATGAAT<br>AACTTGAAACCTGAGGACACTGCTATGTATTACTGCGCGGCTGGTAGCCCTCGC<br>ATGTGCCCGAGCCTGGAATTTGGGTTCGATTACTGGGGACAGGGCACCCAGGTC<br>ACGGTGTCCAGC |
| hIL27Ra_<br>VH<br>H17-<br>DR591 | 1436 | CAGGTGCAGTTGCAAGAAAGTGGCGGGGGTCTGGTACAGCCTGGAGGCTCTCTG<br>CGCCTCTCCTGTGCTGCCAGCGGCTTTACTTTTAGCCTGTCAGGTATGTCCTGG<br>GTCCGCCAGGCCCCCGGTAAAGGTCTTGAGTGGGTCTCCGCTATTTCCAGCGGA<br>GGTGCCAGTACCTATTACACCGACTCAGTGAAAGGACGTTTCACCATTTCCCGC<br>GATAATGCTAAGAATATGTTGTATTTGCAGCTCAACAGCCTGAAGACAGAGGAT<br>ACCGCTATGTACTATTGCGCTAAAGGCGGATCTGGTTATGGAGACGCCTCCCGT |

TABLE 1B-continued

| Name | SEQ ID NO: | Sequence |
|---|---|---|
| | | ATGACATCCCTGGGTCTCAGGGAACGCAGGTGACCGTGTCTAGCGGCGGGTCT<br>GGAGGCTCCGGTGGCTCCGGCCAGGTCCAGCTCCAGGAAAGCGGTGGCGGGTCT<br>GTGCAGGCAGGCGGTTCCCTGAGGCTGAGCTGCACAGCCTCCGGGGCAATCGCC<br>AGCGGTTATATCGACAGCAGATGGTGCATGGCCTGGTTCCGTCAGGCCCCCGGC<br>AAAGAGAGGGAGGGAGTGGCGGCCATCTGGCCAGGAGGCGGACTGACCGTGTAT<br>GCCGACTCTGTGAAGGGTCGCTTTACCATCAGCAGAGACCACGCCAAGAACACC<br>CTGTACTTGCAGATGAATAACCTCAAGCCCGAGGACACCGCAATGTATTACTGC<br>GCCGCAGGCAGCCCTCGCATGTGTCCGTCTCTGGAGTTCGGATTCGATTACTGG<br>GGCCAGGGGACCCAGGTGACCGTTTCCTCC |
| hIL27Ra_<br>VH<br>H17-<br>DR592 | 1437 | CAAGTGCAGCTCCAGGAGTCAGGTGGAGGCCTGGTTCAGCCTGGGGGAAGTCTG<br>CGCCTTTCATGTGCAGCTTCTGGTTTTACCTTCTCTCTGAGCGGCATGTCCTGG<br>GTCCGGCAGGCACCGGGCAAGGGCCTGGAGTGGGTGAGTGCCATCTCATCTGGC<br>GGTGCGAGCACCTACTATACGACTCTGTTAAAGGAAGGTTTACCATCTCCCGC<br>GATAACGCTAAAAATATGTTGTACTTGCAGCTCAACTCACTGAAGACCGAAGAC<br>ACCGCTATGTATTACTGCGCCAAGGGTGCTCCGGGTACGGCGATGCCTCCCGC<br>ATGACCAGCCCCGGTAGTCAGGGCACTCAGGTCACTGTTAGCTCCGGCGGTGGC<br>TCTCAGGTCCAGCTCCAGGAGTCTGGTGGAGGCTCCGTGCAGGCTGGCGGTTCC<br>CTGAGATTGTCTTGTACTGCCCCCGGCTTCACAAGTAACTCCTGTGGTATGGAC<br>TGGTATCGTCAAGCGCCTGGAAAGGAGCGCGAGTTCGTTAGCTCCATTTCTACC<br>GATGGGACCACTGGGTATGCAGACAGCGTGAAAGGTCGCTTTACCATCTCCAAG<br>GACAAGGCTAAGGACACCGTGTACCTCCAAATGAACTCCCTGAAGCCCGAGGAC<br>ACCGGGATGTATTCCTGCAAGACCAAGGACGGGACCATCGCCACTATGGAGTTG<br>TGTGACTTCGGATATTGGGGGCAGGGCACCCAAGTGACTGTGTCTAGC |
| hIL27Ra_<br>VH<br>H17-<br>DR592 | 1438 | CAGGTCCAGCTTCAGGAGTCTGGCGGGGGTCTGGTCCAGCCTGGGGGTTCTCTC<br>CGCCTGTCCTGCGCAGCTAGTGGATTCACCTTCTCTCTCTCCGGTATGTCTTGG<br>GTGCGCCAGGCCCCTGGCAAGGGGCTGGAGTGGGTGAGTGCAATTAGCTCCGGG<br>GGAGCAAGCACCTACTATACAGACTCAGTCAAGGGAAGATTCACAATTTCCCGC<br>GATAACGCTAAAAACATGCTGTATCTCCAGCTCAACAGCCTGAAGACCGGAAGAC<br>ACGGCTATGTACTATTGTGCCAAAGGGGGCAGCGGCTATGGCGACGCCAGCCGC<br>ATGACCCTCCGGGCAGCCAGGGTACGCAGGTGACCGTGTCCAGCGGAGGCTCC<br>GGGGGGCTCTGGAGGTTCAGGGCAGGTACAGCTCCAAGAATCCGGGGCCGGTTCT<br>GTGCAGGCTGGAGGCTCCCTGCGCCTGAGCTGCACAGCTCCGGGCTTTACCTCC<br>AACAGTTGCGGAATGGATTGGTACAGGCAAGCGCCCGGCAAGGAGAGGGAGTTC<br>GTGTCCAGTATTTCAACCGACGGCACAACCGGCTACGCGGATTCCGTGAAAGGA<br>CGCTTCACCATTTCCAAAGACAAGGCCAAGGACACCGTGTATTTGCAGATGAAC<br>TCACTGAAGCCCGAGGATACCGGAATGTATTCTTGTAAAACGAAGGATGGGACC<br>ATCGCTACAATGGAGCTGTGTGACTTTGGTTACTGGGGCCAGGGCACTCAGGTC<br>ACTGTCTCTTCT |
| hIL27Ra_<br>VH<br>H17-<br>DR593 | 1439 | CAGGTGCAGCTCCAGGAAAGCGGTGGCGGTTTGGTGCAGCCTGGGGGCTCCCTG<br>CGCCTGTCTTGTGCGGCTAGTGGCTTCACCTTCTCTCTGCACGGCATGAGCTGG<br>GTGCGGCAAGCGCCGGGCAAGGGCCTCGAATGGGTGAGCGCAATCAGCTCTGGA<br>GGCGCATCAACCTACTATACCGATTCAGTCAAGGGAAGGTTTACCATCTCCAGA<br>GATAACGCCAAGAATATGCTGTACCTCCAGCTCAATTCACTGAAGACCGAGGAT<br>ACCGCCATGTATTACTGCGCTAAGGGTGGCAGCGGATACGGAGATGCGTCCCGC<br>ATGACAAGCCCCGGCTCACAGGGCACACAGGTGACTGTGTCCTCAGGAGGTGGC<br>TCCCAAGTGCAGCTTCAGGAGAGCGGTGGAGGCTCCGTCCAAGCTGGAGGGTCC<br>CTCCGTCTCTCTTGTGCAGCTTCCGGCTATCCTTACTCCAATGGGTACATGGGA<br>TGGTTCCGCCAAGCTCCTGGCAAGGAGAGGGAGGGGGTGGCTACCATCTACACT<br>GGCGATGGCCGCACCTATTACGCCGACAGCGTGAAAGGACGTTTCACCATTTCC<br>CGTGACAATGCAAAGAACACTGTGGACCTCCAGATGTCAAGCCTCAAGCCAGAA<br>GACACCGCGATGTACTATTGTGCTGCCAGAGCAGCGCCCCTGTATTCTTCAGGC<br>TCTCCCCTGACACGCGCACGTTACAACGTCTGGGGCCAGGGTACTCAGGTCACC<br>GTGTCTAGC |
| hIL27Ra_<br>VH<br>H17-<br>DR593 | 1440 | CAGGTGCAGCTCCAGGAATCCGGCGGAGGCCTGGTCCAGCCCGGCGGGTCTCTG<br>CGCCTGTCTTGTGCTGCCAGCGGCTTCACCTTCAGTCTGAGTGGAATGAGCTGG<br>GTGCGTCAGGCTCCAGGAAAGGGCCTGGAGTGGGTGTCCGCCATTAGCTCTGGA<br>GGCGCGTCCACATATTACACCGATAGCGTAAAAGGCCGTTTCACTATCTCACGC<br>GACAACGCTAAGAATATGCTGTATCTCCAGCTGAACTCCCTGAAAACCGAGGAT<br>ACGGCCATGTATTACTGTGCGAAAGGGGTTCAGGGTACGGCGACGCATCCAGG<br>ATGACCAGCCCAGGTTCCCAAGGGACCCAGGTGACAGTGTCTTCCGGCGGAAGC<br>GGAGGCTCCGGTGGCAGCGGCCAGGTCAGTTGCAGGAATCTGGCGGTGGGAGC<br>GTGCAGGCTGGCGGGAGCCTGCGCCTGAGCTGTCTGCAGCGGCTACCCCTAT<br>TCTAACGGGTACATGGGTTGGTTCCGGCAGGCTCCCGGTAAAGAGCGCGAGGGA<br>GTGGCCACGATTTACACGGGTGATGGGCGCACTTATTACGCAGACTCCGTTAAG<br>GGCCGGTTTACCATTAGTCGTGATAACGCGAAGAACACCGTGGACCTTCAGATG<br>TCCAGCTTGAAGCCAGAGGACACCGCTATGTATTACTGTGCTGCACGCGCTGCG<br>CCTCTCTACAGTAGCGGCTCCCCTCTGACCCGCGCTCGCTATAACGTGTGGGGC<br>CAGGGCACTCAGGTGACAGTAAGCTCC |
| hIL27Ra_<br>VH<br>H17-<br>DR594 | 1441 | CAAGTTCAGCTCCAGGAGTCTGGAGGCGGTCTCGTGCAGCCCGGTGGCTCCCTC<br>CGCCTGTCTTGCGCCGCGAGCGGCTTCACCTTCTCTTTGAGCGGAATGAGCTGG<br>GTCAGGCAGGCTCCCGGCAAAGCCTGGAGTGGGTGTCCGCCATTAGTAGCGGC<br>GGAGCCTCTACCTATTACACCGATTCTGTGAAGGGTCGTTTCACCATTTCTCGC |

TABLE 1B-continued

| Name | SEQ ID NO: | Sequence |
|---|---|---|
| | | GATAACGCAAAGAACATGCTGTACCTCCAGCTGAACTCTCTGAAGACCGAGGAT<br>ACTGCAATGTATTACTGCGCCAAAGGCGGTAGTGGTTACGGTGACGCCAGCAGG<br>ATGACCTCCCCAGGATCACAGGGAACCCAGGTCACCGTCAGCTCTGGTGGAGGC<br>AGCCAGGTGCAGTTGCAGGAAAGCGGCGGAGGCAGTGTGCAGGCCGGAGGGTCT<br>CTGAGGCTCTCTTGCGTCGCCAGCGCCTCCACTTACTGCACTTATGACATGCAC<br>TGGTATCGGCAAGCTCCTGGGAAGGGCCGTGAATTTGTGAGCGCTATCGACAGC<br>GACGGCACCACTAGGTATGCTGATTCTGTGAAAGGGAGGTTTACCATTTCCCAG<br>GGCACCGCCAAGAACACGGTGTATCTCCAGATGAACTCTCTCCAGCCGGAAGAC<br>ACTGCCATGTATTACTGTAAGACCGTGTGCGTGGTCGGATCTCGCTGGTCTGAT<br>TATTGGGGCCAGGGAACCCAGGTGACGGTTTCTTCC |
| hIL27Ra_<br>VH<br>H17-<br>DR594 | 1442 | CAGGTCCAGTTGCAGGAGTCCGGCGGAGGGCTGGTACAGCCCGGCGGAAGCCTG<br>CGCCTGAGTTGCGCCGCGTCTGGATTTACTTTCTCTCTCTGGTATGAGCTGG<br>GTGCGCCAGGCTCCCGGCAAGGGACTTGAGTGGGTAAGCGCAATCTCCTCTGGC<br>GGGGCGAGCACCTATTACACCGACAGCGTTAAGGGCAGGTTCACAATTAGCCGT<br>GACAACGCTAAGAATATGCTTTATCTTCAGCTGAACAGCCTGAAGACTGAAGAC<br>ACGGCCATGTATTACTGTGCCAAGGGCGGTTCCGGCTACGGAGACGCTAGTCGC<br>ATGACCTCCCCAGGCTCCCAGGGCACCCAGGTCACCGTGTCTAGCGGAGGCTCT<br>GGCGGTAGTGGTGGCTCCGGTCAGGTGCAACTTCAGGAGAGTGGCGGTGGCTCC<br>GTTCAAGCTGGGGGTTCCCTGCGTCTGTCTTGTGTCGCTAGTGCGTCCACTTAT<br>TGCACCTACGACATGCACTGGTATCGTCAAGCGCCGGGCAAGGGAAGGGAGTTC<br>GTCAGCGCCATTGATTCCGACGGCACCACTCGCTACGCCGACTCTGTCAAGGGA<br>CGCTTCACCATCTCCCAGGGCACTGCCAAAAATACCGTGTATTTGCAGATGAAC<br>TCACTTCAGCCAGAGGACACTGCCATGTATTACTGCAAGACCGTCTGCGTCGTG<br>GGCAGCAGGTGGTCTGATTACTGGGGCAAGGCACCCAGGTGACCGTCAGCAGC |
| hIL27Ra_<br>VH<br>H17-<br>DR595 | 1443 | CAGGTGCAACTTCAGGAATCAGGCGGGGGACTGGTGCAGCCAGGTGGCTCTCTG<br>CGCCTCAGCTGTGCGGCCTCTGGCTTTACCTTCTCTTTGAGCGGTATGAGTTGG<br>GTGCGCCAGGCTCCGGGAAAAGGTCTGGAGTGGGTCTCTGCCATCTCTTCCGGC<br>GGTGCCTCCACGTACTATACCGACTCCGTGAAGGGCCGGTTTACCATTTCCAGG<br>GACAACGCCAAGAACATGCTTTATCTCCAGCTGAACTCTCTGAAGACAGAAGAT<br>ACCGCCATGTACTATTGCGCCAAAGGTGCTCCGGTTACGGCGACGCGAGCCGC<br>ATGACTAGCCCTGGCTCCCAGGGAACCCAGGTCACAGTGTCCTCTGGCGGTGGC<br>TCTCAGGTCCAGCTCCAGGAGTCTGGTGGCGGGTCCGTGCAGGCCGGTGGCTCC<br>CTGACCCTGTCTTGTGCTGCCAGTGAGTATGCGTACAGTACCTGTAATATGGGT<br>TGGTACAGGCAAGCGCCCGGCAAGGAACGCGAGCTGGTCTCCGCTTTTATCTCC<br>GACGGAAGCACCTATTACGCAGACTCAGTGAAGGGTCGTTTCACCATCACCCGT<br>GATAATGCTAAAAACACTGTGTACCTCCAGATGAATAGTCTGAAGCCCGAGGAT<br>ACCGCTATTTATTACTGCTCCGCCAACTGTTACCGTCGCCTGAGAAACTACTGG<br>GGACAAGGCACCCAGGTAACCGTCAGCTCT |
| hIL27Ra_<br>VH<br>H17-<br>DR595 | 1444 | CAGGTGCAGTTGCAGGAGTCTGGCGGAGGTCTGGTACAGCCTGGTGGCAGCCTC<br>CGCTTGAGCTGCGCGGCCAGTGGCTTCACTTTTTCCCTGTCAGGCATGAGCTGG<br>GTGCGTCAGGCTCCTGGCAAAGGACTGGAGTGGGTGTCCGCTATCTCCTCTGGA<br>GGCGCATCCACTTATTACACCGATTCTGTCAAAGGTCGTTTCACCATTTCCCGC<br>GATAATGCTAAGAACATGCTGTATTTGCAGTTGAACTCCCTGAAGACAGAGGAC<br>ACCGCTATGTATTACTGCGCTAAGGGTGGCAGCGGGTATGGGGATGCCAGCCGC<br>ATGACAAGCCCCGGCTCCCAGGGTACACAGGTCACCGTCTCCTCAGGAGGCAGT<br>GGAGGTAGCGGGGGCTCCGGCCAAGTCCAGCTCCAGGAGTCCGGGGGTGGATCT<br>GTCCAGGCCGGGGGCAGTCTCACTCTGTCCTGTGCCGCTTCAGAGTACGCCTAT<br>AGTACCTGTAACATGGGCTGGTATAGGCAGGCTCCCGGCAAGGAGAGAGAACTG<br>GTCAGCGCGTTTATCTCCGACGGCAGTACCTACTATGCTGACTCTGTGAAGGGA<br>CGTTTTACCATCACCCGCGACAACGCCAAGAATACCGTCTACCTCCAGATGAAC<br>TCTCTCAAACCGGAGGACACCGCCATCTATTACTGCTCTGCAAACTGTTATAGA<br>AGGCTGCGTAACTACTGGGGACAAGGCACGCAAGTGACAGTGTCCTCA |
| hIL27Ra_<br>VH<br>H17-<br>DR596 | 1445 | CAGGTGCAGTTGCAGGAGAGCGGTGGCGGTCTCGTGCAGCCAGGTGGCTCTCTG<br>CGGCTGAGTTGCGCTGCCTCTGGCTTCACATTCTCTCTGTCCGGCATGTCTTGG<br>GTGCGCCAGGCTCCGGGTAAAGGGCTGGAGTGGGTGAGCGCAATCTCCTCTGGA<br>GGTGCATCCACCTATTACACCGACTCTGTGAAGGGTCGCTTTACCATCTCCCGC<br>GACAACGCAAAGAATATGCTTTACCTGCAACTGAACTCCCTGAAAACAGAGGAC<br>ACGGCCATGTACTATTGTGCCAAGGGCGGGTCTGGCTACGGCGACGCTTCCAGG<br>ATGACCAGTCCGGGCTCTCAGGGCACCCAGGTGACAGTCTCTAGCGGTGGGGGC<br>TCCCAGGTCCAGCTTCAGGAAAGCGGAGGTGGCCTTGTTCAACCGGGCGGTTCA<br>CTTCGCTTGAGCTGCACAGCTTCAGGTCTGACCTTCGACGATTCTGTCATGGGC<br>TGGTTTAGGCAGGCCCCTGGGAAGGGCAGAGAAGCGGTGTCTTGTATCAGTTCC<br>TCAGGGGCCAACGCTTTCTATGCAGACTCCGTGAAGGGACGTTTTACAATTTCA<br>CGCGATAATGCCAAGAACACATTGTACCTCCAGATGAACTCCCTGAAACCCGAG<br>GACACTGCTACATACTATTGTAAACGCGGCCACGCTTGTGCAGGCTACTATCCC<br>ATCCCTTACGATGACTACTGGGGTCAGGGAACCCAGGTTACCGTTAGCTCC |
| hIL27Ra_<br>VH<br>H17-<br>DR596 | 1446 | CAGGTTCAGCTCCAGGAGAGCGGAGGTGGCCTGGTTCAGCCTGGTGGCAGCCTG<br>CGCCTGTCTTGCGCTGCCAGCGGTTTTACCTTTAGTTTGTCCGGTATGTCATGG<br>GTTCGTCAAGCTCCTGGCAAGGGTCTCGAATGGGTGTCCGCGATTTCCTCAGGA<br>GGTGCCTCTACTTATTACACCGATAGTGTGAAGGGTCGCTTTACTATCTCTCGC<br>GACAACGCGAAGAACATGCTGTACCTCCAACTGAACAGCCTGAAGACTGAAGAT<br>ACCGCGATGTACTATTGCGCGAAGGGAGGCTCTGGGTATGGAGATGCCTCCCGT |

TABLE 1B-continued

| Name | SEQ ID NO: | Sequence |
|---|---|---|
| | | ATGACATCTCCTGGCTCTCAAGGCACCCAGGTGACCGTCTCCAGCGGCGGTTCC<br>GGGGGCTCAGGGGGATCTGGCCAGGTTCAGTTGCAGGAGTCCGGCGGTGGCCTG<br>GTCCAACCGGGCGGGAGCCTGAGGCTGTCCTGCACTGCGAGCGGGTTGACATTC<br>GACGATAGCGTGATGGGTTGGTTTCGCCAGGCTCCCGGAAAGGGTCGGGAGGCC<br>GTCAGCTGTATCTCCAGCAGTGGGGCTAATGCCTTCTACGCCGATTCCGTTAAA<br>GGGGAGATTTACCATCTCACGGGATAACGCTAAGAACACGCTGTACTTGCAGATG<br>AACAGTCTCAAGCCAGAGGACACAGCGACTTACTATTGTAAACGCGGACATGCC<br>TGTGCCGGGTACTATCCTATTCCCTACGATGACTATTGGGGTCAGGGCACCCAG<br>GTGACCGTATCTTCT |
| hIL27Ra_<br>VH<br>H18-<br>DR591 | 1447 | CAGGTTCAGTTGCAAGAGTCCGGCGGTGGAAGCGTCCAGGCCGGGGGTAGTCTT<br>CGGCTGTCATGCGTGGCGAGTGGCTATGTGTCTTGCGACTATTTTCTGCCGAGC<br>TGGTATCGCCAGGCTCCAGGTAAGGAACGCGAGTTCGTGAGCATCATTGATGGC<br>ACAGGTTCAACATCCTACGCTGCGTCCGTGAAGGGACGGTTCACCGCGAGCCAG<br>GACAAGGGTAAGAACATCGCTTACCTCCAGATGAACTCCCTGAAGCCGGAGGAC<br>ACCGCCATGTACTATTGTAAGGCTTCCTGTGTGCGCGGCAGGGGAATCAGTGAA<br>TACTGGGGCCAAGGAACACAGGTGACTGTCAGTTCCGGTGGCGGAAGCCAGGTG<br>CAGTTGCAAGAGTCCGGGGGCGGTTCCGTGCAGGCTGGTGGTCCCTGAGACTC<br>TCTTGTACCGCTTCAGGTGCTATTGCCAGTGGATACATTGATTCCCGCTGGTGC<br>ATGGGCCTGGTTCCGCCAGGCCCCGGCAAGGAGAGGGAAGGAGTCGCCGCTATC<br>TGGCCTGGGGGTGGCCTGACCGTGTATGCTGATAGCGTGAAGGGCAGATTCACC<br>ATCAGCCGCGATCATGCTAAGAACACACTCTACCTTCAGATGAATAACCTGAAG<br>CCTGAGGACACCGCTATGTATTACTGCGCAGCCGGTTCCCCTCGCATGTGCCCC<br>TCTTTGGAGTTTGGCTTCGACTACTGGGGCCAGGGCACTCAGGTTACCGTAAGC<br>TCC |
| hIL27Ra_<br>VH<br>H18-<br>DR591 | 1448 | CAAGTCCAGCTCCAGGAATCCGGCGGTGGCTCCGTCCAGGCGGGCGGTTCCCTC<br>AGGCTCTCCTGCGTGGCCAGCGGCTACGTAAGCTGCGATTATTTCCTGCCATCT<br>TGGTATCGCCAAGCCCCTGGTAAGGAGAGAGAATTTGTCTCAATCATTGATGGT<br>ACAGGTAGCACCTCCTACGCAGCCTCAGTGAAGGGACGTTTTACCGCGAGCCAA<br>GACAAAGGCAAGAACATCGCGTATTTGCAGATGAACTCTCTGAAGCGGAGGAT<br>ACCGCGATGTACTATTGCAAAGCCTCCTGTGTACGCGGCAGGGGAATCTCAGAG<br>TATTGGGGCCAGGGCACTCAAGTGACAGTCAGCTCTGGCGGGAGCGGCGGGTCT<br>GGAGGTAGCGGTCAGGTGCAACTCCAGGAATCTGGCGGAGGCTCTGTGCAGGCC<br>GGTGGCAGCCTGCGTCTCAGCTGCACAGCCAGCGGGGCCATTGCCAGCGGCTAC<br>ATCGACTCCCGCTGGTGCATGGCTTGGTTCCGGCAAGCGCCGGGAAAGGAAAGA<br>GAGGGAGTCGCCGCGATCTGGCCGGGCGGTGGCCTGACTGTGTACGCTGACAGC<br>GTGAAGGGTCGCTTCACCATCAGTCGGGACCATGCGAAAAACACGCTGTACTTG<br>CAGATGAACAATCTGAAGCCTGAGGACACTGCCATGTATTACTGCGCTGCCGGT<br>AGTCCACGCATGTGCCCGTCTCTGGAGTTCGGCTTTGACTACTGGGGCCAGGGC<br>ACTCAGGTCACGGTTAGCTCT |
| hIL27Ra_<br>VH<br>H18-<br>DR592 | 1449 | CAGGTGCAACTGCAAGAAAGTGGTGGAGGTTCCGTGCAAGCTGGCGGATCTTTG<br>CGCCTCAGCTGCGTGGCCTCTGGCTATGTGAGTTGTGATTACTTCCTGCCTTCT<br>TGGTATCGTCAGGCCCCTGGTAAGGAACGGGAGTTCGTGTCCATTATCGACGGC<br>ACCGGATCTACGAGCTACGCTGCATCCGTCAAGGGTCGTTTTACCGCTTCCCAA<br>GACAAAGGCAAAATATTGCCTACTTGCAAATGAACTCTCTGAAACCCGAAGAT<br>ACAGCAATGTATTACTGTAAAGCCAGTTGTGTGCGCGGACGCGGCATTTCCGAG<br>TATTGGGGACAGGGCACTCAGGTGACTGTCTCATCTGGCGGGGGCTCCCAGGTG<br>CAACTTCAGGAATCTGGCGGGGGTTCTGTTCAAGCAGGCGGTTCTCTGCGTCTG<br>AGTTGCACCGCTCCCGGATTTACCTCCAACAGTTGCGGAATGGATTGGTATCGC<br>CAGGCTCCTGGCAAGGAGCGTGAGTTCGTAAGTAGCATTTCAACTGATGGTACT<br>ACCGGATACGCTGACTCAGTTAAGGGTCGGTTCACTATCAGCAAGGATAAAGCT<br>AAGGACACAGTGTACCTTCAGATGAACTCCCTGAAGCCTGAGGACACCGGAATG<br>TACTCCTGTAAAACCAAAGACGGGACCATCGCCACGATGGAACTGTGTGATTTC<br>GGATATTGGGGTCAGGGCACCCAGGTGACCGTGAGTAGC |
| hIL27Ra_<br>VH<br>H18-<br>DR592 | 1450 | CAGGTGCAGCTTAAGAGAGCGGCGGGGGCTCCGTCCAGGCCGGTGGGTCCTTG<br>CGCTTGTCTTGTGTGGCCAGCGGATACGTGTCTTGCGATTATTTCCTGCCCTCT<br>TGGTACAGACAGGCCCCAGGCAAGGAGCGCGAGTTCGTATCCATCATTGACGGC<br>ACTGGTTCTACAAGTTACGCTGCATCTGTGAAGGGCCGCTTTACCGCCTCTCAG<br>GATAAGGGTAAAAACATCGCTTATTTGCAGATGAACTCACTCAAGCCTGAGGAC<br>ACCGCCATGTACTATTGTAAGGCCTCTTGTGTCAGAGGGAGAGGCATTAGTGAA<br>TATTGGGGTCAGGGGACCCAGGTGACTGTGTCCAGCGGCGGGAGCGGGGGCAGC<br>GGTGGCAGCGGCCAGGTTCAACTTCAGGAGAGCGGGGTGGAAGCGTCCAAGCA<br>GGCGGGTCCCTGCGCTTGAGTTGTACCGCTCCGGGATTCACTAGCAACAGCTGC<br>GGGATGGACTGGTATCGGCAGGCCCCAGGGAAGGAGCGTGAGTTCGTCAGCTCC<br>ATCTCTACAGACGGCACAACCGGCTACGCCGACAGCGTTAAGGGCAGGTTCACA<br>ATCAGCAAGGACAAGGCCAAGGATACCGTGTATTTGCAGATGAACAGCCTGAAG<br>CCAGAGGATACAGGAATGTATAGCTGCAAGACTAAGGACGGCACTATTGCAACT<br>ATGGAACTGTGTGATTTTGGCTACTGGGGTCAAGGCACGCAGGTGACCGTGAGT<br>TCC |
| hIL27Ra_<br>VH<br>H18-<br>DR593 | 1451 | CAGGTGCAGCTCCAGGAGTCCGGTGGGGGCTCCGTACAGGCGGGCGGTTCCCTG<br>CGCCTTTCTTGTGTGGCCAGCGGTTACGTGAGCTGCGACTACTTCCTCCCTTCC<br>TGGTATCGTCAAGCCCCTGGTAAGAGAGGGAGTTCGTGTCAATCATTGATGGC<br>ACCGGCTCTACCTCTTATGCTGCCTCTGTGAAAGGACGCTTTACTGCTTCTCAG |

TABLE 1B-continued

| Name | SEQ ID NO: | Sequence |
|---|---|---|
| | | GATAAGGGCAAGAATATTGCTTACTTGCAGATGAACAGTCTGAAACCTGAGGAT<br>ACTGCCATGTACTATTGCAAGGCCTCCTGTGTGCGTGGCCGGGGCATTAGCGAA<br>TACTGGGGCCAGGGAACCCAGGTCACCGTCAGCTCTGGGGGTGGCTCTCAGGTG<br>CAGCTGCAAGAATCCGGCGGTGGCTCCGTTCAGGCTGGCGGTTCCCTGCGGCTG<br>TCCTGTGCAGCCTCCGGCTACCCGTACTCCAACGGCTATATGGGCTGGTTTCGC<br>CAGGCCCCTGGCAAAGAGCGCGAGGGAGTTGCCACCATCTACACCGGGGATGGC<br>CGCACTTATTACGCTGACTCTGTGAAAGGGCGCTTCACTATCAGCCGGGATAAC<br>GCCAAGAATACCGTGGACCTCCAAATGAGTTCCCTCAAGCCGGAAGACACTGCA<br>ATGTACTATTGCGCGGCTCGTGCAGCTCCACTGTACTCCTCTGGCTCTCCCCTG<br>ACCCGCGCACGTTATAATGTCTGGGGCCAGGGCACCCAGGTGACCGTCTCAAGT |
| hIL27Ra_<br>VH_<br>H18-<br>DR593 | 1452 | CAGGTGCAGCTGCAAGAATCTGGCGGGGGCTCCGTGCAGGCAGGGGGTAGCCTG<br>AGGCTGAGCTGCGTGGCTAGTGGCTACGTCTCCTGCGACTACTTTCTGCCCAGC<br>TGGTATATCGTCAGGCACCTGGGAAGGAACGCGAGTTCGTATCCATCATTGATGGC<br>ACTGGCTCTACCAGCTACGCAGCCTCCGTGAAAGGACGCTTCACTGCGAGCCAG<br>GACAAGGGCAAGAACATCGCCTACTTGCAGATGAACTCCCTGAAGCCGGAAGAC<br>ACCGCCATGTATTACTGTAAGGCTTCTTGTATACGGGCGCGGTATCTCTGAA<br>TATTGGGGCCAGGGCACTCAGGTGACGGTGTCCAGCGGAGGTAGCGGGGCTCC<br>GGCGGGAGCGGGCAGGTTCAGCTCCAGGAGTCTGGGGGTGGCTCCGTGCAGGCC<br>GGAGGCTCCCTGCGCCTGTCCTGCGCCGCTTCAGGTTACCCTTATTCTAACGGT<br>TATATGGGTTGGTTCCGTCAAGCGCCCGGCAAAGAAAGGGAGGGTGTGGCTACC<br>ATTTACACTGGTGATGGTCGCACCTACTATGCTGATTCCGTGAAGGGCCGTTTC<br>ACCATCTCTCGCGATAACGCTAAGAATACCGTGGACTTGCAGATGAGTTCTCTG<br>AAACCTGAAGATACCGCCATGTACTATTGTGCCGCACGCGCCGCTCCGCTCTAC<br>TCTAGCGGGTCTCCCCTGACGAGGGCTAGGTACAACGTGTGGGGACAGGGCACC<br>CAGGTGACCGTGTCCAGC |
| hIL27Ra_<br>VH_<br>H18-<br>DR594 | 1453 | CAGGTGCAGTTGCAGGAAAGCGGCGGGGGCAGCGTCCAGGCTGGGGGAAGTCTC<br>CGCCTGTCCTGCGTGGCCAGTGGCTACGTCAGCTGTGACTATTTTCTGCCGAGC<br>TGGTACAGGCAGGCCCCTGGGAAGGAGCGGGAGTTCGTGTCTATCATTGATGGG<br>ACCGGCTCCACCAGCTACGCGGCCTCCGTGAAAGGACGTTTCACGGCCAGCCAG<br>GATAAGGGAAAGAATATCGCTTACCTCCAGATGAACTCTCTGAAACCTGAGGAT<br>ACTGCCATGTATTACTGCAAGGCCTCATGTGTGCGCGGACGCGGCATCTCAGAA<br>TATTGGGGTCAGGGAACCCAGGTGACTGTCAGTTCTGGAGGTGGCTCCAGGTA<br>CAGCTCCAGGAGTCCGGTGGGGCTCCGTGCAAGCAGGGGGTTCTTTGCGGCTT<br>TCCTGTGTAGCCAGCGCCTCTACCTACTGCACCTACGACATGCACTGGTATCGC<br>CAAGCGCCGGGCAAAGGCCGCGAGTTTGTCTCTGCCATTGATTCCGATGGTACA<br>ACCCGTTATGCAGATTCCGTGAAGGGCAGATTCACCATCAGCCAGGGCACGGCG<br>AAGAATACGGTCTACTTGCAGATGAACTCTTTGCAGCCCGAGGACACAGCCATG<br>TATTACTGTAAGACAGTTTGTGTGGTAGGTTCTCGCTGGTCAGATTACTGGGGT<br>CAGGGCACACAGGTGACGGTTTCTAGT |
| hIL27Ra_<br>VH_<br>H18-<br>DR594 | 1454 | CAGGTCCAGCTTCAGGAGTCTGGCGGGGGTTCCGTTCAGGCAGGCGGGTCCCTC<br>AGGCTCTCTTGTGTCGCCTCCGGCTACGTGTCTTGCGACTATTCCTGCCCTCT<br>TGGTATCGGCAGGCTCCGGGCAAGGAGCGCGAGTTCGTGAGCATCATTGATGGC<br>ACAGGCAGTACTTCCTATGCGGCATCCGTGAAAGGGCGCTTCACTGCCAGTCAA<br>GACAAGGGCAAAAACATTGCATACCTCCAGATGAACTCCCTGAAGCCTGAAGAC<br>ACAGCTATGTATTACTGTAAGGCGAGTTGTGTACGTGGACGTGGTATCAGTGAA<br>TACTGGGGCCAGGGCACCCAGGTGACCGTGTCAAGCGGCGGTTCTGGCGGGTCA<br>GGCGGTTCCGGCCAGGTGCAGCTCCAGGAGTCCGGGGGAGGGAGCGTCCAGGCT<br>GGCGGGTCTCTGCGCCTGTCATGCGTCGCCAGCGCATCTACTTACTGTACCTAC<br>GATATGCACTGGTATCGCCAAGCGCCCGGCAAGGGCCGCGAGTTTGTCTCCGCC<br>ATTGATTCAGACGGGACAACCCGGTATGCCGATAGTGTGAAGGGCCGTTTTACC<br>ATCAGTCAGGGCACTGCTAAGAACACTGTGTATCTCCAGATGAACAGTCTTCAG<br>CCTGAAGATACTGCTATGTATTACTGCAAAACTGTGTGTGGTTGGATCTCGT<br>TGGAGCGACTATTGGGGTCAGGGTACTCAGGTCACAGTGTCTTCT |
| hIL27Ra_<br>VH_<br>H18-<br>DR595 | 1455 | CAAGTTCAGTTGCAGGAGTCTGGAGGTGGGTCTGTGCAGGCTGGGGGCTCCCTG<br>CGTTTGTCTTGTGTTGCGAGCGGCTACGTCTCTTGTGACTATTTCCTGCCTAGC<br>TGGTATCGGCAGGCCCCCGGCAAAGAACGCGAGTTTGTGAGCATTATCGACGGT<br>ACTGGCTCCACCAGCTATGCGGCCTCCGTGAAGGGACGCTTTACCGCCTCCCAG<br>GATAAGGGCAAGAACATCGCGTACCTCCAGATGAACTCACTGAAGCCAGAGGAC<br>ACCGCTATGTACTATTGCAAAGCAAGCTGTGTTCGCGGTAGGGGAATTTCAGAG<br>TATTGGGGCCAAGGAACCCAGGTCACCGTCAGCAGTGGAGGTGGCAGCCAGGTG<br>CAGCTCCAGGAGAGTGGCGGGGTTCTGTGCAGGCCGGAGGCTCCCTGACCCTG<br>TCTTGCGCCGCAAGTGAGTATGCGTACTCCACATGCAACATGGGATGGTATCGC<br>CAGGCTCCCGGTAAGGAGCGCGAGCTGGTGAGCGCTTTTATCTCAGACGGCTCT<br>ACCTACTATGCCGACTCCGTCAAGGGCCGTTCACAATCACCCGTGATAACGCC<br>AAGAATACCGTCTACTTGCAGATGAACTCTTTGAAGCCTGAGGACACAGCCATT<br>TACTATTGCTCTGCGAACTGTTACCGCCGTCTGCGGAACTATTGGGGCCAGGGC<br>ACCCAGGTGACTGTGTCCTCC |
| hIL27Ra_<br>VH_<br>H18-<br>DR595 | 1456 | CAGGTGCAGCTGCAAGAGTCCGGCGGTGGCAGTGTCCAAGCTGGCGGGTCCCTG<br>AGGTTGTCCTGCGTGGCATCCGGCTATGTTAGTTGTGACTACTTTCTGCCCTCC<br>TGGTATCGCCAGGCTCCTGGCAAGGAGCGCGAATTTGTGTCTATCATTGATGGC<br>ACCGGCAGCACTTCTTATGCTGCATCTGTGAAAGGACGGTTCACCGCGAGCCAG<br>GACAAGGGTAAGAATATCGCCTACTCCAGATGAACAGCCTGAAACCCGAGGAT |

TABLE 1B-continued

| Name | SEQ ID NO: | Sequence |
|---|---|---|
| | | ACTGCCATGTACTATTGTAAGGCCAGTTGCGTGCGCGGTCGTGGCATCAGCGAG<br>TATTGGGGCCAGGGGACACAGGTGACCGTGTCCAGTGGAGGTAGCGGTGGAAGC<br>GGCGGTTCCGGCCAGGTCCAGCTCCAGGAGAGCGGGGGAGGCTCAGTGCAGGCC<br>GGAGGCAGCCTGACACTGTCCTGCGCCGCAAGCGAATATGCGTACAGCACCTGC<br>AACATGGGCTGGTATCGCCAGGCCCCAGGCAAGGAGCGTGAACTTGTGTCAGCC<br>TTCATCAGCGACGGTAGCACATATTACGCTGACTCAGTGAAGGGACGCTTCACA<br>ATCACCAGGGATAACGCCAAGAACACAGTTTACCTCCAGATGAACTCCCTGAAG<br>CCAGAGGATACCGCTATTTATTACTGTTCCGCAAATTGTTACCGTAGACTGCGC<br>AATTATTGGGGACAAGGCACACAGGTGACAGTGAGTTCT |
| hIL27Ra_<br>VH<br>H18-<br>DR596 | 1457 | CAGGTCCAGTTGCAGGAGTCTGGGGGAGGCAGCGTCCAGGCCGGGGGCAGTCTC<br>CGCCTGTCCTGTGTCGCGAGCGGGTACGTGTCTTGCGATTACTTCCTCCCCTCC<br>TGGTATCGCCAAGCGCCAGGCAAGGAACGCGAGTTCGTTTCCATCATTGACGGC<br>ACCGGAAGCACTTCCTACGCTGCCTCCGTGAAGGGGCGTTTCACAGCGTCCCAG<br>GATAAGGGAAAGAATATCGCTTATTTGCAGATGAACTCTCTGAAGCCTGAGGAT<br>ACCGCCATGTACTATTGTAAAGCCTCCTGTGTGAGGGGTCGCGGGATCTCTGAG<br>TACTGGGGCCAAGGAACTCAGGTGACGGTGTCTAGCGGCGGAGGCTCCCAGGTG<br>CAGCTGCAAGAATCTGGCGGAGGCTTGGTGCAGCCGGGAGGCTCACTGCGTCTC<br>TCCTGCACCGCCAGCGGCCTCACTTTTGACGATAGCGTGATGGGATGGTTCCGT<br>CAGGCCCCTGGCAAGGGCCGTGAGGCGGTCAGCTGCATCTCTTCCAGTGGTGCC<br>AACGCTTTCTACGCAGACAGCGTGAAGGGTAGGTTCACCATCAGCAGAGATAAC<br>GCCAAGAACACGCTGTATCTCCAGATGAACTCCCTGAAGCCTGAGGACACTGCC<br>ACCTACTATTGCAAGCGGGGCCATGCGTGTGCTGGCTATTACCCAATTCCCTAC<br>GATGACTACTGGGGCCAGGGCACACAAGTCACGGTAAGCAGC |
| hIL27Ra_<br>VH<br>H18-<br>DR596 | 1458 | CAGGTCCAGCTCCAGGAATCAGGTGGCGGAAGCGTGCAGGCTGGGGGCTCTCTG<br>CGCCTGTCTTGTGTGGCCAGTGGCTACGTTAGCTGCGATTATTTCCTGCCATCT<br>TGGTACAGGCAGGCCCCTGGCAAGGAGCGTGAGTTCGTCTCTATCATTGATGGA<br>ACAGGTTCCACCAGTTACGCCGCTTCTGTTAAGGGCCGCTTCACCGCCTCACAG<br>GATAAGGGCAAGAACATCGCTTACCTCCAAATGAACTCCCTGAAGCCCGAGGAC<br>ACTGCCATGTATTACTGTAAGGCTTCTTGTGTGCGCGGTCGCGGCATTTCCGAA<br>TACTGGGGACAAGGAACCCAGGTAACAGTGTCCTCTGGAGCAGTGGAGGCTCA<br>GGGGGCTCTGGTCAGGTCCAACTCCAGGAGAGCGGCGGTGGACTGGTGCAGCCC<br>GGTGGCTCTCAGGCTGTCCTGTACGGCGAGCGGCCTCACCTTTGATGACTCT<br>GTTATGGGCTGGTTCCGCCAAGCCCCTGGGAAGGGCGGGAGGCTGTGAGCTGT<br>ATTTCCTCTAGCGGGGCGAACGCTTTCTACGCCGATTCAGTGAAAGGCCGTTTC<br>ACCATCAGTCGCGACAACGCCAAAAACACGCTGTACTTGCAGATGAACTCTTTG<br>AAACCAGAGGACACCGCAACTTACTATTGTAAACGCGGCCACGCATGCTGGC<br>TATTACCCTATCCCCTACGATGACTACTGGGGCCAGGGCACCCAGGTTACAGTG<br>TCATCT |
| hIL27Ra_<br>VH<br>H19-<br>DR591 | 1459 | CAAGTCCAGTTGCAGGAATCCGGCGGTGGATCAGTGCAGGCAGGCGGTAGCTTG<br>AGGCTGTCTTGTAGAGCGTCCGGTTCAACTTACTCCAACTACTGCCTGGGCTGG<br>TTTCGGCAGATTACAGGCAAGGAGCGCGAGGGAGTGGCCGTGATAAATTGGGTG<br>GGTGGAATGCTGTATTTTGCCGACTCCGTGAAGGGCCGGTTCACCGTGTCTCAG<br>GACCAGGCCAAGAACACCGTCTACCTTCAGATGAACTCCCTGAAGCCTGAGGAT<br>ACCGCCATGTATTACTGCGCCGCTGAGAGTGTCAGCTCTTTTAGTTGCGGTGGC<br>TGGCTGACCCGCCCCGACCGTGTGCCGTACTGGGGCCAGGGAACACAGGTGACA<br>GTGAGTTCCGGTGGGGGCTCCCAAGTCAACTTCAGGAGTCTGGCGGTGGCAGC<br>GTGCAGGCAGGGGCTCTCTGCGTCTGTCATGCACCGCCAGCGGAGCCATCGCC<br>TCCGGTTACATCGACTCCCGCTGGTGTATGGCTTGGTTTCGCCAGGCTCCCGGC<br>AAGGAGCGTGAAGGCGTGGCCGCGATCTGGCCTGGCGGGGGCTTGACTGTTTAT<br>GCTGACTCAGTGAAGGGTCGCTTTACCATCTCCCGCGACCACGCAAAGAACACC<br>CTTTATTTGCAGATGAATAACCTGAAGCCGGAAGCACTGCCATGTACTATTGC<br>GCAGCTGGCTCTCCCCGCATGTGTCCGTCTCTGGAGTTCGGTTTCGATTACTGG<br>GGTCAGGGCACTCAGGTTACCGTGTCCAGC |
| hIL27Ra_<br>VH<br>H19-<br>DR591 | 1460 | CAGGTGCAGTTGCAGGAAAGTGGAGGCGGGTCAGTTCAGGCTGGCGGTTCCCTG<br>AGGCTGTCCTGTCGTGCAAGTGGCTCAACGTATTCAAACTATTGCCTTGGTTGG<br>TTTAGGCAGATCACCGGCAAGGAGCGCGAGGGCGTTGCTGTCATCAACTGGGTC<br>GGCGGGATGCTGTACTTTGCCGACAGCGTCAAGGGCAGATTTACCGTCTCCCAG<br>GATCAGGCCAAGAACACAGTGTATCTCCAGATGAACTCTTTGAAGCCCGAAGAC<br>ACAGCAATGTACTATTGTGCGGCTGAATCTGTTAGCTCCTTTTCCTGCGGCGGT<br>TGGTTGACGGAGACCGGATCGGGTCCCGTACTGGGGTCAGGGGACCCAGGTCACG<br>GTCAGCTCCGGGGGCAGCGGCGGTAGTGGAGGCTCCGGTCAGGTGCAGCTCCAG<br>GAGAGCGGGGGCGGTAGCGTGCAAGCAGGGGGCAGTCTGCGGCTGAGCTGTACT<br>GCGAGCGGAGCCATCGCCAGCGGATATATCGACAGCCGCTGGTGTATGGCCTGG<br>TTCCGCCAGGCTCCCGGAAAAGAGCGCGAGGGAGTCGCTGCGATTTGGCCAGGG<br>GGCGGATTGACAGTATACGCCGACTCTGTGAAAGGCAGATTTACTATCAGCCGC<br>GATCACGCCAAGAACACTCTGTACCTCCAGATGAATAACCTCAAACCGGAGGAC<br>ACCGCCATGTATTACTGCGCTGCCGGGTCCCCAGGATGTGTCCTAGTCTGGAG<br>TTCGGTTTCGACTACTGGGGCCAAGGAACCCAGGTGACCGTCTCTAGC |
| hIL27Ra_<br>VH<br>H19-<br>DR592 | 1461 | CAGGTGCAGTTGCAGGAGTCAGGAGGTGGGAGTGTTCAGGCCGGAGGCAGCCTG<br>CGCTTGAGCTGCCGGGCGTCTGGCAGCACCTACAGCAACTATTGCCTGGGTTGG<br>TTCCGTCAGATCACCGGCAAGGAGCGGGAGGGCGTGGCTGTCATCAACTGGGTG<br>GGTGGAATGCTGTATTTTGCGGATAGTGTGAAGGGACGGTTCACAGTCTCTCAG |

TABLE 1B-continued

| Name | SEQ ID NO: | Sequence |
|---|---|---|
| | | GATCAGGCAAAGAATACCGTGTACCTTCAGATGAACTCCCTGAAGCCTGAAGAC<br>ACTGCCATGTACTATTGCGCCGCTGAGAGCGTGTCCAGCTTCTCTTGCGGTGGC<br>TGGCTCACCAGGCCTGACCGTGTGCCTTACTGGGGCCAGGGTACGCAGGTGACC<br>GTATCTAGCGGCGGGGGTTCTCAGGTCCAGTTGCAGGAGTCCGGTGGCGGGTCC<br>GTCCAGGCGGGCGGTAGCCTGCGGCTGAGTTGCACCGCTCCTGGATTTACCAGC<br>AACAGTTGTGGCATGGACTGGTATCGTCAGGCCCCCGGAAAGGAACGCGAGTTC<br>GTGAGCAGTATCTCCACAGACGGCACGACCGGCTACGCTGACTCCGTCAAGGGC<br>CGTTTTACCATCTCCAAAGACAAAGCAAAGGATACAGTGTATCTCCAGATGAAC<br>TCACTGAAGCCCGAGGACACGGGTATGTATAGCTGCAAGACTAAGGACGGAACC<br>ATTGCCACAATGGAGCTTTGTGACTTCGGGTACTGGGGACAGGGAACACAAGTA<br>ACGGTCAGCTCC |
| hIL27Ra_<br>VH<br>H19-<br>DR592 | 1462 | CAGGTCCAGTTGCAGGAATCCGGCGGGGGATCAGTGCAGGCTGGCGGGTCTCTG<br>CGCCTCTCATGCAGAGCCTCCGGCTCCACCTATTCTAACTACTGCTTGGGCTGG<br>TTCAGACAGATCACCGGCAAAGAGCGCGAGGGCGTTGCAGTGATAAATTGGGTG<br>GGTGGAATGCTGTATTTTGCAGACTCCGTCAAGGGAAGGTTCACCGTGAGTCAG<br>GATCAAGCCAAGAACACCGTGTATCTGCAAATGAACTCTCTGAAGCCCGAGGAC<br>ACCGCTATGTATTACTGTGCAGCTGAAAGCGTGTCCTCTTTCTCTTGCGGAGGC<br>TGGCTTACTAGACCTGATCGTGTGCCATATTGGGGTCAGGGCACCCAGGTCACA<br>GTTCTTCCGGTGGCTCAGGCGGATCTGGCGGGTCCGGGCAGGTACAGCTCCAG<br>GAGTCTGGTGGCGGTTCCGTTCAGGCTGGGGGCTCCCTGCGTCTCTCCTGCACC<br>GCGCCCGGCTTCACAAGCAACTCCTGCGGTATGGACTGGTATCGCCAAGCGCCT<br>GGAAAAGAGCGCGAGTTCGTCTCTAGCATTTCCACTGACGGTACTACCGGCTAC<br>GCCGACTCCGTGAAGGGGCGCTTCACTATTTCTAAGGATAAGGCGAAGGATACT<br>GTGTACCTCCAGATGAACTCACTGAAGCCCGAGGACACTGGGATGTATAGTTGC<br>AAGACCAAGGATGGCACAATCGCCACTATGGAATTGTGTGACTTCGGCTACTGG<br>GGGCAGGGCACCCAGGTGACAGTGTCCAGC |
| hIL27Ra_<br>VH<br>H19-<br>DR593 | 1463 | CAGGTCCAGTTGCAGGAGTCCGGTGGCGGTTCCGTCCAAGCCGGAGGCTCACTC<br>AGACTCTCTTGTCGCGCCTCAGGAAGCACTTACTCCAACTACTGCCTGGGGTGG<br>TTTCGCCAGATCACTGGCAAGGAGCGGGAGGGTGTCGCGGTAATAAATTGGGTC<br>GGCGGTATGCTGTATTTCGCGGACTCCGTGAAGGGCCGTTTCACCGTATCACAG<br>GACCAGGCCAAGAACACTGTGTATCTCCAGATGAACTCACTGAAGCCCGAAGAT<br>ACTGCAATGTATTACTGCGCGGCTGAGAGCGTGTCTTCCTTCTCTTGCGGCGGA<br>TGGCTCACACGGCCAGACCGTGTGCCATACTGGGGTCAGGGCACCCAAGTTACA<br>GTCTCCAGCGGGGTGGCTCCCAAGTCCAGCTGCAAGAGAGCGGCGGGGGCTCC<br>GTGCAGGCTGGAGGTTCTCTGCGTTTGTCCTGTGCTGCCTCAGGATACCCTTAT<br>AGTAACGGTTACATGGGCTGGTTTCGGCAGGCTCCAGGGAAGGAAAGGGAGGGG<br>GTGGCTACAATTTACACCGGCGACGGAAGGACCTATTACGCCGACTCTGTGAAA<br>GGTCGCTTCACCATTTCCCGTGACAACGCGAAGAATACAGTTGATCTTCAGATG<br>TCTTCCCTGAAGCCCGAGGACACAGCGATGTATTACTGCGCTGCCCGTGCTGCC<br>CCTCTCTACAGCTCTGGCTCTCCCCTGACCCGCGCCCGTTACAACGTGTGGGGC<br>CAGGGGACTCAGGTCACAGTCTCATCC |
| hIL27Ra_<br>VH<br>H19-<br>DR593 | 1464 | CAAGTGCAGCTGCAAGAGAGCGGAGGTGGATCTGTGCAGGCTGGTGGGTCTCTG<br>CGCCTCTCTTGCCGTGCGTCAGGCTCCACCTACTCTAATTATTGCCTCGGTTGG<br>TTCCGGCAGATTACGGGCAAGGAGCGCGAGGGTGTGGCAGTTATCAACTGGGTT<br>GGGGGTATGTTGTACTTTGCTGACTCCGTCAAGGGACGTTTCACTGTGAGTCAA<br>GACCAGGCTAAGAACACTGTGTACCTCCAGATGAATAGTCTGAAGCCTGAGGAT<br>ACCGCCATGTATTACTGCGCAGCTGAGAGCGTGAGCAGTTTTTCCTGTGGCGGA<br>TGGCTTACCAGACCTGATCGCGTGCCGTACTGGGGCCAGGGGACCCAGGTGACT<br>GTTAGTTCTGGAGGCAGCGGAGGCTCCGGTGGCAGCGGTCAGGTACAGCTCCAG<br>GAATCTGGTGGCGGTAGCGTGCAGGCAGGGGGCTCTCTTCGCCTGAGCTGTGCA<br>GCTTCTGGATACCCATATAGCAACGGTTACATGGGCTGGTTTCGCCAAGCCCCC<br>GGCAAGGAGAGAAGGTGTGGCTACCATTTATACCGGCGACGGGCGCACTTAC<br>TATGCAGACTCCGTCAAAGGCCGTTTACAATCTCTAGGGACAACGCCAAGAAT<br>ACCGTCGATCTTCAGATGTCTTCCCTGAAGCCGGAGGATACCGCCATGTATTAC<br>TGTGCGGCCAGGGCTGCCCCTCTCTACTCCTCTGGATCACCTCTGACTAGGGCT<br>CGCTATAACGTATGGGGTCAGGGAACACAGGTCACGGTGTCATCT |
| hIL27Ra_<br>VH<br>H19-<br>DR594 | 1465 | CAGGTTCAGCTCCAAGAGAGCGGCGGTGGCTCAGTGCAGGCAGGTGGCTCACTT<br>AGGCTGAGTTGCAGAGCTTCCGGCTCAACATACTCCAACTATTGTCTCGGCTGG<br>TTCAGGCAGATCACTGGTAAGGAGCGCGAGGGGGTGGCCGTCATCAACTGGGTG<br>GGTGGAATGCTGTACTTTGCCGACTCTGTAAAGGGTCGTTTTACTGTGTCTCAG<br>GACCAGGCCAAGAACACAGTGTACCTTCAGATGAACTCTCTGAAGCCGGAGGAT<br>ACGGCAATGTACTATTGCGCTGCCGAGAGTGTTAGTTCATTCTCCTGTGGAGGC<br>TGGCTGACTCGCCCGGATCGTGTGCCGTACTGGGGCCAGGGCACCCAGGTGACC<br>GTTAGCTCCGGCGGTGGCTCCCAGGTGCAGCTGCAAGAGAGTGGTGGAGGCTCC<br>GTGCAGGCAGGTGGCTCCCTTCGTCTTTCTTGTGTCGCCTCTGCTTCAACCTAC<br>TGCACATACGACATGCACTGGTATCGCCAGGCCCCTGGCAAGGGGCGCGAGTTC<br>GTTAGTGCCATCGACAGTGACGGCACTACCAGATACGCCGACAGCGTCAAGGGC<br>CGCTTCACCATCAGCCAGGGAACAGCTAAAACACCGTCTACCTCCAGATGAAC<br>TCCCTTGCAGCCAGAGGACACAGCCATGTATTACTGCAAAACTGTCTGCGTCGTG<br>GGGTCCAGATGGAGCGACTACTGGGGCCAAGGCACGCAGGTTACCGTGAGCAGC |

TABLE 1B-continued

| Name | SEQ ID NO: | Sequence |
|---|---|---|
| hIL27Ra_VH H19-DR594 | 1466 | CAGGTCCAGTTGCAGGAGTCCGGCGGGGGTTCTGTGCAGGCTGGAGGCAGCCTC<br>AGACTCTCTTGCAGGGCTTCTGGATCAACTTATTCTAATTATTGCCTCGGTTGG<br>TTCCGCCAAATCACAGGCAAGGAGAGGGAGGGAGTGGCGGTGATTAACTGGGTG<br>GGCGGTATGCTGTACTTCGCCGACTCCGTGAAAGGTCGTTTCACTGTCTCTCAG<br>GATCAGGCCAAGAACACTGTTTACCTCCAGATGAACTCTCTGAAGCCCGAAGAT<br>ACGGCCATGTACTATTGCGCTGCCGAATCCGTCCTCTTTTTCCTGCGGAGGC<br>TGGCTGACACGCCCCGACCGCGTCCCCTATTGGGGTCAGGGGACTCAGGTCACC<br>GTCAGCTCTGGCGGGAGCGGAGGCAGCGGGGGCAGCGGCCAGGTCCAGCTTCAG<br>GAAAGCGGAGGTGGCTCCGTGCAGGCTGGCGGAAGCCTGAGACTGTCCTGCGTG<br>GCTTCAGCTTCCACCTACTGCACCTATGACATGCACTGGTATAGGCAAGCGCCA<br>GGAAAGGGCAGGGAGTTCGTTTCTGCTATTGATTCTGACGGAACAACTAGATAC<br>GCAGACTCCGTCAAGGGAAGGTTCACCATCTCCCAGGGCACCGCCAAGAACACT<br>GTCTACCTCCAGATGAACAGTCTGCAACCAGAAGACACCGCTATGTATTACTGC<br>AAGACCGTGCGTGGTCGGGTCCAGATGGTCCGATTACTGGGGCCAGGGAACA<br>CAGGTGACTGTCTCATCT |
| hIL27Ra_VH H19-DR595 | 1467 | CAGGTGCAGCTCCAGGAATCTGGGGGAGGTTCAGTGCAGGCAGGTGGCTCCCTG<br>CGCCTGAGTTGCAGGGCGTCCGGTAGTACCTACTCAAACTACTGCCTGGGGTGG<br>TTTAGACAAATCACCGGAAAGGAAAGGGAGGGCGTCGCAGTGATAAATTGGGTG<br>GGCGGTATGCTGTACTTCGCCGACTCTGTGAAGGGACGCTTTACCGTCTCCCAG<br>GATCAGGCTAAGAACACTGTGTATTTGCAGATGAACTCCCTGAAACCAGAGGAC<br>ACAGCCATGTATTACTGTGCTGCCGAAAGCGTCTCTAGTTTTTCCTGCGGAGGG<br>TGGCTTACCCGTCCCGACAGAGTTCCTTATTGGGGCCAGGGAACCCAGGTGACA<br>GTTTCCTCTGGTGGCGGGTCTCAGGTTCAGCTTCAGGAGTCTGGCGGGGGCTCT<br>GTGCAGGCTGGCGGATCTCTGACTCTGAGCTGCGCCGCGAGCGAGTACGCCTAC<br>TCAACCTGCAACATGGGCTGGTATCGCCAGGCACCGGGCAAGGAACGGGAGCTG<br>GTGTCTGCATTCATCTCAGACGGTTCTACGTATTACGCCGACTCCGTGAAGGGT<br>CGCTTTACTATTACCCGCGACAACGCTAAGAACACGGTGTACTTGCAGATGAAC<br>AGCCTGAAGCCTGAGGATACTGCCATCTATTACTGTTCCGCTAACTGCTATAGA<br>CGCCTGCGCAATTACTGGGGACAGGGGACGCAAGTGACAGTGTCTAGC |
| hIL27Ra_VH H19-DR595 | 1468 | CAAGTGCAGTTGCAGGAATCCGGCGGAGGCTCCGTACAGGCCGGTGGATCACTG<br>CGCCTGTCTTGTCGGGCCTCCGGGTCAACCTATAGCAACTACTGTCTGGGCTGG<br>TTTCGTCAGATCACAGGTAAAGAGCGCGAGGGGGTCGCCGTCATCAACTGGGTG<br>GGCGGTATGCTGTACTTCGCTGACAGTGTGAAGGGTCGGTTCACCGTTTCCCAG<br>GATCAAGCCAAAAACACCGTCTACCTCCAGATGAACTCCTTGAAGCCCGAAGAC<br>ACCGCCATGTATTACTGCGCCGCAGAGAGTGTGTCCTCTTTCCTGCGGTGGG<br>TGGTTGACTAGGCCGGACCGTGTTCCCTACTGGGGCCAGGGAACCCAAGTGACC<br>GTTAGCTCAGGGGGCTCCGGTGGCTCTGGTGGCTCTGGTCAGGTGCAGCTCCAG<br>GAGTCTGGAGGCGGGTCAGTTCAGGCTGGGGGCAGTCTGACTCTGTCCTGTGCT<br>GCAAGCGAGTACGCTTACTCTACCTGTAACATGGGTTGGTATCGCCAGGCCCCA<br>GGGAAGGAACGCGAGCTTGTGTCAGCCTTTATCTCCGATGGCAGCACTTATTAC<br>GCAGATTCCGTAAAGGGACGCTTCACCATCACCCGTGACAACGCCAAGAATACC<br>GTCTACCTCCAGATGAACAGCCTGAAGCCGGAGGACACCGCCATCTATTACTGC<br>TCCGCCAACTGCTACCGGCGTCTGCGCAACTACTGGGGCCAGGGCACCCAGGTG<br>ACCGTTTCATCA |
| hIL27Ra_VH H19-DR596 | 1469 | CAGGTTCAACTCCAGGAGTCCGGCGGAGGGTCCGTGCAGGCTGGAGGTTCCCTC<br>CGGTTGTCCTGTCGTGCGTCCGGTTCCACCTACTCAAATTATTGTCTGGGCTGG<br>TTCCGCCAGATTACTGGCAAGGAAAGAGAGGGCGTAGCCGTCATCAACTGGGTT<br>GGGGGGAATGTTGTACTTCGCCGACAGCGTGAAAGGCCGCTTTACGGTTTCCCAG<br>GACCAGGCTAAGAACACTGTATACCTTCAGATGAACTCCCTGAAGCGGAGGAC<br>ACCGCTATGTACTATTGCGCCGCTGAGTCTGTCTCCAGCTTCTCTTGCGGGGGA<br>TGGTTGACCCGCCCTGATCGCGTGCCATACTGGGGCAGGGTACTCAAGTGACA<br>GTGTCCTCTGGCGGAGGCTCCCAGGTTCAGTTGCAGGAGAGCGGCGGTGGACTG<br>GTTCAGCCTGGTGGGAGTCTCCGCCTGAGCTGCACAGCCAGCGGACTGACTTTC<br>GATGACTCAGTGATGGGATGGTTCAGACAGGCTCCGGGAAAGGGCCGTGAGGCG<br>GTCAGCTGTATCTCCTCTTCCGGCGCTAACGCCTTCTACGCTGATTCCGTAAAG<br>GGACGGTTTACCATTTCTCGGGATAACGCCAAGAATACCCTGTATCTCCAGATG<br>AACTCTCTCAAGCCCGAGGATACCGCCACCTATTACTGTAAAGGGGCCACGCA<br>TGTGCTGGATATTACCCGATTCCCTATGATGACTATTGGGGGCAAGGAACGCAG<br>GTTACCGTTAGTTCT |
| hIL27Ra_VH H19-DR596 | 1470 | CAGGTGCAGCTCCAGGAGTCCGGTGGCGGTTCCGTCCAGGCAGGTGGCTCCCTG<br>CGGCTGTCTTGTAGGGCTTCTGGCTCTACCTACTCCAACTACTGTCTGGGATGG<br>TTCCGCCAGATCACAGGCAAGGAGAGGGAGGGCGTAGCAGTGATTAACTGGGTT<br>GGGGGTATGCTGTATTTCGCCGATTCCGTGAAGGGTCGCTTCACCGTGTCCCAG<br>GATCAGGCCAAAAACACTGTTTATTTGCAGATGAACTCCCTGAAGCCTGAGGAC<br>ACCGCTATGTATTACTGTGCAGCGGAGTCCGTGTCATCCTTCTCCTGTGGTGGC<br>TGGCTGACTCGTCCAGACCGTGTGCCTTATTGGGACAGGGCACCCAGGTGACC<br>GTGTCCTCAGGCGGTTCCGGTGGCTCCGGTGGCAGCGGTCAGGTGCAGCTTCAG<br>GAGAGCGGTGGGGCCTGGTGCAGCCCGGAGGTTCACTGAGACTGAGCTGCACG<br>GCCAGCGGTCTGACCTTCGATGACAGCGTGATGGGTTGGTTCCGTCAAGCGCCG<br>GGCAAGGGACGCGAAGCAGTGTCCTGTATCAGTTCCTCTGGTGCTAACGCCTTC<br>TATGCTGACAGTGTGAAGGGACGCTTTACTATCTCCCGCGACAACGCCAAGAAT<br>ACCCTGTACCTCCAGATGAACTCTCTGAAGCCCGAGGATACCGCCACGTATTAC |

TABLE 1B-continued

| Name | SEQ ID NO: | Sequence |
|---|---|---|
| | | TGTAAGCGCGGTCACGCCTGTGCAGGGTACTATCCCATCCCCTACGATGACTAC<br>TGGGGCCAGGGAACTCAGGTCACGGTCTCCTCA |
| hIL27Ra_<br>VH<br>H20-<br>DR591 | 1471 | CAGGTTCAGCTCCAGGAGAGTGGGGGCGGGCTGGTGCAGCCCGGCGGATCACTC<br>CGGCTGTCCTGTGCCGCGAGTGGGTTTACGTTTTCCTCATACCCTATGTCCTGG<br>GTCCGCCAGGCTCCGGGCAAAGGACTGGAATGGGTAAGCACAATTAGCTCTGGG<br>GGCGATACAACTCTGTATGCGGACTCTGTAAAAGGACGCTTCACCAGCTCTCGC<br>GACAACGCAAAGAATACACTCTACCTCCAGCTTAACTCTCTGAAAACAGAGGAC<br>ACAGCAATGTATTACTGTGCAAAGCGCATTGATTGCAATTCCGGCTACTGCTAC<br>AAGCGCTCTTATTGGGGGCAAGGTACGCAGGTGACGGTTAGCTCCGGCGGAGGC<br>TCCCAGGTGCAGTTGCAGGAATCCGGCGGAGGCTCAGTGCAAGCGGGAGGGTCC<br>CTGAGACTGAGCTGTACTGCATCCGGGGCTATCGCCAGCGGATACATTGATTCA<br>CGGTGGTGTATGGCTTGGTTCCGGCAAGCCCCTGGCAAGGAGCGCGAGGGCGTG<br>GCGGCTATCTGGCCCGGCGGTGGACTGACCGTGTACGCTGACTCCGTCAAGGGC<br>CGCTTTACTATCAGCCGCGACCACGCTAAGAACACGCTGTACCTCCAGATGAAC<br>AATCTGAAGCCCGAGGACACCGCTATGTACTATTGCGCAGCTGGCTCACCTCGG<br>ATGTGCCCTTCCCTTGAGTTTGGGTTCGATTACTGGGGCCAAGGCACCCAGGTG<br>ACCGTTAGCAGT |
| hIL27Ra_<br>VH<br>H20-<br>DR591 | 1472 | CAGGTGCAGCTGCAAGAATCCGGCGGTGGCCTGGTGCAGCCAGGAGGCTCCCTG<br>CGGCTGTCCTGTGCTGCGTCTGGCTTCACCTTTAGCTCTTATCCCATGTCTTGG<br>GTGCGTCAGGCTCCGGGAAAGGGCTTGGAATGGGTGTCCACCATTTCTACGGA<br>GGCGACACCACTCTCTACGCTGACTCCGTGAAAGGGCGCTTCACCTCCAGCAGA<br>GACAACGCTAAGAACACCCTGTACTTGCAGCTTAATTCTCTGAAGACCGAGGAT<br>ACAGCAATGTACTATTGCGCCAAGCGGATTGATTGCAACTCCGGCTATTGTTAC<br>AAGAGGTCCTATTGGGGCCAGGGAACTCAGGTAACTGTTAGTTCAGGAGGCTCC<br>GGTGGATCTGGCGGAAGCGGACAGGTGCAGCTTCAGGAATCTGGCGGTGGAAGC<br>GTCCAGGCTGGAGGTTCCCTGAGGCTCAGCTGCACCGCCTCTGGTGCCATTGCG<br>TCCGGGTACATTGATAGCCGCTGGTGCATGGCCTGGTTTAGACAAGCGCCAGGC<br>AAGGAAAGAGAGGGTGTGGCAGCCATCTGGCCGGGCGGAGGTCTGACTGTGTAC<br>GCCGACAGCGTGAAGGGCCGTTTCACTATCTCTCGCGACCACGCCAAGAACACT<br>TTGTATCTTCAGATGAACAATCTGAAGCCCGAAGATACAGCCATGTATTACTGT<br>GCAGCCGGTAGCCCTAGAATGTGCCCCAGTCTGGAGTTCGGCTTCGATTATTGG<br>GGTCAGGGTACTCAGGTCACCGTCAGCTCT |
| hIL27Ra_<br>VH<br>H20-<br>DR592 | 1473 | CAGGTGCAGCTTCAAGAATCTGGAGGGGGCCTGGTTCAGCCAGGGGGTTCTCTG<br>CGTCTGAGCTGTGCCGCGTCTGGATTCACATTCTCATCCTATCCAATGAGCTGG<br>GTGCGTCAGGCTCCCGGTAAAGGGCTGGAATGGGTGTCTACTATCTCCAGCGGA<br>GGCGACACTACCCTGTATGCGGACAGCGTCAAGGGACGCTTCACGTCCAGCAGA<br>GACAACGCCAAAAATACCTTGTACTTGCAGCTGAACAGCCTGAAGACGGAGGAT<br>ACAGCTATGTACTATTGCGCTAAAAGAATCGACTGCAACTCCGGCTACTGTTAC<br>AAGAGAAGCTATTGGGGCCAGGGTACTCAGGTCACCGTGTCTAGCGGAGGTGGC<br>TCCCAAGTGCAGTTGCAGGAGTCTGGCGGGGGTTCCGTCCAGGCTGGTGGCTCC<br>TTGCGTCTTTCCTGTACTGCGCCGGGGTTTACCAGCAACTCATGCGGCATGGAT<br>TGGTATCGTCAAGCGCCTGGTAAGGAGAGGGAATTTGTCTCATCCATCTCCACC<br>GACGGCACGACCGGCTATGCTGACAGCGTTAAAGGTCGTTTTACCATTTCTAAG<br>GATAAGGCCAAGGATACCGTCTACCTCCAGATGAACTCTCTGAAGCCTGAGGAT<br>ACTGGCATGTACTCCTGCAAGACTAAGGATGGCACCATTGCCACGATGGAACTG<br>TGTGATTTCGGGTACTGGGGTCAAGGCACCCAGGTTACCGTCTCCAGC |
| hIL27Ra_<br>VH<br>H20-<br>DR592 | 1474 | CAGGTCCAGCTTCAGGAAAGTGGCGGAGGCCTTGTCCAACCTGGGGGTTCACTC<br>AGACTGTCTTGCGCTGCCAGTGGTTTCACCTTTTCTTCCTACCCCATGTCATGG<br>GTGCGCCAGGCCCCAGGGAAGGGATTGGAATGGGTCTCCACAATCTCCTCTGGC<br>GGTGATACCACACTGTACGCTGACTCTGTCAAGGGACGCTTCACTTCCAGCCGT<br>GATAACGCCAAGAACACCCTGTACTTGCAACTGAACAGTTTGAAAACCGAGGAT<br>ACCGCTATGTATTACTGCGCCAAGCGCATTGATTGCAACTCCGGCTATTGTTAC<br>AAGCGCAGCTATTGGGGCCAGGGCACCCAGGTGACTGTCTCCTCTGGTGGCTCA<br>GGCGGAAGCGGAGGCTCAGGGCAAGTACAGCTCCAGGAGTCAGGTGGCGGTTCC<br>GTACAAGCCGGGGCAGCCTGCGTCTTAGTTGCACCGCACCAGGGTTCACCTCT<br>AACAGCTGCGGAATGGATTGGTACAGGCAAGCGCCCGGCAAGGAACGCGAGTTT<br>GTAAGCTCCATCTCCACCGATGGCACAACCGGGTACGCAGACTCTGTGAAGGGG<br>CGCTTCACGATCAGCAAGGACAAAGCGAAGGATACTGTGTACCTGCAAATGAAC<br>TCCCTCAAGCCCGAAGACACCGGCATGTATTCCTGTAAGACCAAGGACGGCACC<br>ATCGCCACTATGGAGCTGTGCGATTTTGGATACTGGGGACAGGGCACCCAGGTG<br>ACTGTCTCCTCC |
| hIL27Ra_<br>VH<br>H20-<br>DR593 | 1475 | CAAGTACAGTTGCAGGAGAGCGGTGGCGGACTGGTACAGCCAGGCGGTTCCCTG<br>CGCTTGAGCTGTGCTGCCTCCGGCTTCACCTTCTCCAGCTACCCTATGTCATGG<br>GTGCGCCAGGCCCCTGGCAAAGGTCTGGAATGGGTCTCTACCATCTCATCTGGA<br>GGGGACACAACCCTTTATGCAGACAGCGTCAAAGGACGTTTCACTTCTTCACGG<br>GACAACGCGAAGAACACCCTGTACCTTCAGCTGAACTCCCTGAAGACTGAGGAT<br>ACCGCAATGTACTATTGCGCCAAGCGGATTGATTGTAATTCCGGCTATTGTTAT<br>AAGCGCTCCTATTGGGGGCAGGGGACCCAGGTAACTGTTTCCTCAGGAGGCGGT<br>TCCCAGGTTCAGCTCCAGGAGTCTGGTGGAGGCTCCGTCCAAGCCGGGGGCTCA<br>CTGCGCCTGTCATGCGCAGCCAGCGGTTACCCCATAGCAACGGTTATATGGGT<br>TGGTTCAGGCAGGCCCCCGGTAAGAACGCGAGGGCGTCGCTACCATCTACACG<br>GGCGACGGCAGGACTTATTACGCCGACTCTGTCAAGGGGCGTTTTACTATCTCT |

TABLE 1B-continued

| Name | SEQ ID NO: | Sequence |
|---|---|---|
| | | CGCGACAATGCCAAGAACACGGTGGACCTTCAAATGTCCAGTCTGAAGCGGAA<br>GACACTGCCATGTATTACTGCGCAGCGCGTGCGGCCCCTCTGTATTCCTCAGGC<br>AGCCCTCTGACCCGCGCTCGCTACAACGTGTGGGGCCAAGGCACGCAAGTAACT<br>GTGTCCTCT |
| hIL27Ra_<br>VH<br>H20-<br>DR593 | 1476 | CAGGTGCAGCTCCAGGAGTCTGGCGGTGGCCTGGTACAGCCGGGAGGCTCCCTG<br>CGCCTGAGCTGTGCAGCTTCTGGCTTCACCTTCTCTTCCTACCCAATGTCCTGG<br>GTGCGTCAGGCTCCCGGTAAGGGCCTTGAGTGGGTGTCTACCATTTCTTCCGGG<br>GGTGATACCACGTTGTACGCAGACTCCGTGAAGGGCAGGTTCACCAGCTCTCGG<br>GACAATGCCAAGAACACTCTGTACTTGCAGCTGAACTCTTTGAAGACCGAGGAT<br>ACCGCAATGTACTATTGTGCAAAGAGGATCGACTGTAACTCTGGCTATTGTTAT<br>AAGAGAAGCTACTGGGGCAGGGTACTCAGGTGACCGTCTCAAGCGGCGGAAGC<br>GGTGGGTCTGGAGGGAGTGGGCAGGTGCAGCTCCAGGAGTCTGGAGGCGGGAGC<br>GTGCAGGCAGGCGGTAGCCTCCGGCTGTCATGCGCCGCTTCCGGTTATCCCTAT<br>AGCAACGGATACATGGGATGGTTCCGTCAGGCTCCCGGCAAGGAAAGGGAGGGT<br>GTGGCCACGATCTACACAGGGGATGGGAGAACTTATTACGCCGACTCCGTTAAG<br>GGACGCTTCACTATCAGCCGCGACAACGCTAAAAACACTGTGGACCTTCAGATG<br>TCCAGCTTGAAGCCTGAGGATACCGCCATGTATTACTGTGCAGCTCGCGCCGCT<br>CCCCTGTACTCAAGCGGTTCACCCCTCACCCGCGCTCGCTACAACGTCTGGGGG<br>CAGGGCACACAGGTGACTGTGTCCTCT |
| hIL27Ra_<br>VH<br>H20-<br>DR594 | 1477 | CAGGTGCAGTTGCAAGAGAGCGGCGGGGGCCTGGTCCAGCCTGGGGGCTCACTG<br>CGTCTCTCCTGCGCCGCATCTGGATTTACCTTCTCCTCTTATCCTATGAGTTGG<br>GTACGCCAGGCTCCTGGCAAGGGTTTGGAGTGGGTTTCCACAATCTCTAGCGGA<br>GGTGACACTACACTTTACGCTGATAGCGTCAAGGGACGCTTTACCTCATCCAGG<br>GACAACGCTAAGAACACCCTCTATCTCCAGCTGAACTCCCTCAAGACTGAGGAT<br>ACAGCCATGTACTATTGCGCTAAACGCATCGACTGTAACAGCGGATACTGCTAC<br>AAGCGTAGCTACTGGGGCCAGGGCACCCAGGTTACCGTCAGCTCTGGAGGTGGG<br>TCCCAGGTCCAGTTGCAGGAAAGTGGCGGTGGCTCAGTGCAAGCTGGCGGATCT<br>CTGCGCCTGTCCTGTGTGGCCAGCGCGTCTACCTACTGGTACCTACGATATGCAC<br>TGGTACAGACAAGCGCCTGGTAAAGGTAGGGAGTTTGTGAGCGCTATCGACTCC<br>GATGGAACCACGAGGTATGCAGACTCCGTCAAGGGAAGGTTCACTATTTCCCAG<br>GGCACAGCCAAAAACACCGTCTACTTGCAGATGAACAGCTTGCAGCCCGAGGAC<br>ACCGCGATGTACTATTGCAAAACGGTGTGCGTAGTGGGGTCCCGCTGGAGCGAC<br>TACTGGGGCCAGGGAACTCAGGTAACAGTCTCCTCC |
| hIL27Ra_<br>VH<br>H20-<br>DR594 | 1478 | CAGGTCCAGCTGCAAGAGTCTGGGGGCGGACTCGTTCAGCCTGGGGGCAGCCTG<br>CGGCTCAGCTGTGCAGCCTCCGGCTTCACTTTTTCCAGCTACCCTATGTCTTGG<br>GTGCGCCAGGCTCCCGGTAAGGGCCTGGAGTGGGTGTCCACGATTTCTAGTGGG<br>GGTGATACGACCCTGTATGCCGACAGTGTAAAGGGTCGCTTCACAAGCAGTCGT<br>GACAACGCTAAAAACACCCTGTACCTTCAGCTCAATTCCCTGAAAACAGAGGAC<br>ACTGCTATGTATTACTGCGCGAAGCGTATCGACTGTAACAGCGGGTATTGCTAT<br>AAGCGCAGTTATTGGGGCCAGGGCACGCAGGTCACCGTGAGTTCCGGGGGTTCT<br>GGTGGCAGCGGCGGTTCTGGGCAGGTTCAGCTTCAGGAGAGTGGTGGCGGGTCC<br>GTTCAGGCCGGGGGCTCTTTGCGGCTGTCATGCGTGGCGTCCGCTTCTACCTAC<br>TGCACCTATGATATGCACTGGTATCGCCAAGCGCCCGGCAAGGGTCGCGAGTTT<br>GTCAGCGCCATCGACTCCGACGGCACGACTCGGTACGCCGACTCTGTCAAGGGG<br>CGGTTCACGATCTCCCAGGGCACCGCCAAGAACACAGTGTATCTTCAGATGAAC<br>TCTCTGCAACCTGAAGATACTGCAATGTACTATTGTAAGACCGTGTGCGTGGTC<br>GGCTCCAGATGGAGCGACTACTGGGGTCAGGGCACCCAGGTGACTGTGAGTAGT |
| hIL27Ra_<br>VH<br>H20-<br>DR595 | 1479 | CAGGTGCAACTGCAAGAGTCTGGAGGCGGTCTGGTGCAGCCAGGAGGTAGTCTT<br>CGTCTGTCTTGCGCGGCCTCCGGCTTTACATTCTCCAGCTACCCAATGTCCTGG<br>GTGCGTCAGGCCCCCGGCAAGGGCCTGGAGTGGGTTTCTACCATCTCTAGTGGC<br>GGTGACACAACCCTGTACGCTGACTCTGTTAAAGGAAGATTTACCTCCAGTCGC<br>GACAACGCCAAGAACACACTTTACTTGCAACTGAACTCTCTGAAAACCGAGGAC<br>ACCGCCATGTATTACTGCGCTAAGCGTATTGACTGCAATTCAGGCTACTGTTAT<br>AAGCGCTCTTACTGGGGCCAGGGCACTCAGGTCACCGTGTCTTCAGGCGGTGGC<br>TCTCAGGTGCAGCTCCAGGAAAGCGGTGGGGGCTCCGTCCAAGCCGGTGGCAGC<br>CTGACACTTTCCTGTGCTGCCTCCGAATACGCTTACTCAACCTGTAACATGGGC<br>TGGTACAGACAGGCTCCTGGCAAGGAAAGAGAGTTGGTGTCCGCTTTCATCTCT<br>GACGGCTCCACTTATTACGCCGACTCTGTAAAGGGCAGGTTCACGATCACCCGC<br>GACAATGCCAAAAACACCGTCTACTTGCAGATGAACAGCCTGAAGCCGGAAGAC<br>ACAGCAATTACTATTGTAGCGCGAACTGCTATCGGCGTCTGCGCAACTATTGG<br>GGCCAGGGCACCCAGGTCACCGTCTCCTCC |
| hIL27Ra_<br>VH<br>H20-<br>DR595 | 1480 | CAGGTGCAGCTCCAGGAATCTGGGGGCGGTCTGGTTCAGCCGGGCGGTAGTCTG<br>CGGCTCTCCTGTGCCGCAAGCGGTTTTACTTTCTCTAGCTATCCCATGAGTTGG<br>GTTCGGCAGGCCCCAGGTAAAGGGTTGGAGTGGGTATCTACCATCAGCTCTGGA<br>GGTGACACTACCCTGTACGCCGACTCTGTGAAGGGCCGTTTCACCTCTTCACGC<br>GACAACGCAAAAAATACGCTGTACCTCCAGCTCAATTCACTGAAAACTGAGGAC<br>ACCGCTATGTATTACTGTGCGAAGCGCATTGATTGTAACAGCGGATATTGCTAC<br>AAGCGCTCCTACTGGGGACAAGGTACGCAGGTGACTGTCTCCAGCGGCGGTAGC<br>GGGGGGTTCTGGAGGTTCCGGCCAGGTGCAACTGCAAGAGTCCGGGGTGGCTCC<br>GTGCAGGCCGGTGGGTCCCTGACTCTGTCCTGTGCTGCATCAGAATATGCGTAT<br>TCCACTTGCAACATGGGTTGGTACAGGCAGGCTCCCGGAAAAGAGCGCGAGCTG<br>GTCTCCGCCTTCATCAGTGACGGGTCTACCTATTACGCGGACAGTGTGAAGGGC |

TABLE 1B-continued

| Name | SEQ ID NO: | Sequence |
|---|---|---|
| | | CGCTTCACCATCACACGTGATAACGCCAAGAATACCGTGTATTTGCAAATGAAC<br>TCTCTGAAACCCGAGGACACCGCAATCTATTACTGTAGCGCTAACTGCTACCGC<br>CGTCTCAGGAACTATTGGGACAGGGCACGCAGGTCACAGTTTCCTCC |
| hIL27Ra_<br>VH<br>H20-<br>DR596 | 1481 | CAGGTACAGCTTCAAGAGTCTGGGGGAGGTTTGGTGCAGCCTGGTGGGTCCTTG<br>CGGCTGTCCTGTGCCGCGAGCGGGTTTACGTTCTCTTCCTATCCTATGTCTTGG<br>GTGAGGCAAGCGCCGGGCAAGGGCCTTGAATGGGTGTCCACCATCTCTAGCGGA<br>GGCGACACGACCCTTTACGCTGACTCTGTGAAGGGACGCTTTACATCAAGTAGA<br>GACAACGCCAAGAATACACTGTATTTGCAGCTGAACTCCCTGAAGACTGAGGAC<br>ACTGCCATGTATTACTGCGCTAAGAGAATTGACTGCAACTCAGGCTACTGCTAC<br>AAGCGCAGCTACTGGGGCCAGGGAACTCAGGTGACCGTTAGCTCCGGTGGCGGA<br>TCTCAGGTACAGTTGCAAGAGTCAGGAGGTGGCCTGGTGCAGCCCGGCGGTAGC<br>CTGCGTCTTAGCTGTACTGCCAGCGGCTTGACATTCGATGACTCCGTGATGGGT<br>TGGTTTAGACAGGCCCCTGGCAAAGGACGGGAGGCTGTGAGCTGTATCAGCTCT<br>TCAGGAGCTAATGCTTTCTACGCCGACTCCGTCAAGGGACGTTTTACAATCTCT<br>CGTGATAACGCTAAGAATACTCTGTATTTGCAAATGAACTCTCTGAAGCCAGAG<br>GATACCGCTACCTATTACTGCAAGAGAGGCCACGCCTGCGCGGGCTATTACCCC<br>ATTCCTTACGACGATTACTGGGGTCAGGGTACACAGGTGACCGTCAGTTCT |
| hIL27Ra_<br>VH<br>H20-<br>DR596 | 1482 | CAGGTACAGTTGCAGGAGTCTGGAGGCGGACTGGTGCAACCCGGAGGCAGCCTG<br>AGGCTGAGCTGCGCAGCCAGCGGGATTTACCTTCTCCTCTTATCCCATGAGCTGG<br>GTTCGCCAAGCGCCAGGTAAAGGTCTGGAATGGGTCAGCACAATCAGCTCAGGC<br>GGTGACACTACCCTGTACGCAGACTCTGTGAAAGGCCGGTTCACCTCTTCCAGG<br>GATAACGCCAAGAATACGCTCTACCTCCAGCTGAACTCCCTCAAGACTGAAGAC<br>ACCGCGATGTACTATTGCGCAAAGAGAATTGATTGTAACAGCGGTTATTGTTAC<br>AAACGTAGCTACTGGGGTCAGGGCACCCAGGTCACCGTGTCTTCCGGGGGAAGT<br>GGAGGTTCTGGTGGCTCTGGACAGGTACAGTTGCAGGAGAGCGGCGGTGGCCTG<br>GTGCAGCCTGGGGGAAGCCTGCGGCTGAGCTGCACTGCGAGCGGTTTGACTTTC<br>GATGACTCTGTTATGGGTTGGTTCCGTCAGGCCCCTGGTAAGGGCCGTGAGGCG<br>GTTTCCTGCATCTCTTCATCCGGTGCTAACGCTTTTTATGCAGACTCCGTGAAG<br>GGTCGCTTTACAATCAGCAGGGATAACGCGAAAAACACCCTCTACCTGCAAATG<br>AACTCCCTGAAACCCGAAGACACTGCTACCTATTACTGCAAGAGGGGCACGCC<br>TGCGCTGGCTATTACCCTATCCCTTACGATGACTACTGGGGTCAGGGAACCCAG<br>GTCACCGTGTCCTCC |
| hIL27Ra_<br>VH<br>H21-<br>DR591 | 1483 | CAAGTGCAGTTGCAGGAAAGCGGAGGCGGACTTGTTCAGCCAGGGGGATCTTTG<br>CGCCTCAGCTGTGCCGCTTCAGGGTTTACATTCTCCCTGTCTAGCATGAGCTGG<br>GTCCGTCAGGCTCCTGGAAAGGGTCTGGAATGGGTTTCCGCCATTAGCTCCGGC<br>GGTGCCTCCACTTATTACACCGACAGTGTGAAAGGCCGCTTTACAATCAGCCGC<br>GACAACGCCAAGAACATGCTGTACTTGCAACTGAACAGCCTGAAAACCGAGGAC<br>ACCGCCATGTACTATTGTGCCAAGGGTGGGTCCGGCTACGGCGACGCGAGCCGG<br>ATGACCCTCCCCAGGCTCCCAGGGCACCCAGGTCACCGTGAGCAGTGGCGGAGGC<br>TCCCAGGTTCAGTTGCAGGAGTCTGGAGGGGGCTCCGTGCAGGCTGGCGGAAGC<br>CTGCGCCCTGAGCTGCACTGCCTCCGGCGCTATCGCTTCAGGATATATTGATTCC<br>CGTTGGTGTATGGCCTGGTTTAGGCAGGCTCCTGGAAAGGAGCGCGAAGGCGTG<br>GCAGCTATCTGGCCTGGCGGTGGCCTGACCGTATACGCAGATAGTGTCAAGGGC<br>CGCTTCACTATCTCCCGCGACCACGCAAAGAACACGCTGTACCTCCAGATGAAT<br>AACCTGAAGCCTGAGGACACCGCCATGTATTACTGTCCGCTGGCTCACCTCGT<br>ATGTGCCCCTCCCTGGAGTTCGGCTTTGACTACTGGGGCCAGGGAACCCAGGTC<br>ACCGTCTCTTCT |
| hIL27Ra_<br>VH<br>H21-<br>DR591 | 1484 | CAGGTGCAGCTTCAGGAGAGCGGAGGTGGCCTGGTTCAGCCTGGTGGGTCACTC<br>CGCCTGAGTTGTGCGGCCTCAGGATTTACATTCTCCCTCTCCAGCATGTCTTGG<br>GTTAGACAAGCTCCTGGCAAAGGTCTGGAGTGGGTATCCGCCATTAGCTCCGGT<br>GGCGCTTCTACTTACTATACCGACAGCGTGAAGGTCGCTTCACTATCTCCCGC<br>GACAATGCCAAGAACATGCTGTACCTTCAGCTCAATTCTCTGAAGACCGAGGAC<br>ACTGCCGATGTACTATTGCGCCAAGGGAGGCTCTGGTTATGGCGACGCATCTCGC<br>ATGACCCTCCCCCGGTTCCCAAGGCACCCAGGTCACGGTCTCCAGCGGAGGCAGT<br>GGCGGTTCAGGCGGGAGCGGACAGGTGCAGCTCCAGGAGTCCGGCGGGGCTCT<br>GTGCAGGCTGGAGGCTCCCTTCGTCTGAGCTGCACTGCTTCCGGGGCAATCGCG<br>AGCGGCTACATTGATTCTCGTTGGTGTATGGCCTGGTTTCGTCAGGCACCCGGC<br>AAGGAGCGCAAGGCGTTGCTGCAATTTGGCCGGGAGGCGGGTTGACGGTCTAT<br>GCGGACTCCGTGAAGGGCCGCTTCACTATCTCCCGCGACCATGCCAAGAACACA<br>CTGTATCTTCAGATGAATAACCTGAAGCCTGAGGACACTGCAGTGTACTATTGT<br>GCCCGCAGGCTCTCCCCGTATGTGCCCGTCACTGGAATTTGGGTTTGACTATTGG<br>GGCCAAGGCACACAAGTAACCGTGTCCAGC |
| hIL27Ra_<br>VH<br>H21-<br>DR592 | 1485 | CAGGTCCAGCTGCAAGAGTCTGGCGGTGGCCTCGTGCAGCCCGGAGGCAGCCTG<br>AGGCTCAGCTGTGCCGCAAGTGGATTTACCTTTTCACTCAGCTCTATGTCCTGG<br>GTGCGTCAGGCTCCAGGAAAGGGACTGGAGTGGGTGTCTGCTATCTCATCTGGA<br>GGGGCGTCTACATATTACACTGATAGTGTGAAGGGCCGGTTCACCATCAGTCGT<br>GATAACGCGAAAAACATGCTGTACCTGCAACTGAACAGTCTGAAGACTGAGGAC<br>ACCGCCATGTACTATTGTGCAAGGGTGGAAGTGGCTACGGTGATGCGTCAAGA<br>ATGACCCTCTCCCGGTAGTCAGGGAACTCAGGTCACTGTGTCCAGTGGCGGAGGC<br>AGCCAGGTGCAGCTCCAGGAAAGTGGAGGGGGTTCTGTCCAGGCAGGGGGCTCC<br>CTGCGCCTGAGCTGTACCGCCCCGGCTTCACCTCCAACTCCTGTGGAATGGAT<br>TGGTACAGACAGGCTCCCGGCAAGGAGAGGGAGTTCGTTAGCTCCATCTCTACA |

TABLE 1B-continued

| Name | SEQ ID NO: | Sequence |
|---|---|---|
| | | GACGGAACCACTGGGTACGCCGATAGCGTGAAGGGGCGTTTTACCATCTCCAAA GATAAAGCCAAGGATACTGTGTATTTGCAGATGAACTCCCTCAAGCCCGAGGAT ACCGGAATGTATAGCTGCAAAACCAAGGACGGTACTATCGCTACGATGGAGCTG TGCGACTTTGGCTACTGGGGCCAAGGCACCCAGGTGACCGTTTCTAGC |
| hIL27Ra_VH H21-DR592 | 1486 | CAGGTCCAGTTGCAGGAGTCCGGCGGGGGCCTGGTTCAGCCGGGTGGCTCTCTG CGCCTGAGCTGCGCCGCTTCTGGCTTCACTTTCTCTCTCAGCTCTATGTCCTGG GTCAGACAAGCGCCGGGCAAAGGTTTGGAGTGGGTGTCTGCTATTTCATCCGGT GGCGCGAGTACCTACTATACCGATTCCGTGAAGGGCCGCTTCACTATTAGCCGG GACAATGCTAAGAACATGCTGTACCTTCAGCTCAATTCTCTGAAAACCGAGGAC ACTGCCATGTATTACTGCGCTAAGGGAGGTTCAGGATACGGCGATGCCTCCAGG ATGACTAGCCCAGGCAGCCAAGGGACACAGGTCACCGTTTCCAGTGGGGGCTCC GGCGGTTCTGGCGGTAGCGGCCAAGTGCAGCTGCAAGAGTCCGGCGGGGGCAGC GTTCAAGCTGGGGGTAGCCTCAGGCTTTCCTGCACAGCTCCAGGTTTCACCAGC AACAGTTGCGGAATGGACTGGTATCGCCAAGCGCCAGGTAAGGAGAGGGAGTTT GTTTCCAGCATCTCTACCGACGGCACCACGGGATATGCTGATTCTGTGAAGGGA CGCTTTACCATCTCTAAGGATAAAGCGAAGGACACCGTGTACTTGCAGATGAAC AGCCTGAAGCCCGAGGATACCGGCATGTATAGCTGCAAAACTAAGGACGGAACC ATTGCGACAATGGAACTCTGCGATTTCGGATACTGGGGTCAGGGAACCCAGGTG ACTGTGTCTAGC |
| hIL27Ra_VH H21-DR593 | 1487 | CAGGTCCAGCTCCAGGAATCTGGCGGAGGGCTGGTGCAGCCGGGCGGTAGCCTC CGGTTGTCCTGCGCTGCCAGCGGCTTTACCTTTTCCCTCAGCTCCATGTCTTGG GTGCGCCAGGCACCCGGAAAAGGATTGGAGTGGGTGTCCGCTATCTCATCCGGG GGAGCCAGCACGTATTACACTGATTCCGTGAAGGGCCGCTTCACCATTTCTCGC GATAACGCTAAAAACATGCTGTATTTGCAGCTTAACTCCCTGAAAACAGAAGAT ACCGCGATGTATTACTGTGCTAAGGGTGGGTCCGGCTACGGCGACGCATCTCGT ATGACCAGCCCTGGCAGCCAGGGCACGCAGGTCACCGTGTCAAGCGGAGGCGGT TCCCAGGTTCAGTTGCAGGAGAGCGGTGGCGGTAGCGTGCAGGCTGGGGGTTCC CTTCGCCTCTCTTGCGCGGCTTCCGGTTATCCATACAGCAACGGCTATATGGGG TGGTTCAGACAGGCACCCGGCAAGGAACGCGAAGGCGTGGCAACCATCTACACT GGCGACGACGCACGTACTATGCTGACAGCGTTAAAGGCCGTTTTACTATCAGC CGCGACAATGCGAAGAACACCGTCGATTTGCAGATGTCAAGTCTGAAGCCAGAA GACACAGCCATGTACTATTGCGCTGCGAGAGCCGCTCCCCTCTACTCTAGCGGC AGCCCCCTGACCCGCGCACGTTACAATGTGTGGGGCCAGGGCACCCAGGTGACC GTCTCCTCC |
| hIL27Ra_VH H21-DR593 | 1488 | CAGGTGCAGCTTCAAGAATCTGGCGGGGGCTTGGTGCAGCCCGGCGGTAGCCTC CGGTTGAGCTGCGCCGCTTCAGGGTTTACCTTCAGCTTGTCATCCATGTCATGG GTGCGCCAGGCCCCCGGCAAGGGACTGGAGTGGGTCAGCGCCATCAGTAGCGGG GGAGCGTCAACTTATTACACTGACTCCGTCAAGGGTCGCTTCACAATTAGCCGG GACAACGCCAAGAACATGCTGTACCTCCAGTTGAACTCCCTGAAAACTGAGGAC ACAGCCATGTACTATTGCGCCAAAGGGGGTAGCGGTTATGGCGACGCTTCCCGC ATGACCTCTCCCGGCTCCCAAGGCACCCAGGTCACTGTAAGCTCAGGAGGGAGC GGCGGTTCCGGTGGCAGCGGACAGGTCCAGCTCCAGGAGAGTGGAGGCGGATCA GTGCAAGCCGGTGGCTCCCTCAGGCTCTCCTGCGCTGCGTCTGGCTACCCATAT AGCAACGGCTACATGGGATGGTTCCGCCAGGCCCCAGGCAAAGAGCGGGAGGGC GTTGCCACCATCTACACCGGGGATGGCCGTACCTATTACGCAGACTCCGTGAAG GGGAGGTTTACCATCTCTCGGGACAATGCCAAAAACACGGTGACCTCCAGATG AGTTCCCTGAAGCCCGAAGACACCGCCATGTATTACTGCGCAGCCAGAGCCGCT CCTTTGTACTCCTCAGGTAGCCCCCTCACCCGTGCTCGCTATAATGTATGGGA CAGGGCACTCAAGTGACCGTGTCCTCC |
| hIL27Ra_VH H21-DR594 | 1489 | CAGGTTCAGCTTCAGGAGTCTGGTGGGGGCCTGGTGCAGCCAGGTGGCAGCTTG CGCCTGTCCTGCGCGGCCAGCGGATTTACTTTCTCTCTCAGCTCCATGTCTTGG GTGAGGCAGGCTCCAGGTAAGGGCCTGGAGTGGGTTTCTGCTATTAGCTCCGGG GGAGCTTCCACATATTACACAGATTCTGTGAAAGGTCGTTTCACGATCTCTCGC GACAACGCCAAAAACATGCTGTACCTTCAGCTGAACAGCCTGAAAACCGAAGAC ACAGCTATGTACTATTGCGCCAAGGGAGGTAGCGGGTACGGCGACGCCTCCAGG ATGACAAGTCCCGGTTCCCAGGGACCCAGGTGACGGTCAGCTCCGGTGGAGGT AGTCAAGTCCAACTTCAGGAGTCCGGCGGTGGCTCCGTTCAGGCTGGCGGTTCT CTGCGTCTGTCTTGTGTGGCGTCCGCTTCCACCTACTGCACTTATGATATGCAC TGGTACAGGCAAGCGCCCGGTAAGGGGCGCGAGTTTGTTTCCGCCATTGATTCC GATGGGACCACTCGGTATGCGGACAGCGTCAAGGGCCGCTTCACTATCTCACAG GGTACAGCCAAGAACACAGTGTACCTCCAGATGAACTCATTGCAACCCGAGGAC ACGGCCATGTACTATTGTAAGACAGTCTGCGTGGTCGGTTCCAGATGGTCAGAC TACTGGGCCAAGGGACCCAAGTCACAGTCTCCTCA |
| hIL27Ra_VH H21-DR594 | 1490 | CAGGTGCAACTCCAGGAAAGTGGCGGTGGCCTTGTTCAGCCTGGAGGCTCCCTG CGGCTTAGCTGCGCTGCCTCCGGGTTTACTTTCTCACTGTCATCTATGAGCTGG GTCCGGCAAGCTCCAGGGAAGGGCCTGGAATGGGTCAGCGCTATCTCTTCCGGC GGAGCCCTCAACTTACTATACTGACTCCGTGAAGGGCCGGTTTACCATCAGTCGC GACAACGCTAAGAACATGCTGTACCTTCAGCTGAACAGCCTGAAGACTGAAGAT ACTGCTATGTACTATTGCGCCAAAGGCGGTTCCGGGTACGGCGACGCCTCTCGG ATGACCTCTCCGGGTTCCCAAGGCACCCAGGTTACCGTGTCCAGTGGGGGCTCC GGGGGTAGCGGTGGCTCTGGCCAGGTGCAGCTCCAGGAATCCGGTGGCGGGTCC GTGCAGGCTGGAGGGTCACTGCGCCTGTCCTGCGTGGCCAGCGCCTCTACCTAC |

TABLE 1B-continued

| Name | SEQ ID NO: | Sequence |
|---|---|---|
| | | TGCACATACGACATGCACTGGTACAGGCAAGCTCCAGGTAAGGGTCGGGAGTTT<br>GTCAGCGCTATCGACAGCGACGGCACAACTCGCTATGCGGATAGCGTCAAGGGG<br>CGTTTTACCATCAGCCAAGGGACTGCCAAAAACACAGTGTATCTCCAGATGAAC<br>TCTCTCCAGCCAGAGGATACTGCCATGTATTACTGCAAGACCGTGTGCGTTGTG<br>GGGTTCACGTTGGTCCGACTATTGGGGCCAAGGCACACAGGTGACCGTGTCCTCA |
| hIL27Ra_<br>VH<br>H21-<br>DR595 | 1491 | CAGGTGCAGCTCCAGGAATCTGGCGGGGGTCTGGTGCAGCCCGGCGGGTCTTTG<br>CGCCTCTCATGTGCAGCCTCTGGGTTTACCTTCTCTCTGTCCAGCATGTCTTGG<br>GTTAGGCAGGCCCCAGGTAAGGGGCTGGAGTGGGTTTCCGCCATCTCATCCGGC<br>GGTGCCAGCACATATTACACCGACTCCGTCAAGGGGAGATTCACCATCAGCCGG<br>GACAACGCCAAGAACATGCTGTATCTCCAGCTCAACTCCCTGAAAACCGAGGAC<br>ACCGCCATGTATTACTGCGCCAAGGGCGGTTCCGGCTATGGTGATGCTTCAAGG<br>ATGACTAGCCCCGGTTCCCAGGGCACCCAAGTCACTGTATCCAGCGGGGGAGGC<br>TCCCAGGTGCAGCTTCAGGAGTCTGGCGGTGGCAGCGTGCAGGCCGGGGCTCC<br>CTGACACTGTCCTGTGCCGCTTCCGAGTACGCCTATTCCACGTGTAACATGGGA<br>TGGTATCGCCAGGCTCCTGGCAAGGAGCGCGAGCTGGTCAGCGCCTTTATCTCC<br>GACGGCAGCACTTATTACGCCGACTCCGTGAAGGGACGCTTCACAATCACTCGC<br>GACAACGCCAAGAATACTGTGTACCTCCAGATGAACAGCCTCAAGCCTGAGGAT<br>ACCGCCATCTATTACTGCTCTGCTAATTGCTATCGTCGGCTGCGCAACTACTGG<br>GGACAAGGAACACAGGTGACCGTGTCATCT |
| hIL27Ra_<br>VH<br>H21-<br>DR595 | 1492 | CAGGTTCAACTCCAGGAAAGCGGAGGTGGACTTGTGCAGCCTGGCGGTTCCCTT<br>CGGCTGTCCTGCGCTGCCTCTGGCTTCACTTTCTCACTCTCATCCATGAGCTGG<br>GTCCGCCAGGCCCCCGGCAAAGCCTGGAGTGGGTGAGTGCTATCTCCTCTGGC<br>GGAGCTTCCACCTACTATACTGACTCTGTGAAGGGCCGCTTCACCATTAGTCGG<br>GACAACGCCAAGAACATGCTGTACTTGCAGCTGAACTCACTGAAGACCGAGGAC<br>ACTGCCATGTACTATTGCGCTAAGGGAGGCTCCGGGTACGGCGACGCCTCCAGA<br>ATGACATCTCCCGGCTCTCAGGGGACCCAGGTCACGGTGTCCAGCGGCGGGTCC<br>GGGGGGCTCCGGCGGATCTGGTCAGGTACAACTTCAGGAGTCAGGCGGAGGCAGC<br>GTTCAAGCCGGAGGCTCCTTGACACTGTCCTGCGCGGCCTCTGAGTACGCATAC<br>AGTACCTGCAACATGGGCTGGTATCGGCAGGCCCCCGGAAAGGAGCGCGAATTG<br>GTTTCTGCTTTCATCAGCGATGGATCTACTTATTACGCCGACTCTGTAAAAGGT<br>AGATTCACTATTACTCGTGACAACGCTAAAAACACGGTGTATCTGCAAATGAAC<br>AGCCTGAAGCCCGAGGACACTGCCATTTATTACTGTTCCGCTAATTGTTACCGT<br>AGGCTGCGCAATTACTGGGGTCAGGGTACTCAGGTCACTGTATCCAGC |
| hIL27Ra_<br>VH<br>H21-<br>DR596 | 1493 | CAAGTCCAACTGCAAGAGTCTGGTGGAGGCTTGGTACAGCCCGGAGGGAGCCTG<br>CGCCTCTCCTGCGCAGCCTCTGGCTTCACCTTCTCTCAGCTCAATGTCCTGG<br>GTGAGGCAGGCCCCCGGAAAGGGCCTTGAGTGGGTGTCTGCTATCTCCTCTGGA<br>GGGGCCAGCACCTACTATACAGACAGCGTCAAGGGCAGATTTACCATTAGTCGT<br>GATAATGCTAAAAATATGCTCTACTTGCAGCTGAACTCCCTGAAAACAGAGGAC<br>ACCGCCATGTACTATTGCGCCAAGGGCGGTTCAGGATATGGAGATGCCAGTCGC<br>ATGACCAGCCCCGGTAGTCAGGGTACAAGTGACCGTATCTAGCGGCGGAGGC<br>TCTCAGGTGCAGCTCCAGGAGTCTGGAGGGGGCTTGGTGCAGCCGGGAGGCTCT<br>CTCCGCCTTAGTTGTACTGCCTCTGGACTGACTTTCGATGACTCAGTGATGGGC<br>TGGTTCCGCCAGGCCCCAGGCAAGGGCAGAGAGGCCGTGTCTTGTATCAGCAGT<br>AGCGGGGCCAACGCTTTCTATGCCGACTCTGTCAAGGGCCGTTTCACCATCTCT<br>CGCGACAACGCTAAGAATACCCTGTACCTCCAAATGAACTCCCTGAAACCCGAG<br>GACACAGCAACGTATTACTGTAAGAGAGGTCATGCTTGTGCGGGGTATTACCCA<br>ATTCCCTATGACGATTACTGGGGCCAGGGGACCCAGGTAACAGTAAGCTCC |
| hIL27Ra_<br>VH<br>H21-<br>DR596 | 1494 | CAGGTGCAGTTGCAGGAGTCCGGCGGTGGGCTGGTCCAGCCTGGGGGCAGCCTG<br>CGCCTTAGTTGCGCCGCTTCCGGCTTCACCTTTAGCCTTAGCAGTATGAGCTGG<br>GTGAGACAGGCCCCAGGCAAGGGGCTGGAGTGGGTGTCCGCAATTTCTTCCGGG<br>GGTGCGAGCACCTATTACACTGATAGCGTTAAGGGACGTTTCACCATTTCTCGC<br>GACAACGCTAAGAACATGCTGTACCTCCAGCTCAACAGCCTGAAGACAGAAGAT<br>ACTGCTATGTATTACTGTGCAAAGGGAGGCAGCGGCTACGGCGATGCGAGCCGG<br>ATGACCAGTCCGGGGTCCCAGGGCACTCAGGTCACCGTTAGCTCCGGCGGGTCT<br>GGCGGTTCCGGCGGTTCCGGTCAAGTTCAGCTGCAAGAGAGCGGTGGGGGACTG<br>GTGCAGCCGGGAGGCTCCCTGCGCCTGAGTTGCACCGCTTCCGGTCTGACCTTT<br>GACGATTCCGTTATGGGCTGGTTTCGCCAAGCCCCTGGCAAGGGGAGGGAAGCT<br>GTGTCCTGCATTTCTAGCTCTGGCGCTAACGCCTTCTATGCCGATTCCGTGAAG<br>GGCCGCTTCACGATCAGCCGCGACAACGCCAAGAACACCCTGTACCTGCAAATG<br>AACTCATTGAAGCCCGAGGATACCGCCACCTATTACTGCAAACGCGGCCATGCT<br>TGCGCGGGCTATTACCCGATTCCTTACGACGATTACTGGGGTCAAGGCACCCAG<br>GTGACAGTCTCCTCC |
| hIL27Ra_<br>VH<br>H22-<br>DR591 | 1495 | CAGGTGCAGCTCCAGGAATCCGGCGGAGGCTCTGTGCAGGCTGGTGGCAGCCTG<br>AGGCTGAGTTGCCGCGCTTCCGGCTCCACTTATAGCAACTACTGTCTGGGCTGG<br>TTTGCCAGACAACCGGAAAGAAAGAGAAGGCGTGGCCGTGATTAACTGGGTC<br>GGCGGGATGCTCTACTTTGCCGATAGTGTGAAAGGTCGTTTCACGGTCTCCCAG<br>GACCAGGCCAAAAACACCGTTACCTCCAGATGAACTCCCTGAAGCCTGAGGAT<br>ACTGCGATGTATTACTGCGCCGCTGAGTCCGTCTCTTCCTTCTCCTGCGGGGGC<br>TGGCTGACACGCCCCGACAGAGTCCCTTATTGGGGCCAAGGAACTCAGGTAACA<br>GTGTCTTCCGGTGGCGGTTCCCAGGTACAGCTTCAGGAGTCTGGTGGCGGTTCT<br>GTTCAGGCCGGGGCTCCCTGCGCCTGTCCTGCACTGCTTCTGGCGCTATCGCA<br>AGCGGATATATTGATAGTCGCTGGTGTATGGCATGGTTCAGACAAGCCCCCTGGG TABLE 1B-continued

| Name | SEQ ID NO: | Sequence |
|---|---|---|
| | | AAGGAGCGCGAAGGCGTGGCGGCCATCTGGCCAGGCGGTGGGCTGACTGTCTAC<br>GCTGACAGCGTTAAAGGTCGCTTCACCATCTCAAGAGATCATGCTAAGAACACT<br>CTCTACCTCCAGATGAACAATCTGAAGCCTGAGGACACCGCCATGTATTACTGT<br>GCTGCGGGAAGCCCCCGCATGTGTCCTAGCCTGGAGTTCGGGTTCGACTACTGG<br>GGTCAGGGGACCCAGGTCACAGTGTCCAGC |
| hIL27Ra_<br>VH<br>H22-<br>DR591 | 1496 | CAAGTGCAACTCCAAGAATCTGGAGGTGGCTCTGTGCAGGCGGGCGGTTCCCTG<br>AGACTGTCTTGCAGAGCAAGCGGCAGTACTTACTCTAACTACTGTTTGGGATGG<br>TTCCGGCAGACAACCGGCAAAGAGAGGGAAGGCGTGGCCGTAATCAACTGGGTG<br>GGTGGCATGTTGTACTTCGCGGATAGCGTTAAGGGCCGCTTCACAGTTTCCCAG<br>GATCAGGCCAAGAACACCGTGTACTTGCAAATGAACTCTCTGAAGCCGGAGGAC<br>ACCGCCATGTATTACTGCGCTGCCGAGTCAGTATCTTCATTTAGCTGTGGCGGA<br>TGGTTGACTAGGCCGGACAGGGTCCCTTACTGGGGCCAGGGCACACAGGTGACT<br>GTGTCCTCTGGCGGAAGCGGGGGTTCAGGAGGCTCTGGGCAGGTGCAGTTGCAG<br>GAGAGCGGCGGGGGCTCTGTCCAGGCTGGAGGGAGCCTCAGGCTCTCATGCACA<br>GCCTCTGGGCTATCGCATCAGGATATATTGATTCTCGGTGGTGCATGGCTTGG<br>TTCAGACAGGCACCGGGAAAGGAGCGCGAAGGTGTGGCGGCCATCTGGCCTGGC<br>GGGGGCCTGACCGTGTATGCCGATTCCGTGAAGGGTCGTTTCACCATCTCCCGT<br>GACCACGCGAAGAATACCCTGTATTTGCAGATGAATAACCTGAAGCCCGAAGAT<br>ACCGCCATGTATTACTGCGCTGCCGGGAGCCCACGTATGTGCCCTTCTTTGGAG<br>TTCGGTTTCGATTACTGGGGTCAGGGGACCCAGGTGACCGTCTCCTCC |
| hIL27Ra_<br>VH<br>H22<br>DR592 | 1497 | CAGGTGCAACTCCAGGAGAGCGGCGGGGGCAGTGTGCAGGCCGGAGGTTCCTTG<br>CGCCTGTCTTGTCGTGCGTCAGGAAGCACATACAGCAACTACTGCCTCGGGTGG<br>TTCAGGCAGACTACCGGCAAGGAACGTGAAGGTGTAGCCGTGATTAACTGGGTG<br>GGCGGAATGCTGTACTTCGCGGACTCCGTGAAGGGCCGCTTCACCGTGTCTCAG<br>GACCAGGCCAAGAACACCGTTTATCTCCAGATGAACTCCCTGAAGCCGGAGGAC<br>ACGGCCATGTATTACTGCGCTGCCGAGTCCGTGTCTTCATTCCTGCGGTGGC<br>TGGTTGACTCGCCCTGATCGCGTGCCCTATTGGGGTCAGGGCACACAGGTGACA<br>GTCAGCTCTGGTGGAGGTTCACAGGTCCAGCTCCAGGAGAGTGGCGGGGGTAGC<br>GTTCAGGCCGGAGGCTCCCTGCGCCTGAGCTGTACCGCCCCAGGCTTTACCTCT<br>AATAGCTGTGGAATGGACTGGTATCGTCAGGCTCCTGGTAAGGAACGCGAGTTC<br>GTCTCTAGCATCTCAACCGACGGGACTACCGGCTATGCGGACTCTGTGAAGGGT<br>CGTTTCACCATTAGCAAGGACAAGGCCAAGGACACAGTGTACCTTCAGATGAAC<br>TCACTGAAGCCCGAGGACACTGGCATGTATAGCTGCAAAACTAAAGATGGAACC<br>ATCGCCACTATGGAACTGTGCGATTTCGGCTACTGGGGCCAGGGCACGCAGGTG<br>ACCGTGTCTTCC |
| hIL27Ra_<br>VH<br>H22-<br>DR592 | 1498 | CAGGTGCAGTTGCAGGAGAGTGGTGGAGGCAGTGTGCAGGCCGGTGGCTCTCTT<br>AGACTGAGCTGCCGCGCCAGTGGCTCCACCTACTCCAACTATTGTCTGGGATGG<br>TTTCGTCAGACCACTGGTAAAGAGCGGGAGGGGGTGGCCGTCATCAACTGGGTT<br>GGGGGGTATGCTGTACTTTGCTGACTCTGTCAAGGGGCGGTTCACAGTCTCACAG<br>GACCAAGCCAAGAATACCGTGTACCTCCAGATGAACAGTCTGAAGCCGGAGGAT<br>ACCGCTATGTATTACTGCGCAGCCGAATCCGTCAGCTCTTTCTCCTGCGGAGGC<br>TGGCTCACGCGCCCTGACAGGGTTCCCTACTGGGGCCAAGGAACGCAGGTGACA<br>GTTTCTAGTGGTGGGTCCGGCGGTAGCGGAGGCTCCGGCCAGGTGCAGCTCCAG<br>GAATCCGGCGGAGGTTCCGTGCAGGCCGGAGGCTCCCTCCGCCTGAGCTGCACA<br>GCCCCCGGTTTCACCTCCAATTCTTGCGGCATGGACTGGTATCGCCAGGCTCCG<br>GGCAAGGAGCGTGAGTTCGTGTCCAGTATTTCTACGGACGGCACTACCGGGTAC<br>GCTGACTCCGTTAAGGGCCGCTTTACCATTAGCAAAGACAAGGCGAAGGACACA<br>GTCTATCTCCAGATGAATAGTCTGAAGCCGGAGGATACCGGCATGTACTCATGC<br>AAAACAAAGGATGGCACGATTGCGACAATGGAGCTGTGCGACTTCGGGTATTGG<br>GGCCAGGGCACGCAGGTGACGGTGTCCTCC |
| hIL27Ra_<br>VH<br>H22-<br>DR593 | 1499 | CAGGTACAGCTCCAGGAATCCGGTGGGGGTTCAGTTCAGGCCGGGGGTAGCCTT<br>CGGCTGTCCTGCCGCGCGAGTGGCTCCACCTATAGCAACTACTGCCTGGGATGG<br>TTCCGCCAGACCACAGGCAAGGAGCGTGAGGGCGTCGCTGTAATAAATTGGGTT<br>GGGGGGAATGTTGTACTTTGCGGACAGTGTGAAGGGACGTTTCACCGTCAGTCAG<br>GACCAGGCCAAGAACACCGTTTACCTCCAGATGAACAGCCTCAAGCCCGAGGAT<br>ACCGCCATGTATTACTGCGCGGCTGAGTCTGTTTCTTCCTTCTTGTGGGGAC<br>TGGCTGACCAGGCCCGACAGAGTCCCATACTGGGGCCAGGGGACCCAGGTGACA<br>GTTAGCTCCGGCGGTGGCTCACAGGTGCAGCTGCAAGAGAGCGGCGGTGGCTCC<br>GTCCAAGCGGGCGGGTCACTCAGACTGTCTTGCGCAGCTAGTGGTTACCCGTAT<br>TCAAACGGTTACATGGGATGGTTTAGACAGGCACCAGGCAAAGAGCGCGAAGGC<br>GTCGCTACCATCTACACAGGAGATGGCCGCACCTATTACGCCGACAGCGTGAAA<br>GGCAGGTTTACAATTAGTCGCGACAACGCCAAGAACACTGTCGATCTTCAGATG<br>TCTTCCTTGAAGCCAGAAGCACCGCCATGTATTACTGTGCAGCGCGGGCAGCC<br>CCACTTTATTCCAGCGGCTCTCCCCTCACCCGCGCCCGGTATAACGTCTGGGGC<br>CAAGGTACTCAGGTGACCGTGAGTTCT |
| hIL27Ra_<br>VH<br>H22-<br>DR593 | 1500 | CAGGTGCAGTTGCAGGAATCAGGTGGAGGCTCTGTGCAGGCCGGTGGATCTCTG<br>CGGCTCAGCTGCCGGGCGTCCGGGAGCACTTACAGCAATTACTGTTTGGGGTGG<br>TTTCGGCAGACCACTGGTAAGGAGAGAGGGAGTGGCCGTTATCAACTGGGTC<br>GGAGGTATGCTCTACTTCGCTGACAGCGTCAAGGGACGCTTCACCGTGTCCCAG<br>GACCAGGCTAAGAATACCGTTTATCTCCAGATGAATAGCCTGAAGCCTGAGGAC<br>ACCGCTATGTATTACTGTGCGGCTGAGAGCGTCAGCTCTTTCTCCTGCGGTGGA<br>TGGCTCACACGCCCCGACCGTGTCCCATATTGGGGACAAGGCACTCAGGTGACC |

TABLE 1B-continued

| Name | SEQ ID NO: | Sequence |
|---|---|---|
| | | GTCAGCTCAGGAGGCAGCGGGGGTAGCGGGGGTTCCGGCCAAGTGCAGCTCCAG<br>GAGTCTGGGGGCGGAAGCGTGCAGGCCGGTGGGAGCTTGCGCCTGTCCTGTGCT<br>GCGTCTGGCTACCCTTACAGTAACGGCTATATGGGCTGGTTCCGGCAGGCCCCT<br>GGCAAGGAAAGGGAGGGTGTGGCCACTATCTACACTGGTGATGGTAGGACATAT<br>TACGCCGATAGCGTGAAGGGCCGGTTCACGATCTCTCGTGATAACGCCAAAAAT<br>ACCGTGGATCTTCAGATGTCATCCCTCAAGCCCGAGGATACCGCTATGTACTAT<br>TGCGCAGCCCGCGCTGCCCCGCTCTACAGCAGTGGAAGCCCGTTGACCCGCGCC<br>CGTTACAACGTGTGGGGTCAGGGCACACAAGTCACTGTCTCCTCA |
| hIL27Ra_<br>VH<br>H22-<br>DR594 | 1501 | CAAGTCCAACTTCAGGAGTCAGGGGGAGGTTCTGTTCAAGCCGGGGGTTCACTG<br>AGGCTCTCTTGCCGCGCCTCCGGCTCAACATACTCCAACTATTGTCTGGGCTGG<br>TTCAGGCAGACAACCGGGAAGGAGCGCGAGGGTGTGGCCGTCATCAACTGGGTC<br>GGCGGGATGCTGTACTTTGCAGATTCCGTGAAGGGCCGGTTTACAGTGAGCCAG<br>GACCAGGCTAAGAACACCGTGTACCTGCAAATGAACTCTCTGAAACCCGAGGAT<br>ACAGCGATGTATTACTGCGCTGCGGAGTCCGTGTCTAGCTTCTCTTGCGGGGGC<br>TGGCTGACCCGTCCTGATAGAGTCCATACTGGGGACAGGGGACACAGGTGACC<br>GTGAGCAGTGGGGTGGCAGCCAGGTGCAGCTTCAGGAAAGCGGAGGTGGCTCA<br>GTACAGGCGGGAGGCAGTCTGCGCCTGTCTTGCGTGGCCTCCGCATCCACCTAT<br>TGCACCTACGACATGCACTGGTACAGGCAGGCACCTGGCAAGGGTCGCGAGTTT<br>GTCAGTGCTATCGACTCCGACGGCACCACTCGGTACGCAGATTCCGTCAAGGGC<br>CGGTTTACCATCTCCCAGGGCACAGCTAAAAACACTGTTTACCTCCAAATGAAC<br>TCCCTCCAGCTGAGGATACCGCTATGTATTACTGCAAGACAGTCTGTGTAGTG<br>GGCTCCCGTTGGTCCGATTACTGGGGCCAGGGGACCCAAGTTACGGTTTCTAGC |
| hIL27Ra_<br>VH<br>H22-<br>DR594 | 1502 | CAAGTCCAACTCCAGGAAAGCGGGGGTGGCTCAGTCCAAGCAGGGGGCTCTCTC<br>AGACTGAGTTGCAGGGCAGGCGGTTCCACCTACTCAAACTACTGCCTGGTTGG<br>TTTCGGCAGACTACCGGCAAGGAAAGGGAGGGCGTGGCGGTCATTAACTGGGTA<br>GGGGGTATGCTCTACTTTGCAGACTCCGTGAAGGGCAGATTTACAGTATCCCAG<br>GACCAGGCTAAGAACACGGTGTACCTGCAAATGAACTCTCTGAAGCCAGAGGAC<br>ACCGCCATGTACTATTGCGCGGCAGAGTCAGTGAGCAGTTTTTCTTGTGGGGGC<br>TGGCTCACCCGCCCGGACCGCGTGCCTTACTGGGGACAAGGAACGCAGGTTACA<br>GTCTCTTCCGGCGGAAGCGGGGGCAGTGGTGGCAGCGGTCAGGTTCAGCTTCAG<br>GAGAGTGGCGGAGGCAGCGTGCAGGCAGGGGGTTCCCTGAGGCTGTCCTGTGTG<br>GCCTCTGCGAGTACGTATTGCACCTACGACATGCACTGGTATCGCCAGGCTCCT<br>GGTAAGGGCCGTGAGTTCGTGTCCGCCATCGACAGCGACGGAACCACACGGTAC<br>GCTGATTCCGTGAAAGGCAGGTTCACTATTTCCCAAGGAACTGCCAAAAACACT<br>GTCTACCTCCAGATGAACAGCCTCCAGCCTGAGGATACAGCCATGTACTATTGC<br>AAGACTGTGTGCGTGGTCGGCTCTCGTTGGTCCGACTACTGGGGCCAGGGCACC<br>CAGGTCACCGTGTCCAGT |
| hIL27Ra_<br>VH<br>H22-<br>DR595 | 1503 | CAGGTGCAGCTCCAGGAGAGCGGTGGCGGGAGTGTTCAGGCGGGCGGTAGCCTG<br>AGACTGTCATGCAGAGCATCTGGCTCTACGTACTCTAACTACTGTCTTGGCTGG<br>TTCCGCCAGACGACCGGAAAGGAGCGTGAGGGCGTCGCTGTGATTAACTGGGTG<br>GGCGGGATGTTGTACTTCGCCGATTCCGTGAAGGGCAGATTCACTGTGAGCCAG<br>GATCAGGCTAAGAACACTGTGTACCTTCAGATGAACGCTTGAAGCCCGAAGAC<br>ACTGCCATGTACTATTGTGCAGCTGAATCTGTGAGCAGTTTCTCATGCGGTGGG<br>TGGCTTACCAGACCGGATAGAGTGCCTTACTGGGGCCAGGGACCCAGGTTACC<br>GTGTCTAGCGGGGTGGATCTCAGGTGCAGCTCCAGGAGTCCGGCGGGGGCTCC<br>GTTCAGGCTGGGGGTAGTCTCACTCTGTCCTGTGCCGCTTCTGAGTACGCCTAC<br>AGTACATGCAACATGGGCTGGTATCGCCAGGCTCCGGGGAAGGAACGCGAACTT<br>GTGAGCGCCTTCATCTCCGATGGCTCTACCTATTACGCCGACTCCGTGAAGGGC<br>AGGTTTACCATCACTCGCGACAACGCTAAGAACACTGTCTACTTGCAGATGAAC<br>TCACTGAAACCCGAGGATACTGCCATCTATTACTGTTCCGCTAACTGCTATAGG<br>CGGCTGAGAAACTATTGGGGACAGGGGACCCAGGTGACTGTCTCTAGC |
| hIL27Ra_<br>VH<br>H22-<br>DR595 | 1504 | CAAGTGCAACTCCAGGAAAGTGGAGGTGGCTCCGTGCAAGCCGGAGGCAGTCTC<br>CGCCTGAGCTGTCGTGCGAGCGGTTCCACCTATAGCAACTACTGCCTGGGATGG<br>TTTAGACAGACAACCGGGAAGGAGCGGGAGGGAGTCGCGGTGATAAATTGGGTG<br>GGCGGTATGCTGTACTTCGCGGATTCTGTCAAGGGGAGATTCACCGTGAGCCAG<br>GATCAGGCGAAGAACACTGTGTACCTTCAGATGAACTCTCTCAAGCCGGAGGAC<br>ACAGCCATGTACTATTGTGCTGCCGAGTCTGTTTCATCCTTCTCCTGTGGCGGT<br>TGGCTGACCCGCCCAGATCGCGTGCCTTACTGGGGCCAGGGTACTCAGGTCACC<br>GTCTCTTCCGGGGGTTCAGGCGGTAGCGGTGGCTCCGGCCAGGTTCAACTCCAG<br>GAAAGCGGAGGCGGTTCTGTGCAAGCCGGGGCTCCCTGACCCTGTCCTGTGCT<br>GCCAGCGAGTACGCCTATAGCACTTGTAACATGGGATGGTATCGCCAGGCCCCA<br>GGAAAAGAACGCGAGCTTGTGAGTGCTTTTATCTCTGACGGGTCCACCTATTAC<br>GCGGACTCTGTGAAAGGTCGCTTCACAATCACCCGCGATAACGCAAAGAACACT<br>GTCTACCTTCAGATGAACTCCCTGAAGCCCGAGGCACTGCGATTTATTACTGT<br>AGCGCCAACTGTTACCGCCGTCTCCGCAACTACTGGGGACAGGGGACCCAGGTG<br>ACCGTCTCATCC |
| hIL27Ra_<br>VH<br>H22-<br>DR596 | 1505 | CAGGTCCAACTTCAGGAGTCTGGCGGAGGCAGCGTGCAAGCGGGTGGGAGCCTG<br>CGCCTTTCCTGCCGCGCGTCTGGCAGCACCTACTCCAACTACTGCCTGGGATGG<br>TTTCGCCAGACCACAGGTAAGGAGCGTGAAGGTGTGGCCGTCATCAACTGGGTC<br>GGCGGTATGCTGTATTTCGCTGATTCCGTTAAGGGCAGATTTACTGTGAGTCAG<br>GACCAGGCAAAGAACACAGTGTACCTTCAGATGAATAGCCTGAAGCCCGAAGAC<br>ACTGCCATGTACTATTGCGCAGCCGAATCTGTGTCTAGCTTTTCCTGCGGTGGG |

TABLE 1B-continued

| Name | SEQ ID NO: | Sequence |
|---|---|---|
| | | TGGCTGACCCGCCCTGATCGCGTGCCATACTGGGGGCAGGGCACCCAGGTGACT<br>GTATCTTCCGGGGGAGGCTCCCAGGTCCAGTTGCAGGAGTCCGGCGGAGGCCTG<br>GTACAGCCTGGTGGATCTCTCCGCCTCTCTTGCACCGCGTCCGGGCTTACCTTC<br>GATGACTCTGTCATGGGCTGGTTTCGGCAGGCTCCTGGTAAGGGCCGTGAAGCC<br>GTGTCCTGCATCTCCTCTTCAGGAGCGAACGCTTTCTATGCTGATAGCGTTAAA<br>GGCGTTTCACCATCTCCCGTGATAACGCTAAGAACACCCTCTACCTTCAAATG<br>AACTCCCTCAAGCCAGAGGACACCGCCACATATTACTGTAAACGCGGCCATGCT<br>TGCGCGGGATATTACCCCATCCCTTATGACGATTACTGGGGTCAAGGGACACAG<br>GTCACTGTCAGCTCC |
| hIL27Ra_<br>VH<br>H22-<br>DR596 | 1506 | CAGGTGCAACTTCAGGAGTCCGGTGGCGGTTCCGTGCAGGCTGGTGGCAGCCTG<br>AGGCTGAGCTGTCGCGCCAGCGGGTCCACCTACTCTAACTATTGTCTGGGATGG<br>TTCCGGCAGACCACAGGCAAGGAGCGCGAGGGAGTCGCTGTAATCAACTGGGTA<br>GGTGGGGATGCTGTACTTCGCCGATAGTGTAAAAGGCCGCTTCACCGTGTCACAG<br>GACCAAGCCAAGAACACAGTCTACCTCCAGATGAACTCCCTGAAGCCAGAGGAC<br>ACCGCCATGTATTACTGCGCCGCTGAATCCGTCAGCTCTTTCTCTTGCGGCGGT<br>TGGCTGACCCGCCCCGACCGTGTCCCCTACTGGGGCCAGGGCACTCAGGTGACT<br>GTGAGCAGTGGTGGCAGCGGGGGCTCCGGTGGAAGCGGCCAGGTTCAGCTCCAG<br>GAATCCGGGGGCGGACTCGTCCAGCCAGGGGGCAGCCTGCGGCTGTCCTGCACC<br>GCAAGCGGCCTGACCTTCGACGATAGCGTCATGGGATGGTTCCGTCAAGCCCCT<br>GGCAAGGGGAGGGAGGCCGTCAGCTGTATTAGCTCTAGCGGCGCTAACGCCTTC<br>TATGCCGATTCTGTTAAGGGTAGGTTCACAATCTCCCGCGACAACGCCAAAAAT<br>ACGCTGTATCTCCAGATGAACGCCTGAAGCCCGAGGACACCGCAACCTATTAC<br>TGTAAGAGGGGACACGCATGTGCCGGTTATTACCCCTATCCCCTACGATGACTAC<br>TGGGGGCAAGGTACTCAGGTCACCGTTTCCTCA |
| hIL27Ra_<br>VH<br>H23-<br>DR591 | 1507 | CAGGTGCAACTTCAGGAGAGTGGAGGCGGTAGCGTCCAAGCTGGGGGTTCCCTG<br>AGACTTTCATGTAGAGCTTCCCGTTCTCCTTACGGAAATTACTGTCTGGGCTGG<br>TTCCGCCAGTCCACTGGTAAGGAACGCGAGGGTGTGGCTGTGATAAATTGGGTG<br>GGTGGGAATGCTGTACTTTGCCGACTCTGTTAAGGGTAGATTCACTGTGTCCCAA<br>GATCATGCCAAGAACACCGTCACCCTTCAGATGAACTCCCTGAAGCCCGGAAGAC<br>ACCGCTATGTACTATTGTGCTGCCGAGTCCGTGTCCTCTTTCTCTTGCGGCGGT<br>TGGCTGACCAGACCGGACAGGGTTCCGTATTGGGCCAAGGCACCCAGGTCACT<br>GTGAGTTCTGGAGGGGGTTCCCAGGTCCAACTCCAAGAAAGCGGAGGCGGTTCC<br>GTCCAGGCTGGCGGTTCTCTGCGCCTGAGCTGCACCGCCAGCGGGGCCATTGCG<br>TCTGGTTACATCGACAGTAGATGGTGTATGGCGTGGTTTCGGCAGGCTCCTGGA<br>AAGGAACGCGAGGGCGTTGCTGCCATCTGGCCAGGGGGTGGCCTGACAGTCTAT<br>GCGGACTCCGTGAAGGGCGCTTCACCATTAGCAGAGACCACGCAAAAAACACT<br>CTGTATTTGCAGATGAATAACCTGAAGCCCGAAGCACTGCCATGTACTATTGT<br>GCTGCCGGTTCTCCGCGCATGTGCCCATCCCTGGAGTTCGGATTCGACTACTGG<br>GGACAGGGCACCCAGGTGACGGTGTCCAGT |
| hIL27Ra_<br>VH<br>H23-<br>DR591 | 1508 | CAGGTCCAGTTGCAGGAGTCAGGGGGCGGTAGCGTCCAGGCAGGGGGCAGCCTG<br>CGCCTGTCCTGCCGGGCCAGCAGAAGCCCCTACGGAAATTACTGTCTGGGCTGG<br>TTCCGGCAGAGCACTGGGAAGGAGCGCGAGGGCGTCGCCGTAATCAACTGGGTC<br>GGCGGGATGCTGTATTTCGCCGACAGTGTGAAGGGACGCTTTACTGTGAGTCAG<br>GACCACGCAAAGAATACAGTCACGTTGCAGATGAACTCCCTGAAGCCTGAGGAC<br>ACCGCTATGTACTATTGCGCGGCTGAGTCAGTGTCTAGCTTCAGCTGTGGTGGC<br>TGGCTCACTCGTCCTGATCGCGTACCATATTGGGTCAGGGGACTCAGGTCACC<br>GTGAGTAGCGGCGGAAGTGGAGGCAGCGGTGGGAGCGGCCAAGTTCAGTTGCAG<br>GAGAGCGGCGGGGGCTCTGTGCAGGCTGGTGGCTCCCTGCGTCTGTCCTGCACC<br>GCGTCCGGGGCCATCGCCAGCGGATACATCGACAGTAGGTGGTGTATGGCATGG<br>TTCCGTCAGGCCCCTGGTAAGGAGCGCGAGGGCGTGGCCGCTATTTGGCCGGGT<br>GGGGGGACTCACCGTGTATGCTGACTCCGTAAAGGGTCGCTTCACTATCTCTCGC<br>GATCACGCCAAGAACACCCTGTACTTGCAGATGAACAATCTGAAGCCCGAGGAC<br>ACCGCTATGTATTACTGCGCAGCTGGAAGCCCCAGGATGTGTCCGAGCCTGGAG<br>TTCGGCTTCGACTACTGGGGCAGGGGACTCAGGTGACCGTGTCCTCT |
| hIL27Ra_<br>VH<br>H23-<br>DR592 | 1509 | CAAGTCCAGCTTCAGGAAAGCGGCGGTGGAAGCGTGCAGGCTGGAGGCAGCCTG<br>AGACTCAGCTGCCGCGCTTCAAGGTCCCCCTACGGTAACTACTGCCTGGGCTGG<br>TTTCGCCAGAGTACAGGCAAGGAAAGGGAAGGTGTGGCCGTTATCAACTGGGTG<br>GGCGGTATGCTGTACTTTGCCGACTCCGTCAAGGGCCGTTTTACAGTGTCCCAG<br>GACCACGCCAAGAACACGGTCACGCTTCAGATGAACAGCCTGAAGCCCGAGGAC<br>ACCGCTATGTATTACTGTGCTGCCGAGTCCGTTAGCAGTTTCTCCTGCGGCGGA<br>TGGCTGACCCGCCCTGACCGCGTTCCCTACTGGGGCAGGGCACTCAGGTGACG<br>GTCAGCTCTGGGGCGGGTCCCAGGTTCAGCTGCAAGAGAGTGGTGGAGGCTCC<br>GTACAGGCCGGGGGATCTCTTCGCCTGTCCTGTACTGCTCCGGGCTTCACGAGT<br>AACTCCTGTGGGATGGACTGGTATCGCCAAGCGCCGGCAAGGAGCGCGAGTTC<br>GTAAGTAGCATCTCAACAGACGGCACGACCGGCTACGCCGATTCCGTGAAGGGC<br>CGCTTTACCATTAGCAAGGACAAGGCCAAGGACACTGTGTATCTGCAAATGAAC<br>TCCCTGAAACCCGAGGATACGGGCATGTACTCTTGCAAGACTAAGGATGGCACG<br>ATTGCCACAATGGAGCTGTGCGATTTCGGATATTGGGGCCAGGGCACCCAGGTG<br>ACTGTCTCCTCT |

TABLE 1B-continued

| Name | SEQ ID NO: | Sequence |
|---|---|---|
| hIL27Ra_VH H23-DR592 | 1510 | CAGGTGCAACTTCAGGAAAGTGGGGGCGGTTCCGTGCAGGCAGGGGGCTCTCTG<br>CGTCTGTCTTGCAGAGCCAGCAGGTCTCCTTATGGTAACTACTGCCTCGGGTGG<br>TTTCGTCAGTCTACCGGAAAGGAGCGCGAAGGAGTCGCAGTGATAAATTGGGTC<br>GGCGGTATGCTCTATTTCGCCGACAGCGTCAAGGGGCGTTTCACCGTCAGCCAA<br>GATCACGCTAAGAACACCGTAACACTGCAAATGAACTCCCTCAAACCTGAAGAC<br>ACGGCTATGTATTACTGCGCAGCGGAAAGTGTGAGCAGTTTCAGTTGTGGTGGA<br>TGGCTGACCCGCCCAGATCGCGTCCCTTACTGGGGGCAGGGCACCCAGGTGACT<br>GTCTCCAGTGGAGGGTCCGGTGGCAGCGGGGGAAGCGGCCAGGTGCAGTTGCAG<br>GAGTCTGGGGGCGGTTCTGTCCAGGCTGGAGGTAGCCTCCGCCTGTCTTGCACA<br>GCCCCCGGCTTTACGTCCAACTCTTGTGGCATGGACTGGTATCGGCAGGCTCCA<br>GGCAAAGAACGCGAGTTCGTCAGCTCTATCTCTACTGATGGAACTACAGGATAC<br>GCAGACAGCGTTAAGGGGCGTTTCACCATCTCCAAAGATAAAGCTAAGGACACC<br>GTTTACCTGCAAATGAACTCACTGAAGCCAGAGGATACAGGTATGTACTCTTGC<br>AAGACTAAGGATGGGACCATCGCCACTATGGAACTGTGTGATTTCGGCTACTGG<br>GGCCAGGGCACCCAGGTCACCGTGAGCAGC |
| hIL27Ra_VH H23-DR593 | 1511 | CAGGTGCAACTGCAAGAAAGTGGCGGTGGAAGCGTGCAGGCAGGTGGAAGCCTG<br>CGCCTCTCTTGTCGTGCTTCCAGAAGTCCGTATGGCAATTATTGTCTGGGCTGG<br>TTTAGACAGTCCACTGGTAAGGAAAGGGAAGGAGTGGCTGTCATCAACTGGGTG<br>GGCGGTATGCTGTACTTCGCCGATTCCGTCAAGGGCCGTTTCACAGTCTCCCAA<br>GACCATGCAAAGAACACAGTGACACTCCAGATGAACTCCCTCAAGCCCGAGGAC<br>ACTGCTATGTATTACTGCGCCGCTGAGTCTGTCTCCAGCTTCTCTTGCGCGGA<br>TGGCTGACTCGCCCGGATCGCGTTCCCTATTGGGGCCAGGGGACGCAGGTGACC<br>GTGTCCTCAGGCGGGGGCTCCCAGGTTCAGCTCCAGGAGTCTGGCGGGGGCTCA<br>GTACAGGCCGGTGGCTCCCTCCGCCTCTCATGCGCAGCCTCCGGCTACCCGTAT<br>AGCAACGGTTACATGGGCTGGTTCAGGCAGGCCCCTGGGAAGGAACGCGAGGGC<br>GTGGCGACTATCTACACTGGCGACGGTAGGACTTATTACGCTGATTCAGTGAAG<br>GGCAGGTTCACAATTTCTCGCGACAACGCTAAAAATACCGTGGATCTCCAGATG<br>TCCAGCCTGAAACCTGAGGATACTGCCATGTATTACTGTGCCGCTCGCGCAGCT<br>CCTCTGTATAGTAGCGGCAGCCCCTTGACCCGCGCTAGATACAATGTCTGGGGT<br>CAGGGCACCCAGGTAACCGTTAGTTCC |
| hIL27Ra_VH H23-DR593 | 1512 | CAGGTACAACTTCAGGAAAGCGGAGGTGGGTCCGTGCAGGCCGGTGGCTCACTG<br>CGCTTGAGTTGTCGCGCCAGCCGCTCCCCTTATGGGAACTACTGCCTTGGGTGG<br>TTCCGCCAGAGCACTGGAAAGGAGCGCGAGGGCGTCGCAGTCATCAACTGGGTT<br>GGCGGGATGCTCTATTTCGCCGACAGCGTGAAAGGGCGGTTTACCGTTAGCCAA<br>GACCACGCCAAGAACACAGTGACCCTTCAAATGAACTCCCTGAAGCCCGAAGAC<br>ACCGCTATGTACTATTGCGCCGCAGAGTCAGTCTCCAGTTTTAGCTGCGGAGGC<br>TGGTTGACTCGCCCTGACCGCGTGCCTTATTGGGGCCAGGGCACCCAGGTGACA<br>GTAAGCAGTGGAGGCAGCGGCGGTTCCGGTGGAAGCGGCCAGGTGCAGCTTCAG<br>GAGAGCGGCGGTGGCAGTGTTCAGGCTGGCGGGTCCCTGAGGCTGTCCTGTGCT<br>GCCTCCGGCTACCCCTACTCCAACGGTTACATGGGTTGGTTCCGCCAAGCGCCA<br>GGAAAGGAACGCGAGGGTGTGGCTACCATCTACACCGGCGATGGTCGCACTTAT<br>TACGCTGACAGCGTGAAAGGCCGGTTCACAATCAGCCGGGACAACGCCAAGAAC<br>ACAGTGGACCTGCAAATGTCCAGTTTGAAGCCTGAAGACACAGCCATGTATTAC<br>TGTGCGGCTCGGGCCGCGCCCCTCTACAGCTCCGGCTCACCACTGACACGCGCG<br>AGATACAACGTGTGGGGACAGGGCACCCAGGTGACAGTTAGCAGC |
| hIL27Ra_VH H23-DR594 | 1513 | CAGGTTCAGTTGCAGGAGTCTGGTGGCGGTTCCGTCCAGGCTGGCGGAAGTCTG<br>CGCCTCAGTTGTCGTGCCAGCCGCTCTCCTTACGGCAACTATTGCCTCGGCTGG<br>TTCCGGCAGTCCACTGGCAAGGAGAGGGAAGGAGTCGCCGTTATCAACTGGGTG<br>GGTGGAATGCTCTACTTTGCTGATAGCGTGAAGGGCCGCTTCACAGTTTCTCAG<br>GACCATGCGAAGAACACTGTTACTTTGCAGATGAACTCCCTGAAGCCAGAGGAT<br>ACGGCTATGTATTACTGTGCAGCCGAGTCCGTGAGTTCCTTTTCCTGCGGGGGT<br>TGGCTCACCCGTCCTGACCGTGTGCCTTATTGGGGCCAGGGTACGCAAGTCACC<br>GTAAGTAGCGGAGGGGGCAGCCAGGTCCAGTTGCAGGAGTCCGGCGGAGGCTCC<br>GTGCAGGCCGGGGGTTCTCTGCGTCTCTCATGTGTGGCATCTGCTTCACTTAC<br>TGCACTTACGACATGCACTGGTATCGGCAGGCTCCTGGGAAAGGACGGGAGTTC<br>GTTAGTGCCATCGACAGCGACGGCACTACACGCTATGCTGATTCCGTTAAGGGC<br>CGCTTTACGATTTCACAGGGGACGGCCAAGAACACTGTGTACCTCCAGATGAAC<br>TCTTTGCAGCCTGAGGACACGGCTATGTATTACTGCAAAACCGTTTGTGTAGTG<br>GGCAGCCGCTGGTCAGACTATTGGGGCCAGGGCACACAGGTCACCGTGAGTTCT |
| hIL27Ra_VH H23-DR594 | 1514 | CAGGTGCAACTGCAAGAGTCCGGCGGAGGCTCCGTGCAGGCTGGTGGCTCACTC<br>CGGCTCTCCTGTCGCGCCCTCTCGCAGCCCTTATGGAATTACTGCCTGGGTTGG<br>TTCCGTCAGAGTACCGGCAAGGAGCGTGAGGGAGTCGCAGTAATCAACTGGGTC<br>GGAGGTATGCTGTACTTCGCCGACTCCGTGAAGGGAAGGTTCACTGTGTCCCAG<br>GACCACGCCAAGAACACGGTAACGCTCCAGATGAACTCCCTGAAGCCCGAAGAC<br>ACCGCTATGTATTACTGTGCTGCCGAGTCCGTGTCCTCATTCTCCTGCGGCGGT<br>TGGCTGACACGCCCAGACCGCGTGCCCTATTGGGACAGGGTACACAGGTTACC<br>GTCAGCTCTGGCGGGTCTGGTGGCAGTGGGGCTCCGGTCAGGTGCAGTTGCAG<br>GAGTCCGGCGGAGGCTCTGTGCAGGCTGGTGGAGTCTGCGCCTGTCTTGCGTC<br>GCCAGCGCCAGTACTTATTGTACTTACGACATGCACTGGTATAGACAGGCCCCC<br>GGTAAGGGAAGGGAGTTCGTGTCAGCTATCGACAGCGATGGGACCACTAGATAT<br>GCGGATAGCGTCAAGGGGCGCTTCACCATCTCCCAGGGAACCGCAAAAACACT<br>GTCTACCTTCAGATGAACAGCCTCCAGCCTGAGGACACGGCTATGTATTACTGC |

TABLE 1B-continued

| Name | SEQ ID NO: | Sequence |
|---|---|---|
| | | AAGACCGTGTGTGTCGTTGGATCTCGCTGGTCTGACTATTGGGGCAGGGCACC CAGGTGACGGTGTCCAGC |
| hIL27Ra_ VH H23- DR595 | 1515 | CAGGTTCAGCTCCAGGAGTCTGGAGGGGGCAGCGTGCAGGCGGGAGGGTCTCTT CGTCTTAGCTGCCGTGCCAGTCGCTCCCCCCTACGGTAACTACTGCCTGGGGTGG TTTTCGCCAGAGTACCGGCAAGGAGCGCGAAGGTGTGGCTGTAATCAACTGGGTT GGGGGTATGCTGTATTTCGCCGACTCCGTGAAAGGTAGGTTTACAGTGAGCCAG GACCACGCTAAGAACACCGTCACCCTCCAGATGAACTCTCTCAAACCGGAGGAT ACCGCTATGTATTACTGCGCTGCCGAGAGTGTGAGTAGCTTCTCTTGTGGCGGT TGGCTGACCAGGCCTGACCGCGTACCCTACTGGGGCCAGGGCACCCAGGTCACA GTCAGCTCTGGTGGAGGCTCACAGGTGCAGCTTCAGGAGTCCGGCGGGGGCAGC GTGCAGGCCGGGGGCTCACTGACCCTGAGCTGTGCTGCCAGCGAATACGCATAC TCTACCTGCAATATGGGCTGGTATCGGCAGGCCCCTGGGAAAGAAAGGGAACTG GTTTCTGCCTTTATCAGCATGGATCAACATATTACGCCGACTCCGTGAAAGGG AGGTTCACGATCACCCGCGACAACGCCAAGAACACTGTGTACCTCCAAATGAAC AGCCTGAAGCCTGAGGACACCGCGATCTATTACTGCTCTGCTAACTGCTACCGC AGGCTGCGCAATTATTGGGGTCAAGGCACCCAGGTTACCGTGTCTTCC |
| hIL27Ra_ VH H23- DR595 | 1516 | CAGGTCCAGCTCCAGGAGTCTGGCGGAGGCTCCGTGCAGGCTGGAGGCAGCCTC AGACTTTCTTGCAGAGCTTCCCGGTCTCCCTATGGAAACTACTGCTTGGGTTGG TTCCGCCAATCCACTGGCAAGGAGAGGGAGGGTGTTGCTGTCATCAACTGGGTG GGCGGGATGCTTTATTTCGCCGACAGTGTCAAGGGACGGTTCACCGTCTCTCAG GATCACGCCAAGAACACTGTGACCTTGCAGATGAACTCACTCAAACCCGAAGAT ACCGCTATGTACTATTGTGCCGCAGAAAGCGTGTCTAGCTTCAGCTGTGGTGGC TGGCTCACACGCCCTGACCGGGTGCCATACTGGGGCCAGGGCACGCAGGTGACC GTAAGCTCAGGCGGGAGTGGTGGCTCTGGAGGCTGGACAGGTGCAGCTCCAG GAGAGCGGGGCGGGAGCGTGCAGGCTGGCGGTAGTCTGACCCTGTCATGCGCT GCAAGCGAATACGCCTACAGCACCTGCAATATGGGGTGGTATCGTCAGGCTCCT GGCAAGGAGCGTGAGCTGGTTTCCGCCTTCATCTCCGATGGCTCTACCTATTAC GCCGACTCAGTGAAGGGCCGCTTCACTATCACTAGGGACAATGCCAAGAACACA GTATACCTCCAGATGAACTCTCTGAAGCCAGAGGATACTGCCATCTATTACTGT AGCGCCAACTGTTATCGTCGCCTGCGCAACTATTGGGGTCAAGGCACACAGGTG ACAGTCTCTAGC |
| hIL27Ra_ VH H23- DR596 | 1517 | CAGGTGCAACTCCAGGAATCCGGGGGTGGATCAGTACAGGCAGGCGGAAGCCTG AGGCTGTCTTGTCGCGCTTCCCGTTCTCCCTACGGAAATTACTGTCTGGGCTGG TTCCGGCAGTCCACTGGAAAAGAGAGGGAGGGAGTGGCCGTTATCAACTGGGTA GGAGGGTATGCTGTACTTTGCCGACAGCGTGAAAGGAAGGTTCACCGTGAGCCAG GACCACGCCAAGAATACCGTGACCTTGCAGATGAACAGCCTGAAGCCTGAAGAC ACTGCCATGTACTATTGTGCCGCTGAGAGTGTATCATCTTTCTCCTGCGGTGGC TGGTTGACTCGCCCAGACAGAGTGCCTTATTGGGGCAGGGCACTCAGGTGACC GTGTCTTCCGGTGGAGGCTCCCAGGTTCAACTTCAGGAGTCCGGTGGAGGCCTG GTACAGCCTGGCGGATCTCTCAGGCTCAGCTGCCTCTGGACTGACCTTC GATGACTCTGTTATGGGCTGGTTTAGGCAGGCCCCTGGAAAAGGCCGGGAGGCG GTCAGCTGCATCAGCTCTAGCGGGGCCAATGCGTTTTACGCTGATTCCGTGAAG GGCCGCTTCACTATCTCTAGGGACAACGCGAAGAACACCCTCTACTTGCAGATG AACTCCCTCAAGCCCGAGGACACGGCGACTTATTACTGCAAAAGAGGACACGCT TGTGCCGGATATTACCCGATTCCCTATGATGACTATTGGGGCCAGGGCACCCAG GTGACAGTGAGCAGC |
| hIL27Ra_ VH H23- DR596 | 1518 | CAGGTGCAACTCCAGGAAAGCGGCGGTGGAAGCGTGCAGGCTGGAGGGTCCCTC AGACTGAGTTGCCGGGCCTCACGGTCCCCCTATGGGAACTATTGCCTGGGTTGG TTCCGTCAGTCCACTGGCAAGGAGCGCGAGGGCGTGGCCGTTATCAACTGGGTG GGAGGGATGCTGTACTTTGCAGACAGCGTTAAGGGTCGGTTTACCGTGAGCCAG GACCACGCCAAGAATACCGTGACCTTGCAGATGAACTCCCTGAAGCCTGAGGAC ACCGCCATGTATTACTGCGCTGCCGAATCCGTGTCTAGCTTTAGCTGTGGGGGC TGGCTCACCAGACCTGATCGCGTGCCGTACTGGGGCCAGGGCACTCAAGTGACG GTCAGCTCCGGTGGAAGCGGTGGCTCCGGCGGTTCCGGGCAGGTGCAGTTGCAG GAGTCAGGGGGAGGGTTGGTTCAGCCCGGTGGCTCCTTGCGTCTGTCCTGTACT GCAAGCGGGCTGACCTTCGACGATTCTGTGATGGGCTGGTTTCGTCAGGCTCCT GGCAAGGGCAGAGAGGCGGTGAGCTGTATCTCCAGCTCCGGCGCTAATGCCTTC TACGCAGACAGTGTTAAGGGTAGGTTTACTATCTCAGGGACAATGCTAAAAAC ACTCTGTATCTTCAGATGAACAGCCTGAAGCCGGAGGATACTGCTACCTATTAC TGTAAGCGGGGCATGCTTGCGCCGGGTACTATCCAATCCCCTACGATGACTAT TGGGGTCAAGGCACACAGGTGACAGTGTCCTCC |
| hIL27Ra_ VH H24- DR591 | 1519 | CAGGTCCAGTTGCAGGAGAGCGGTGGGGGGCTGGTGCAGCCTGGCGGTTCCCTG CGCCTGTCTTGTGCTGCGAGCGGGTTCACTTTCAGCCATTCTGGTATGAGTTGG GTACGCCAGGCTCCAGGCAAGGGCTGGAATGGGTGAGCACCATCAACTCTGGA GGTGCCTCTACTTATTACACCGACAGTGTCAAGGGACGCTTTACAATCTCCAGA GACAACGCGAAGAATATGCTTTACTTGCAGCTCAACTCACTGAAGACCGAGGAT ACTGCCATGTATTACTGCGCTAAGGGAGGCTCAGGATATGGTGATGCCTCTCGC ATGACCTCTCCTGGCTCACAGGGAACCCAGGTGACCGTCAGTTCCGGTGGAGGT TCTCAGGTCCAGCTCCAGGAGTCCGGCGGTGGCAGCGTGCAGGCCGGAGGCAGC CTGCGCCTGTCATGCACAGCCTCTGGCGCTATCGCCAGTGGTTACATCGACAGC AGGTGGTGCATGGCCTGGTTCAGACAGGCCCCTGGTAAGGAACGCGAGGGAGTT GCTGCCATTTGGCCAGGCGGTGGCCTGACAGTGTACGCCGATAGCGTCAAGGGG |

TABLE 1B-continued

| Name | SEQ ID NO: | Sequence |
|---|---|---|
| | | CGCTTCACTATCTCACGGGATCACGCTAAAAACACTTTGTACCTCCAGATGAAT<br>AACCTCAAACCAGAGGACACCGCGATGTATTACTGCGCTGCGGGCTCTCCCCGC<br>ATGTGTCCCTCTCTGGAGTTCGGGTTCGATTATTGGGGTCAGGGAACGCAGGTG<br>ACTGTGTCCTCC |
| hIL27Ra_<br>VH<br>H24-<br>DR591 | 1520 | CAGGTGCAGCTTCAGGAGTCCGGGGGAGGCCTGGTTCAGCCCGGCGGTTCTCTC<br>CGCCTCAGCTGTGCCGCTTCCGGGTTTACATTCAGCCACAGTGGAATGTCTTGG<br>GTACGTCAAGCGCCAGGTAAGGGCCTGGAGTGGGTCTCTACAATCAACAGCGGT<br>GGCGCAAGTACATACTATACCGACTCCGTGAAAGGGCGGTTTACCATCTCCCGT<br>GACAACGCTAAGAATATGCTCTATCTTCAGCTGAACTCACTCAAGACTGAGGAT<br>ACTGCTATGTATTACTGTGCGAAAGGGGATCTGGGTACGGCGATGCGAGCCGC<br>ATGACCCTCCCCCGGCAGTCAGGGCACTCAAGTGACCGTATCATCCGGGGGTTCC<br>GGTGGCTCAGGAGGTAGCGGCCAGGTTCAACTGCAAGAGAGTGGCGGGGGCTCC<br>GTGCAGGCGGGCGGTTCCCTCAGGCTCTCTTGCACTGCAAGCGGCGCTATTGCG<br>AGTGGGTACATCGACTCCAGATGGTGTATGGCCTGGTTCCGCCAGGCACCTGGC<br>AAGGAGCGCAAGGCGTGGCAGCCATCTGGCCTGGGGGCGGTCTTACCGTCTAC<br>GCTGACTCCGTGAAAGGCCGCTTCACTATTTCTCGCGACCATGCCAAGAACACC<br>CTGTACTTGCAAATGAATAACCTGAAGCCTGAAGACACCGCGATGTATTACTGC<br>GCCGCTGGATCTCCCAGGATGTGCCCGAGCCTGGAGTTCGGTTTCGACTACTGG<br>GGCCAAGGCACACAGGTTACAGTCTCCTCC |
| hIL27Ra_<br>VH<br>H24-<br>DR592 | 1521 | CAAGTGCAGCTCCAGGAGAGCGGTGGCGGTCTCGTGCAACCAGGAGGTTCCTTG<br>CGGCTGAGCTGTGCCGCGTCAGGTTTTACATTTAGCCACAGTGGGATGTCTTGG<br>GTGAGACAGGCTCCGGGTAAGGGTCTCGAATGGGTCAGTACTATCAATTCCGGC<br>GGAGCAAGCACATACTATACCGACTCTGTCAAGGGGAGATTTACCATCTCCAGA<br>GACAATGCCAAAAACATGCTGTATTTGCAACTCAACAGTCTGAAGACCGAAGAC<br>ACCGCGATGTATTACTGCGCCAAGGGCGGTTCCGGGTACGGAGACGCGAGCCGC<br>ATGACTTCCCCTGGATCTCAGGGCACCCAGGTGACTGTCTCCAGCGGTGGCGGT<br>TCCCAAGTCCAACTCCAGGAAAGCGGAGGCGGTTCTGTGCAGGCAGGCGGGTCC<br>CTTCGGTTGAGCTGTACCGCACCCGGCTTTACCAGCAACTCTTGTGGTATGGAC<br>TGGTATCGGCAGGCTCCTGGCAAAGAGCGCGAGTTCGTGTCTTCCATTTCCACC<br>GACGGCACTACCGGGTACGCGGATTCCGTGAAGGGCAGGTTCACGATCAGCAAG<br>GATAAGGCAAAAGATACTGTTTATCTCCAGATGAACTCACTCAAGCCCGAAGAC<br>ACTGGCATGTACTCCTGCAAGACCAAAGACGGCACCATTGCCACTATGGAGCTG<br>TGCGATTTTGGCTACTGGGGTCAGGGCACCCAGGTCACCGTGTCATCC |
| hIL27Ra_<br>VH<br>H24-<br>DR592 | 1522 | CAGGTGCAGCTTCAGGAGAGTGGTGGGGGTCTGGTTCAGCCTGGGGGTAGCCTG<br>AGGCTGAGTIGTGCCGCGAGCGGATTTACTTTCTCTCATAGCGGCATGAGTTGG<br>GTGCGCCAGGCCCCTGGCAAGGGTCTGGAATGGGTGAGTACAATCAACTCTGGC<br>GGTGCCTCTACCTATTACACCGACAGCGTGAAGGGGAGATTCACTATTAGCCGC<br>GACAATGCTAAGAATATGCTCTATCTTCAGCTGAACTCCCTGAAAACCGAAGAC<br>ACCGCAATGTATTACTGTGCAAAGGGTGGAAGCGGCTACGGCGACGCCAGCCGC<br>ATGACTTCCCCCGGCTCTCAGGGAACTCAGGTTACCGTCTCTTCCGGCGGTAGC<br>GGGGGCTCTGGAGGCTCTGGCCAGGTTCAGTTGCAGGAAAGTGGAGGCGGTTCA<br>GTTCAGGCTGGAGGCAGCTTGCGCTTGTCCTGTACCGCGCCAGGCTTCACAAGT<br>AATAGCTGTGGCATGGATTGGTATCGTCAGGCACCGGGAAAGGAGCGCGAGTTT<br>GTGTCTAGCATCAGCACAGACGGGACAACCGGCTATGCGGATTCCGTAAAAGGA<br>CGGTTTACTATCTCCAAGGATAAGGCTAAGGACACAGTGTACCTGCAAATGAAC<br>AGCCTGAAGCCCGAAGATACTGGTATGTATAGCTGCAAGACCAAGGATGGCACA<br>ATCGCCACTATGGAGCTGTGTGACTTCGGCTATTGGGGTCAGGGCACCCAGGTG<br>ACAGTGTCTTCT |
| hIL27Ra_<br>VH<br>H24-<br>DR593 | 1523 | CAGGTGCAGCTCCAGGAAAGCGGAGGTGGCCTGGTACAGCCCGGCGGTAGTCTG<br>AGGCTGAGTTGTGCTGCCTCAGGTTTTACTTTCTCACACTCCGGGATGTCCTGG<br>GTGAGACAAGCGCCGGGCAAGGGCCTGGAGTGGGTATCAACTATTAACAGTGGC<br>GGGGCGTCTACCTATTACACTGACAGCGTGAAGGGCCGGTTCACTATCAGCAGA<br>GATAACGCTAAAAATATGTTGTATCTTCAGCTCAATTCCCTGAAAACCGAAGAT<br>ACCGCGATGTATTACTGTGCTAAAGGGGTTCTGGATACGGCGATGCGTCTCGC<br>ATGACCCTCTCCTGGAAGCCAGGGCACCCAGGTCACCGTGTCTAGTGGCGGAGGT<br>AGTCAGGTTCAGCTCCAAGAGTCCGGCGGAGGTAGCGTCCAGGCCGGGGGCTCA<br>CTCCGCCTGTCCTGCGCAGCCAGCGGATACCCCTATTCAAACGGCTACATGGGC<br>TGGTTCCGCCAGGCCCCCGGAAAAGAGCGTGAAGGAGTGGCTACAATCTATACC<br>GGCGACGGGAGGACCTATTACGCAGATTCCGTGAAAGGCCGTTTCACCATCTCC<br>CGTGACAACGCCAAAAATACCGTGGACCTTCAGATGAGTTCTCTGAAGCCAGAG<br>GACACCGCTATGTACTATTGTGCTGCCAGAGCTGCACCACTGTATTCCTCTGGC<br>AGCCCCCTGACCAGAGCCCGCTACAACGTCTGGGACAGGGCACCCAGGTCACA<br>GTCAGCTCT |
| hIL27Ra_<br>VH<br>H24-<br>DR593 | 1524 | CAGGTTCAGCTCCAGGAATCTGGCGGTGGCCTCGTTCAGCCGGGTGGCAGTCTT<br>CGTCTGAGCTGTGCAGCCTCTGGCTTCACCTTCTCTCACTCCGGCATGAGCTGG<br>GTCAGACAGGCCCCAGGCAAGGGTCTGGAGTGGGTGTCTACGATCAATAGCGGA<br>GGCGCTTCTACCTATTACACCGACAGCGTGAAGGGCAGATTTACCATTTCCCGT<br>GACAACGCCAAAAACATGCTGTATCTGCAACTGAACTCTCTGAAGACCGAGGAC<br>ACCGCCATGTACTATTGCGCTAAGGGCGGTAGCGGATATGGCGACGCGAGCAGA<br>ATGACTTCTCCGGGGAGCCAGGGTACACAGGTGACCGTGTCCAGCGGCGGTAGT<br>GGGGGCAGCGGTGGCAGCGGACAGGTCCAGTTGCAGGAATCCGGCGGAGGCAGC<br>GTGCAGGCTGGCGGTTCACTGAGACTCTCTTGCGCGGCCAGCGGCTATCCCTAT |

TABLE 1B-continued

| Name | SEQ ID NO: | Sequence |
|---|---|---|
| | | TCTAACGGTTATATGGGCTGGTTTAGGCAGGCTCCCGGCAAGGAAAGGGAGGGC<br>GTGGCTACTATCTATACTGGCGATGGCCGCACTTACTATGCCGATAGTGTCAAG<br>GGCCGTTTCACTATCTCTCGCGACAACGCTAAGAACACAGTGGATCTTCAGATG<br>TCTTCCCTGAAGCCAGAGGATACCGCGATGTATTACTGTGCCGCGAGGGCTGCA<br>CCACTGTACTCTAGCGGATCTCCCCTGACCCGCGCCAGATACAACGTGTGGGGC<br>CAGGGGACGCAGGTTACCGTTTCTTCT |
| hIL27Ra_<br>VH<br>H24<br>DR594 | 1525 | CAGGTGCAGTTGCAGGAGAGTGGAGGCGGACTGGTGCAGCCAGGAGGTTCACTG<br>CGTCTTTCTTGCGCAGCCAGCGGTTTTACATTCAGCCACTCTGGAATGTCTTGG<br>GTTCGCCAGGCACCGGGGAAGGGCCTGGAGTGGGTGTCCACAATCAACAGTGGG<br>GGTGCCTCTACTTACTATACAGACTCCGTGAAAGGCAGGTTTACCATCTCCAGG<br>GACAACGCCAAAAATATGCTTTATCTTCAGCTCAATTCTCTGAAGACCGAGGAT<br>ACTGCGATGTATTACTGTGCAAAAGGGGCTCAGGATATGGCGATGCCTCCCGC<br>ATGACCAGCCCAGGGAGCCAGGGCACCCAGGTGACCGTCTCCAGTGGCGGAGGC<br>TCTCAGGTGCAGCTCCAGGAGTCAGGCGGTGGCTCCGTCCAGGCTGGCGGGAGC<br>TTGCGCTTGTCCTGTGTTGCCTCCGCTAGTACCTATTGCACCTATGATATGCAC<br>TGGTACAGACAGGCTCCGGGTAAGGGCCGTGAGTTCGTGTCCGCCATTGATAGC<br>GACGGCACAACTCGCTACGCTGATTCCGTGAAAGGCCGCTTCACCATTAGCCAG<br>GGCACCGCTAAGAACACAGTGTACTTGCAGATGAACAGCTTGCAGCCAGAGGAT<br>ACCGCGATGTATTACTGCAAAACTGTGCGTAGTGGGCAGTAGATGGTCCGAC<br>TACTGGGGCCAGGGCACACAGGTCACCGTGAGCAGC |
| hIL27Ra_<br>VH<br>H24-<br>DR594 | 1526 | CAGGTACAGCTCCAAGAGTCTGGCGGTGGCCTGGTGCAACCAGGGGGCTCATTG<br>AGATTGTCTTGCGCCGCTTCTGGATTCACATTCTCCCACTCAGGTATGAGTTGG<br>GTGCGGCAAGCCCCAGGCAAGGGCCTGGAGTGGGTTTCTACCATCAACAGTGGG<br>GGAGCTAGTACCTACTATACAGACTCCGTGAAAGGCCGCTTCACCATTAGCCGC<br>GATAACGCTAAGAACATGCTGTACTTGCAGCTCAATTCCCTGAAGACCGAGGAC<br>ACAGCTATGTACTATTGCGCCAAGGGAGGCAGTGGTTACGGGGACGCCAGCCGG<br>ATGACCCTCTCCCGGCTCTCAAGGGACGCAGGTTACCGTGTCAAGCGGCGGTTCC<br>GGTGGGTCCGGTGGCTCCGGTCAAGTGCAGCTCCAGGAGAGTGGGGGTGGCAGC<br>GTCCAGGCCGGAGGCTCCCTCAGGCTGTCCTGCGTGGCCTCTGCCAGCACATAT<br>TGCACATACGACATGCACTGGTATCGTCAGGCTCCTGGCAAAGGGCGCGAGTTC<br>GTGTCCGCTATTGATTCCGATGGTACAACCCGGTACGCTGACAGTGTGAAGGGC<br>CGTTTCACAATTAGCCAGGGCACCGCTAAAAACACCGTGTACCTCCAGATGAAC<br>TCCCTCCAACCTGAGGATACTGCCATGTATTACTGCAAAACGGTGTGCGTCGTG<br>GGCTCTCGCTGGTCCGATTACTGGGGGCAGGGCACTCAGGTGACCGTGTCCAGC |
| hIL27Ra_<br>VH<br>H24-<br>DR595 | 1527 | CAGGTGCAGTTGCAGGAGAGCGGAGGCGGGCTGGTGCAGCCTGGAGGCTCTCTG<br>CGCCTGTCCTGCGCAGCCTCAGGATTTACATTCTCTCACAGTGGGATGTCTTGG<br>GTGCGGCAGGCTCCGGGCAAAGGCCTGGAATGGGTGTCCACCATTAACTCTGGT<br>GGCGCGAGCACTTACTATACCGATAGTGTCAAAGGCCGCTTCACCATCAGCCGG<br>GACAACGCTAAGAACATGCTGTATCTCCAGCTGAACAGCCTGAAGACCGAAGAC<br>ACTGCTATGTATTACTGTGCCAAGGGCGGTTCAGGTTATGGGGACGCCTCTCGG<br>ATGACATCACCGGGCTCCCAAGGAACTCAGGTCACCGTCAGCAGTGGCGGTGGC<br>TCCCAGGTGCAACTTCAGGAGTCCGGGGGTGGAAGCGTGCAGGCTGGAGGCTCC<br>CTGACACTGTCTTGCGCTGCCAGCGAATACGCTTATTCCACCTGTAACATGGGG<br>TGGATCGCCAAGCTCCTGGGAAGGAACGTGAACTGGTCAGTGCCTTCATCTCT<br>GATGGGTCCACGTATTACGCTGATTCAGTAAAGGGACGTTTCACAATCACCCGC<br>GACAACGCCAAAAACACTGTGTACTTGCAGATGAACAGCCTGAAGCCAGAGGAT<br>ACCGCTATCTACTATTGCAGCGCCAACTGTTACCGTCGGCTGCGCAACTACTGG<br>GGGCAGGGCACACAAGTCACAGTGTCCAGC |
| hIL27Ra_<br>VH<br>H24-<br>DR595 | 1528 | CAGGTCCAGCTCCAGGAGTCAGGGGGTGGACTTGTTCAACCCGGTGGCTCCCTC<br>CGTCTCTCCTGTGCTGCGTCTGGTTTCACCTTCAGCCACTCTGGAATGAGCTGG<br>GTTAGACAAGCACCTGGCAAAGGCCTCGAATGGGTCTCTACCATCAACAGCGGC<br>GGAGCCTCCACTTATTACACCGACTCCGTGAAGGGTCGCTTCACGATCAGCAGA<br>GACAACGCCAAGAACATGCTGTACCTCCAACTGAATAGCCTGAAAACCGAGGAT<br>ACTGCCATGTATTACTGTGCAAAGGGCGGAAGTGGTTACGGAGACGCCAGCAGG<br>ATGACATCTCCGGGTTCTCAAGGCACCCAGGTCACCGTGAGTAGCGGCGGATCT<br>GGGGGCAGCGGAGGCAGCGGCCAGGTGCAGCTTCAGGAAAGCGGAGGGGGTTCC<br>GTTCAGGCCGGGGCTCACTGACACTGAGTTGCGCGGCCTCCGAATACGCCTAT<br>TCTACTTGTAACATGGGCTGGTACAGACAAGCTCCTGGGAAGGAGAGAGAACTG<br>GTGAGCGCTTTTATTTCTGACGGCTCAACCTATTACGCAGACTCCGTCAAGGGC<br>CGCTTCACCATTACCCGCGACAACGCTAAGAACACGGTGTACCTCCAGATGAAC<br>TCCCTGAAGCCCGAAGCACCGCAATTTACTATTGCAGCGCCAACTGCTACCGC<br>CGGTTGCGCAACTACTGGGGCCAGGGAACTCAGGTTACCGTATCCTCC |
| hIL27Ra_<br>VH<br>H24-<br>DR596 | 1529 | CAGGTGCAACTCCAGGAGTCCGGCGGTGGACTGGTGCAGCCTGGCGGTAGCTTG<br>AGGCTGTCTTGCGCCGCATCCGGCTTCACATTCAGCCACTCTGGAATGTCATGG<br>GTCAGACAGGCTCCGGGCAAGGGCCTGGAATGGGTCTCAACCATCAATAGTGGA<br>GGTGCCTCAACTTACTATACCGACTCCGTGAAAGGTCGTTTCACAATTTCACGC<br>GACAACGCTAAGAACATGCTGTACCTCCAGCTGAATAGTCTCAAAACTGAGGAC<br>ACCGCTATGTATTACTGTGCTAAGGGCGGTTCCGGGTATGGGAGACGCCTCCAGG<br>ATGACTTCACCGGGTAGCCAGGGACCCAGGTGACGGTTTCTAGCGGGGCGGG<br>TCCCAGGTGCAGCTTCAGGAAAGCGGAGGGGGCCTGGTGCAGCCCGGCGGGTCC<br>CTGAGACTGAGCTGCACGGCAAGCGGCCTGACGTTTGATGACTCCGTGATGGGC<br>TGGTTCAGACAGGCCCCCGGCAAGGGGCGCGAAGCCGTCTCCTGTATTAGCTCC |

TABLE 1B-continued

| Name | SEQ ID NO: | Sequence |
|---|---|---|
| | | AGCGGGGCCAACGCTTTCTACGCGGACAGCGTCAAAGGCCGCTTCACCATTAGC<br>AGAGACAACGCTAAGAACACTCTGTACCTCCAGATGAACAGCCTGAAACCAGAG<br>GATACCGCAACGTATTACTGCAAGCGCGGACATGCTTGCGCGGGCTATTACCCA<br>ATCCCTTATGACGATTACTGGGGCCAGGGCACTCAGGTGACGGTAAGCTCC |
| hIL27Ra_VH H24-DR596 | 1530 | CAGGTCCAACTCCAGGAGTCCGGCGGTGGCCTGGTTCAGCCAGGAGGTTCCCTG<br>CGCCTGTCCTGTGCCGCTTCCGGCTTTACCTTCTCCCATTCCGGCATGAGCTGG<br>GTGAGGCAGGCCCCTGGCAAAGGCCTGGAGTGGGTGTCTACCATTAACTCTGGC<br>GGAGCCAGCACATACTATACAGACTCAGTAAAGGGACGCTTCACCATCAGCAGG<br>GACAACGCCAAAAACATGCTGTATCTCCAGCTGAACTCTCTCAAGACCGAAGAC<br>ACCGCTATGTATTACTGTGCTAAGGGCGGTAGCGGCTATGGGGACGCATCTCGT<br>ATGACCTCTCCCGGCTCTCAAGGCACCCAGGTGACTGTGTCTAGTGGTGGGTCT<br>GGCGGGTCTGGCGGATCTGGTCAAGTCCAGTTGCAGGAGAGTGGAGGCGGTCTC<br>GTCCAGCCAGGCGGAAGCCTGCGCCTGTCTTGTACTGCCAGCGGTTTGACCTTT<br>GATGACTCTGTGATGGGCTGGTTTCGTCAGGCCCCCGGCAAGGGCCGTGAGGCC<br>GTGTCATGTATCTCATCTTCAGGAGCCAACGCCTTTTATGCCGATAGCGTGAAA<br>GGGAGATTCACCATCTCTCGTGATAACGCAAAGAACACCCTGTACCTTCAGATG<br>AACTCTCTGAAGCCTGAGGACACTGCTACCTACTATTGTAAGCGTGGGCACGCC<br>TGCGCTGGATATTACCCTATCCCTTACGATGACTATTGGGGGCAGGGCACTCAG<br>GTGACCGTCAGCAGC |

In some embodiments, a bispecific $V_HH^2$ comprises:

an anti-gp130 $V_HH$ antibody comprising a CDR1 having at least 90% (e.g., 91%, 92%, 93%, 94%, 95%, 96%, 97%, 98%, 99%, or 100%) sequence identity, or having 0, 1, 2, or 3 amino acid changes, optionally conservative amino acid changes relative, to the sequence of any one of SEQ ID NOS: 193-198; a CDR2 having at least 90% (e.g., 91%, 92%, 93%, 94%, 95%, 96%, 97%, 98%, 99%, or 100%) sequence identity, or having 0, 1, 2, or 3 amino acid changes, optionally conservative amino acid changes relative, to the sequence of any one of SEQ ID NOS: 199-204; and a CDR3 having at least 90% (e.g., 91%, 92%, 93%, 94%, 95%, 96%, 97%, 98%, 99%, or 100%) sequence identity, or having 0, 1, 2, or 3 amino acid changes optionally conservative amino acid changes relative, to the sequence of any one of SEQ ID NOS:205-210; and an anti-IL27Rα $V_HH$ antibody comprising a CDR1 having at least 90% (e.g., 91%, 92%, 93%, 94%, 95%, 96%, 97%, 98%, 99%, or 100%) sequence identity, or having 0, 1, 2, or 3 amino acid changes, optionally conservative amino acid changes relative, to the sequence of any one of SEQ ID NOS:211-217; a CDR2 having at least 90% (e.g., 91%, 92%, 93%, 94%, 95%, 96%, 97%, 98%, 99%, or 100%) sequence identity, or having 0, 1, 2, or 3 amino acid changes, optionally conservative amino acid changes relative, to the sequence of any one of SEQ ID NOS:218-224; and a CDR3 having at least 90% (e.g., 91%, 92%, 93%, 94%, 95%, 96%, 97%, 98%, 99%, or 100%) sequence identity, or having 0, 1, 2, or 3 amino acid changes optionally conservative amino acid changes relative, to the sequence of any one of SEQ ID NOS:225-231.

In certain embodiments, a bispecific $V_HH^2$ described herein comprises an anti-gp130 $V_HH$ antibody comprising a CDR1, a CDR2, and a CDR3 and an anti-IL27Rα $V_HH$ antibody comprising a CDR1, a CDR2, and a CDR3 as described in each row of Table 1 below. In some embodiments, the CDR1, CDR2, and CDR3 in the anti-gp130 $V_HH$ antibody and CDR1, CDR2, and CDR3 in the anti-IL27Rα $V_HH$ antibody can each, independently, comprise at least 90% (e.g., 91%, 92%, 93%, 94%, 95%, 96%, 97%, 98%, 99%, or 100%) sequence identity, or have 0, 1, 2, or 3 amino acid changes, optionally conservative amino acid changes, relative to the sequence described in each row of Table 1.

In some embodiments, the bispecific $V_HH^2$ comprises an anti-gp130 $V_HH$ antibody at the N-terminus and an anti-IL27Rα $V_HH$ antibody at the C-terminus. In some embodiments, the bispecific $V_HH^2$ comprises an anti-IL27Rα $V_HH$ antibody at the N-terminus and an anti-gp130 $V_HH$ antibody at the C-terminus.

TABLE 1

| Anti-gp130 $V_HH$ CDR1 | Anti-gp130 $V_HH$ CDR2 | Anti-gp130 $V_HH$ CDR3 | Anti-IL27Rα $V_HH$ CDR1 | Anti-IL27Rα $V_HH$ CDR2 | Anti-IL27Rα $V_HH$ CDR3 |
|---|---|---|---|---|---|
| AIASGYIDSR (SEQ ID NO: 193) | AIWPGGGLTVY ADSVKG (SEQ ID NO: 199) | GSPRMCPSLEFG FDY (SEQ ID NO: 205) | FTFSSYPMS (SEQ ID NO: 211) | TISAGGDTTLYA DSVKG (SEQ ID NO: 218) | GYCYRRNY (SEQ ID NO: 225) |
| AIASGYIDSR (SEQ ID NO: 193) | AIWPGGGLTVY ADSVKG (SEQ ID NO: 199) | GSPRMCPSLEFG FDY (SEQ ID NO: 205) | FTFSNYAMS (SEQ ID NO: 212) | GINVAYGITSYA DSVKG (SEQ ID NO: 219) | HSGTTIPRGFISY TK (SEQ ID NO: 226) |
| AIASGYIDSR (SEQ ID NO: 193) | AIWPGGGLTVY ADSVKG (SEQ ID NO: 199) | GSPRMCPSLEFG FDY (SEQ ID NO: 205) | FSFSSYAMK (SEQ ID NO: 213) | TISSGGSSTNYA DSVKG (SEQ ID NO: 220) | AIVPTGATME (SEQ ID NO: 227) |
| AIASGYIDSR (SEQ ID NO: 193) | AIWPGGGLTVY ADSVKG (SEQ ID NO: 199) | GSPRMCPSLEFG FDY (SEQ ID NO: 205) | FTYSTSNSWMA (SEQ ID NO: 214) | AIYTVGGSIFYA DSVRG (SEQ ID NO: 221) | ASGRLRGKWFW PYEYNY (SEQ ID NO: 228) |

TABLE 1-continued

| Anti-gp130 V$_H$H CDR1 | Anti-gp130 V$_H$H CDR2 | Anti-gp130 V$_H$H CDR3 | Anti-IL27Rα V$_H$H CDR1 | Anti-IL27Rα V$_H$H CDR2 | Anti-IL27Rα V$_H$H CDR3 |
|---|---|---|---|---|---|
| AIASGYIDSR (SEQ ID NO: 193) | AIWPGGGLTVY ADSVKG (SEQ ID NO: 199) | GSPRMCPSLEFG FDY (SEQ ID NO: 205) | YVSCDYFLPS (SEQ ID NO: 215) | IIDGTGSTSYAA SVKG (SEQ ID NO: 222) | SCVRGRAISEY (SEQ ID NO: 229) |
| AIASGYIDSR (SEQ ID NO: 193) | AIWPGGGLTVY ADSVKG (SEQ ID NO: 199) | GSPRMCPSLEFG FDY (SEQ ID NO: 205) | STYSNYCLG (SEQ ID NO: 216) | VINWVGGMLYF ADSVKG (SEQ ID NO: 223) | ESVSSFSCGGWL TRPDRVPY (SEQ ID NO: 230) |
| AIASGYIDSR (SEQ ID NO: 193) | AIWPGGGLTVY ADSVKG (SEQ ID NO: 199) | GSPRMCPSLEFG FDY (SEQ ID NO: 205) | FTFSLSSMS (SEQ ID NO: 217) | AISSGGASTYYT DSVKG (SEQ ID NO: 224) | GGSGYGDASRM TSP (SEQ ID NO: 231) |
| FTSNSCGMD (SEQ ID NO: 194) | SISTDGTTGYAD SVKG (SEQ ID NO: 200) | KDGTIATMELC DFGY (SEQ ID NO: 206) | FTFSSYPMS (SEQ ID NO: 211) | TISAGGDTTLYA DSVKG (SEQ ID NO: 218) | GYCYRRNY (SEQ ID NO: 225) |
| FTSNSCGMD (SEQ ID NO: 194) | SISTDGTTGYAD SVKG (SEQ ID NO: 200) | KDGTIATMELC DFGY (SEQ ID NO: 206) | FTFSNYAMS (SEQ ID NO: 212) | GINVAYGITSYA DSVKG (SEQ ID NO: 219) | HSGTTIPRGFISY TK (SEQ ID NO: 226) |
| FTSNSCGMD (SEQ ID NO: 194) | SISTDGTTGYAD SVKG (SEQ ID NO: 200) | KDGTIATMELC DFGY (SEQ ID NO: 206) | FSFSSYAMK (SEQ ID NO: 213) | TISSGGSSTNYA DSVKG (SEQ ID NO: 220) | AIVPTGATME (SEQ ID NO: 227) |
| FTSNSCGMD (SEQ ID NO: 194) | SISTDGTTGYAD SVKG (SEQ ID NO: 200) | KDGTIATMELC DFGY (SEQ ID NO: 206) | FTYSTSNSWMA (SEQ ID NO: 214) | AIYTVGGSIFYA DSVRG (SEQ ID NO: 221) | ASGRLRGKWFW PYEYNY (SEQ ID NO: 228) |
| FTSNSCGMD (SEQ ID NO: 194) | SISTDGTTGYAD SVKG (SEQ ID NO: 200) | KDGTIATMELC DFGY (SEQ ID NO: 206) | YVSCDYFLPS (SEQ ID NO: 215) | IIDGTGSTSYAA SVKG (SEQ ID NO: 222) | SCVRGRAISEY (SEQ ID NO: 229) |
| FTSNSCGMD (SEQ ID NO: 194) | SISTDGTTGYAD SVKG (SEQ ID NO: 200) | KDGTIATMELC DFGY (SEQ ID NO: 206) | STYSNYCLG (SEQ ID NO: 216) | VINWVGGMLYF ADSVKG (SEQ ID NO: 223) | ESVSSFSCGGWL TRPDRVPY (SEQ ID NO: 230) |
| FTSNSCGMD (SEQ ID NO: 194) | SISTDGTTGYAD SVKG (SEQ ID NO: 200) | KDGTIATMELC DFGY (SEQ ID NO: 206) | FTFSLSSMS (SEQ ID NO: 217) | AISSGGASTYYT DSVKG (SEQ ID NO: 224) | GGSGYGDASRM TSP (SEQ ID NO: 231) |
| YPYSNGYMG (SEQ ID NO: 195) | TIYTGDGRTYY ADSVKG (SEQ ID NO: 201) | RAAPLYSSGSPL TRARYNV (SEQ ID NO: 207) | FTFSSYPMS (SEQ ID NO: 211) | TISAGGDTTLYA DSVKG (SEQ ID NO: 218) | GYCYRRNY (SEQ ID NO: 225) |
| YPYSNGYMG (SEQ ID NO: 195) | TIYTGDGRTYY ADSVKG (SEQ ID NO: 201) | RAAPLYSSGSPL TRARYNV (SEQ ID NO: 207) | FTFSNYAMS (SEQ ID NO: 212) | GINVAYGITSYA DSVKG (SEQ ID NO: 219) | HSGTTIPRGFISY TK (SEQ ID NO: 226) |
| YPYSNGYMG (SEQ ID NO: 195) | TIYTGDGRTYY ADSVKG (SEQ ID NO: 201) | RAAPLYSSGSPL TRARYNV (SEQ ID NO: 207) | FSFSSYAMK (SEQ ID NO: 213) | TISSGGSSTNYA DSVKG (SEQ ID NO: 220) | AIVPTGATME (SEQ ID NO: 227) |
| YPYSNGYMG (SEQ ID NO: 195) | TIYTGDGRTYY ADSVKG (SEQ ID NO: 201) | RAAPLYSSGSPL TRARYNV (SEQ ID NO: 207) | FTYSTSNSWMA (SEQ ID NO: 214) | AIYTVGGSIFYA DSVRG (SEQ ID NO: 221) | ASGRLRGKWFW PYEYNY (SEQ ID NO: 228) |
| YPYSNGYMG (SEQ ID NO: 195) | TIYTGDGRTYY ADSVKG (SEQ ID NO: 201) | RAAPLYSSGSPL TRARYNV (SEQ ID NO: 207) | YVSCDYFLPS (SEQ ID NO: 215) | IIDGTGSTSYAA SVKG (SEQ ID NO: 222) | SCVRGRAISEY (SEQ ID NO: 229) |
| YPYSNGYMG (SEQ ID NO: 195) | TIYTGDGRTYY ADSVKG (SEQ ID NO: 201) | RAAPLYSSGSPL TRARYNV (SEQ ID NO: 207) | STYSNYCLG (SEQ ID NO: 216) | VINWVGGMLYF ADSVKG (SEQ ID NO: 223) | ESVSSFSCGGWL TRPDRVPY (SEQ ID NO: 230) |
| YPYSNGYMG (SEQ ID NO: 195) | TIYTGDGRTYY ADSVKG (SEQ ID NO: 201) | RAAPLYSSGSPL TRARYNV (SEQ ID NO: 207) | FTFSLSSMS (SEQ ID NO: 217) | AISSGGASTYYT DSVKG (SEQ ID NO: 224) | GGSGYGDASRM TSP (SEQ ID NO: 231) |
| STYCTYDMH (SEQ ID NO: 196) | AIDSDGTTRYAD SVKG (SEQ ID NO: 202) | GSRWSDY (SEQ ID NO: 208) | FTFSSYPMS (SEQ ID NO: 211) | TISAGGDTTLYA DSVKG (SEQ ID NO: 218) | GYCYRRNY (SEQ ID NO: 225) |
| STYCTYDMH (SEQ ID NO: 196) | AIDSDGTTRYAD SVKG (SEQ ID NO: 202) | GSRWSDY (SEQ ID NO: 208) | FTFSNYAMS (SEQ ID NO: 212) | GINVAYGITSYA DSVKG (SEQ ID NO: 219) | HSGTTIPRGFISY TK (SEQ ID NO: 226) |

TABLE 1-continued

| Anti-gp130 V$_H$H CDR1 | Anti-gp130 V$_H$H CDR2 | Anti-gp130 V$_H$H CDR3 | Anti-IL27Rα V$_H$H CDR1 | Anti-IL27Rα V$_H$H CDR2 | Anti-IL27Rα V$_H$H CDR3 |
|---|---|---|---|---|---|
| STYCTYDMH (SEQ ID NO: 196) | AIDSDGTTRYAD SVKG (SEQ ID NO: 202) | GSRWSDY (SEQ ID NO: 208) | FSFSSYAMK (SEQ ID NO: 213) | TISSGGSSTNYA DSVKG (SEQ ID NO: 220) | AIVPTGATME (SEQ ID NO: 227) |
| STYCTYDMH (SEQ ID NO: 196) | AIDSDGTTRYAD SVKG (SEQ ID NO: 202) | GSRWSDY (SEQ ID NO: 208) | FTYSTSNSWMA (SEQ ID NO: 214) | AIYTVGGSIFYA DSVRG (SEQ ID NO: 221) | ASGRLRGKWFW PYEYNY (SEQ ID NO: 228) |
| STYCTYDMH (SEQ ID NO: 196) | AIDSDGTTRYAD SVKG (SEQ ID NO: 202) | GSRWSDY (SEQ ID NO: 208) | YVSCDYFLPS (SEQ ID NO: 215) | IIDGTGSTSYAA SVKG (SEQ ID NO: 222) | SCVRGRAISEY (SEQ ID NO: 229) |
| STYCTYDMH (SEQ ID NO: 196) | AIDSDGTTRYAD SVKG (SEQ ID NO: 202) | GSRWSDY (SEQ ID NO: 208) | STYSNYCLG (SEQ ID NO: 216) | VINWVGGMLYF ADSVKG (SEQ ID NO: 223) | ESVSSFSCGGWL TRPDRVPY (SEQ ID NO: 230) |
| STYCTYDMH (SEQ ID NO: 196) | AIDSDGTTRYAD SVKG (SEQ ID NO: 202) | GSRWSDY (SEQ ID NO: 208) | FTFSLSSMS (SEQ ID NO: 217) | AISSGGASTYYT DSVKG (SEQ ID NO: 224) | GGSGYGDASRM TSP (SEQ ID NO: 231) |
| YAYSTCNMG (SEQ ID NO: 197) | AFISDGSTYYAD SVKG (SEQ ID NO: 203) | NCYRRLRNY (SEQ ID NO: 209) | FTFSSYPMS (SEQ ID NO: 211) | TISAGGDTTLYA DSVKG (SEQ ID NO: 218) | GYCYRRNY (SEQ ID NO: 225) |
| YAYSTCNMG (SEQ ID NO: 197) | AFISDGSTYYAD SVKG (SEQ ID NO: 203) | NCYRRLRNY (SEQ ID NO: 209) | FTFSNYAMS (SEQ ID NO: 212) | GINVAYGITSYA DSVKG (SEQ ID NO: 219) | HSGTTIPRGFISY TK (SEQ ID NO: 226) |
| YAYSTCNMG (SEQ ID NO: 197) | AFISDGSTYYAD SVKG (SEQ ID NO: 203) | NCYRRLRNY (SEQ ID NO: 209) | FSFSSYAMK (SEQ ID NO: 213) | TISSGGSSTNYA DSVKG (SEQ ID NO: 220) | AIVPTGATME (SEQ ID NO: 227) |
| YAYSTCNMG (SEQ ID NO: 197) | AFISDGSTYYAD SVKG (SEQ ID NO: 203) | NCYRRLRNY (SEQ ID NO: 209) | FTYSTSNSWMA (SEQ ID NO: 214) | AIYTVGGSIFYA DSVRG (SEQ ID NO: 221) | ASGRLRGKWFW PYEYNY (SEQ ID NO: 228) |
| YAYSTCNMG (SEQ ID NO: 197) | AFISDGSTYYAD SVKG (SEQ ID NO: 203) | NCYRRLRNY (SEQ ID NO: 209) | YVSCDYFLPS (SEQ ID NO: 215) | IIDGTGSTSYAA SVKG (SEQ ID NO: 222) | SCVRGRAISEY (SEQ ID NO: 229) |
| YAYSTCNMG (SEQ ID NO: 197) | AFISDGSTYYAD SVKG (SEQ ID NO: 203) | NCYRRLRNY (SEQ ID NO: 209) | STYSNYCLG (SEQ ID NO: 216) | VINWVGGMLYF ADSVKG (SEQ ID NO: 223) | ESVSSFSCGGWL TRPDRVPY (SEQ ID NO: 230) |
| YAYSTCNMG (SEQ ID NO: 197) | AFISDGSTYYAD SVKG (SEQ ID NO: 203) | NCYRRLRNY (SEQ ID NO: 209) | FTFSLSSMS (SEQ ID NO: 217) | AISSGGASTYYT DSVKG (SEQ ID NO: 224) | GGSGYGDASRM TSP (SEQ ID NO: 231) |
| LTFDDSVMG (SEQ ID NO: 198) | CISSSGANAFYA DSVKG (SEQ ID NO: 204) | GHACAGYYPIP YDDY (SEQ ID NO: 210) | FTFSSYPMS (SEQ ID NO: 211) | TISAGGDTTLYA DSVKG (SEQ ID NO: 218) | GYCYRRNY (SEQ ID NO: 225) |
| LTFDDSVMG (SEQ ID NO: 198) | CISSSGANAFYA DSVKG (SEQ ID NO: 204) | GHACAGYYPIP YDDY (SEQ ID NO: 210) | FTFSNYAMS (SEQ ID NO: 212) | GINVAYGITSYA DSVKG (SEQ ID NO: 219) | HSGTTIPRGFISY TK (SEQ ID NO: 226) |
| LTFDDSVMG (SEQ ID NO: 198) | CISSSGANAFYA DSVKG (SEQ ID NO: 204) | GHACAGYYPIP YDDY (SEQ ID NO: 210) | FSFSSYAMK (SEQ ID NO: 213) | TISSGGSSTNYA DSVKG (SEQ ID NO: 220) | AIVPTGATME (SEQ ID NO: 227) |
| LTFDDSVMG (SEQ ID NO: 198) | CISSSGANAFYA DSVKG (SEQ ID NO: 204) | GHACAGYYPIP YDDY (SEQ ID NO: 210) | FTYSTSNSWMA (SEQ ID NO: 214) | AIYTVGGSIFYA DSVRG (SEQ ID NO: 221) | ASGRLRGKWFW PYEYNY (SEQ ID NO: 228) |
| LTFDDSVMG (SEQ ID NO: 198) | CISSSGANAFYA DSVKG (SEQ ID NO: 204) | GHACAGYYPIP YDDY (SEQ ID NO: 210) | YVSCDYFLPS (SEQ ID NO: 215) | IIDGTGSTSYAA SVKG (SEQ ID NO: 222) | SCVRGRAISEY (SEQ ID NO: 229) |
| LTFDDSVMG (SEQ ID NO: 198) | CISSSGANAFYA DSVKG (SEQ ID NO: 204) | GHACAGYYPIP YDDY (SEQ ID NO: 210) | STYSNYCLG (SEQ ID NO: 216) | VINWVGGMLYF ADSVKG (SEQ ID NO: 223) | ESVSSFSCGGWL TRPDRVPY (SEQ ID NO: 230) |
| LTFDDSVMG (SEQ ID NO: 198) | CISSSGANAFYA DSVKG (SEQ ID NO: 204) | GHACAGYYPIP YDDY (SEQ ID NO: 210) | FTFSLSSMS (SEQ ID NO: 217) | AISSGGASTYYT DSVKG (SEQ ID NO: 224) | GGSGYGDASRM TSP (SEQ ID NO: 231) |

Anti-GP130-Linker-Anti-Il27Rα $V_HH$

A bispecific $V_HH^2$ can contain, from the N-terminus to the C-terminus, a first $V_HH$ binding to gp130 (an anti-gp130 $V_HH$ antibody), a linker, and a second $V_HH$ binding to IL27Rα (an anti-IL27Rα $V_HH$ antibody). In other words, the linker joins the C-terminus of the anti-gp130 $V_HH$ in the binding protein to the N-terminus of the anti-IL27Rα $V_HH$ in the binding protein. In some embodiments, a purification peptide, e.g., a six-histidine peptide ((His)$_6$ (SEQ ID NO: 1531) or His-tag) can be included, or not, in the bispecific $V_HH^2$.

In certain embodiments, a bispecific $V_HH^2$ described herein comprises an anti-gp130 $V_HH$ antibody comprising a sequence having at least 90% (e.g., 91%, 92%, 93%, 94%, 95%, 96%, 97%, 98%, 99%, or 100%) sequence identity to a sequence of any one of SEQ ID NOS:232-237; and an anti-IL27Rα $V_HH$ antibody comprising a sequence having at least 90% (e.g., 91%, 92%, 93%, 94%, 95%, 96%, 97%, 98%, 99%, or 100%) sequence identity to a sequence of any one of SEQ ID NOS:238-244.

In certain embodiments, a bispecific $V_HH^2$ described herein comprises an anti-gp130 $V_HH$ antibody and an anti-IL27Rα $V_HH$ antibody as described in each row of Table 2A below or Table 1A above. In some embodiments, in each row of Table 2A, the anti-gp130 $V_HH$ antibody and the anti-IL27Rα $V_HH$ antibody can each, independently, comprise at least 90% (e.g., 91%, 92%, 93%, 94%, 95%, 96%, 97%, 98%, 99%, or 100%) sequence identity to the sequence described in each row of Table 2A. In some embodiments, the bispecific $V_HH^2$ can comprise a linker (e.g., linkers described in Section IV) between the anti-gp130 $V_HH$ antibody and the anti-IL27Rα $V_HH$ antibody as described in each row of Table 2A below. In particular embodiments, the linker is GGGS (SEQ ID NO:108) or (GGGS)n (SEQ ID NO: 1532), (GGS)nG (SEQ ID NO: 1533), (GGGGS)n (SEQ ID NO: 1534) as described elsewhere herein. The sequence of the anti-gp130 $V_HH$ is N-terminus to the linker and the sequence of the anti-IL27Rα $V_HH$ is C-terminus to the linker. Examples of linkers are further described in Section IV below. The CDR sequences in each $V_HH$ are underlined.

TABLE 2A

| N-terminal Anti-gp130 $V_HH$ | C-terminal Anti-IL27Rα $V_HH$ |
|---|---|
| QVQLQESGGGSVQAGGSLRLSCTASGAIASGYIDSRWCMAWFRQAPGKEREGVAAIWPGGGLTVYADSVKGRFTISRDHAKNTLYLQMNNLKPEDTAMYYCAAGSPRMCPSLEFGFDYWGQGTQVTVSS (SEQ ID NO: 232) | QVQLQESGGGLVQPGGSLRLSCAASGFTFSSYPMSWVRQAPGKGLEWISTISAGGDTTLYADSVKGRFTSSRDNAKNTLYLQLNSLKTEDAAIYYCAKRIDCNSGYCYRRNYWGQGTQVTVS (SEQ ID NO: 238) |
| QVQLQESGGGSVQAGGSLRLSCTASGAIASGYIDSRWCMAWFRQAPGKEREGVAAIWPGGGLTVYADSVKGRFTISRDHAKNTLYLQMNNLKPEDTAMYYCAAGSPRMCPSLEFGFDYWGQGTQVTVSS (SEQ ID NO: 232) | QVQLQESGGGLVQPGESLRLSCTASGFTFSNYAMSWVRQAPGKGLEWVSGINVAYGITSYADSVKGRFTISRDNTKNTLYLQLNSLKTEDTAIYYCVKHSGTTIPRGFISYTKRGQGTQVTVS (SEQ ID NO: 239) |
| QVQLQESGGGSVQAGGSLRLSCTASGAIASGYIDSRWCMAWFRQAPGKEREGVAAIWPGGGLTVYADSVKGRFTISRDHAKNTLYLQMNNLKPEDTAMYYCAAGSPRMCPSLEFGFDYWGQGTQVTVSS (SEQ ID NO: 232) | QVQLQESGGGLVQPGGSLRLSCAASGFSFSSYAMKWVRQAPGKGLEWVSTISSGGSSTNYADSVKGRFTISRDNAKNTLYLQLNSLKIEDTAMYYCAKAIVPTGATMERGQGTQVTVS (SEQ ID NO: 240) |
| QVQLQESGGGSVQAGGSLRLSCTASGAIASGYIDSRWCMAWFRQAPGKEREGVAAIWPGGGLTVYADSVKGRFTISRDHAKNTLYLQMNNLKPEDTAMYYCAAGSPRMCPSLEFGFDYWGQGTQVTVSS (SEQ ID NO: 232) | QVQLQESGGGSVQSGGSLRLSCAASGFTYSTSNSWMAWFRQAPGKEREGVAAIYTVGGSIFYADSVRGRFTISQDATKNMFYLQMNTLKPEDTAMYYCAAASGRLRGKWFWPYEYNYWGQGTQVTVS (SEQ ID NO: 241) |
| QVQLQESGGGSVQAGGSLRLSCTASGAIASGYIDSRWCMAWFRQAPGKEREGVAAIWPGGGLTVYADSVKGRFTISRDHAKNTLYLQMNNLKPEDTAMYYCAAGSPRMCPSLEFGFDYWGQGTQVTVSS (SEQ ID NO: 232) | QVQLQESGGGSVQAGGSLRLSCVASGYVSCDYFLPSWYRQAPGKEREFVSIIDGTGSTSYAASVKGRFTASQDKGKNIAYLQMNTLKPEDTAMYYCKASCVRGRAISEYWGQGTQVTVS (SEQ ID NO: 242) |
| QVQLQESGGGSVQAGGSLRLSCTASGAIASGYIDSRWCMAWFRQAPGKEREGVAAIWPGGGLTVYADSVKGRFTISRDHAKNTLYLQMNNLKPEDTAMYYCAAGSPRMCPSLEFGFDYWGQGTQVTVSS (SEQ ID NO: 232) | QVQLQESGGGSVQAGGSLRLSCRASGSTYSNYCLGWFRQITGKEREGVAVINWVGGMLYFADSVKGRFTVSQDQAKNTVYLQMNSLKPEDTAMYYCAAESVSSFSCGGWLTRPDRVPYWGQGTQVTVS (SEQ ID NO: 243) |
| QVQLQESGGGSVQAGGSLRLSCTASGAIASGYIDSRWCMAWFRQAPGKEREGVAAIWPGGGLTVYADSVKGRFTISRDHAKNTLYLQMNNLKPEDTAMYYCAAGSPRMCPSLEFGFDYWGQGTQVTVSS (SEQ ID NO: 232) | QVQLQESGGGLVQPGGSLRLSCAASGFTFSLSSMSWVRQAPGKGLEWVSAISSGGASTYYTDSVKGRFTISRDNAKNMLYLQLNSLKTEDTAMYYCAKGSGYGDASRMTSPGSQGTQVTVS (SEQ ID NO: 244) |
| QVQLQESGGGSVQAGGSLRLSCTAPGFTSNSCGMDWYRQAPGKEREFVSSISTDGTTGYADSVKGRFTISKDKAKDTVYLQMNSLKPEDTGMYSCKTKDGTIATMELCDFGYWGQGTQVTVSS (SEQ ID NO: 233) | QVQLQESGGGLVQPGGSLRLSCAASGFTFSSYPMSWVRQAPGKGLEWISTISAGGDTTLYADSVKGRFTSSRDNAKNTLYLQLNSLKTEDAAIYYCAKRIDCNSGYCYRRNYWGQGTQVTVS (SEQ ID NO: 238) |

TABLE 2A-continued

| N-terminal Anti-gp130 V$_H$H | C-terminal Anti-IL27Rα V$_H$H |
|---|---|
| QVQLQESGGGSVQAGGSLRLSCTAPGFTSNSC GMDWYRQAPGKEREFVSSISTDGTTGYADSV KGRFTISKDKAKDTVYLQMNSLKPEDTGMYS CKTKDGTIATMELCDFGYWGQGTQVTVSS (SEQ ID NO: 233) | QVQLQESGGGLVQPGESLRLSCTASGFTFSNY AMSWVRQAPGKGLEWVSGINVAYGITSYADS VKGRFTISRDNTKNTLYLQLNSLKTEDTAIYYC VKHSGTTIPRGFISYTKRGQGTQVTVS (SEQ ID NO: 239) |
| QVQLQESGGGSVQAGGSLRLSCTAPGFTSNSC GMDWYRQAPGKEREFVSSISTDGTTGYADSV KGRFTISKDKAKDTVYLQMNSLKPEDTGMYS CKTKDGTIATMELCDFGYWGQGTQVTVSS (SEQ ID NO: 233) | QVQLQESGGGLVQPGGSLRLSCAASGFSFSSY AMKWVRQAPGKGLEWVSTISSGGSSTNYADS VKGRFTISRDNAKNTLYLQLNSLKIEDTAMYY CAKAIVPTGATMERGQGTQVTVS (SEQ ID NO: 240) |
| QVQLQESGGGSVQAGGSLRLSCTAPGFTSNSC GMDWYRQAPGKEREFVSSISTDGTTGYADSV KGRFTISKDKAKDTVYLQMNSLKPEDTGMYS CKTKDGTIATMELCDFGYWGQGTQVTVSS (SEQ ID NO: 233) | QVQLQESGGGSVQSGGSLRLSCAASGFTYSTS NSWMAWFRQAPGKEREGVAAIYTVGGSIFYA DSVRGRFTISQDATKNMFYLQMNTLKPEDTA MYYCAAASGRLRGKWFPYEYNYWGQGTQ VTVS (SEQ ID NO: 241) |
| QVQLQESGGGSVQAGGSLRLSCTAPGFTSNSC GMDWYRQAPGKEREFVSSISTDGTTGYADSV KGRFTISKDKAKDTVYLQMNSLKPEDTGMYS CKTKDGTIATMELCDFGYWGQGTQVTVSS (SEQ ID NO: 233) | QVQLQESGGGSVQAGGSLRLSCVASGYVSCD YFLPSWYRQAPGKEREFVSIIDGTGSTSYAASV KGRFTASQDKGKNIAYLQMNTLKPEDTAMYY CKASCVRGRAISEYWGQGTQVTVS (SEQ ID NO: 242) |
| QVQLQESGGGSVQAGGSLRLSCTAPGFTSNSC GMDWYRQAPGKEREFVSSISTDGTTGYADSV KGRFTISKDKAKDTVYLQMNSLKPEDTGMYS CKTKDGTIATMELCDFGYWGQGTQVTVSS (SEQ ID NO: 233) | QVQLQESGGGSVQAGGSLRLSCRASGSTYSNY CLGWFRQITGKEREGVAVINWVGGMLYFADS VKGRFTVSQDQAKNTVYLQMNSLKPEDTAMY YCAAESVSSFSCGGWLTRPDRVPYWGQGTQV TVS (SEQ ID NO: 243) |
| QVQLQESGGGSVQAGGSLRLSCTAPGFTSNSC GMDWYRQAPGKEREFVSSISTDGTTGYADSV KGRFTISKDKAKDTVYLQMNSLKPEDTGMYS CKTKDGTIATMELCDFGYWGQGTQVTVSS (SEQ ID NO: 233) | QVQLQESGGGLVQPGGSLRLSCAASGFTFSLSS MSWVRQAPGKGLEWVSAISSGGASTYYTDSV KGRFTISRDNAKNMLYLQLNSLKTEDTAMYY CAKGGSGYGDASRMTSPGSQGTQVTVS (SEQ ID NO: 244) |
| QVQLQESGGGSVQAGGSLRLSCAASGYPYSN GYMGWFRQAPGKEREGVATIYTGDGRTYYAD SVKGRFTISRDNAKNTVDLQMSSLKPEDTAMY YCAARAAPLYSSGSPLTRARYNVWGQGTQVT VSS (SEQ ID NO: 234) | QVQLQESGGGLVQPGGSLRLSCAASGFTFSSY PMSWVRQAPGKGLEWISTISAGGDTTLYADSV KGRFTSSRDNAKNTLYLQLNSLKTEDAAIYYC AKRIDCNSGYCYRRNYWGQGTQVTVS (SEQ ID NO: 238) |
| QVQLQESGGGSVQAGGSLRLSCAASGYPYSN GYMGWFRQAPGKEREGVATIYTGDGRTYYAD SVKGRFTISRDNAKNTVDLQMSSLKPEDTAMY YCAARAAPLYSSGSPLTRARYNVWGQGTQVT VSS (SEQ ID NO: 234) | QVQLQESGGGLVQPGESLRLSCTASGFTFSNY AMSWVRQAPGKGLEWVSGINVAYGITSYADS VKGRFTISRDNTKNTLYLQLNSLKTEDTAIYYC VKHSGTTIPRGFISYTKRGQGTQVTVS (SEQ ID NO: 239) |
| QVQLQESGGGSVQAGGSLRLSCAASGYPYSN GYMGWFRQAPGKEREGVATIYTGDGRTYYAD SVKGRFTISRDNAKNTVDLQMSSLKPEDTAMY YCAARAAPLYSSGSPLTRARYNVWGQGTQVT VSS (SEQ ID NO: 234) | QVQLQESGGGLVQPGGSLRLSCAASGFSFSSY AMKWVRQAPGKGLEWVSTISSGGSSTNYADS VKGRFTISRDNAKNTLYLQLNSLKIEDTAMYY CAKAIVPTGATMERGQGTQVTVS (SEQ ID NO: 240) |
| QVQLQESGGGSVQAGGSLRLSCAASGYPYSN GYMGWFRQAPGKEREGVATIYTGDGRTYYAD SVKGRFTISRDNAKNTVDLQMSSLKPEDTAMY YCAARAAPLYSSGSPLTRARYNVWGQGTQVT VSS (SEQ ID NO: 234) | QVQLQESGGGSVQSGGSLRLSCAASGFTYSTS NSWMAWFRQAPGKEREGVAAIYTVGGSIFYA DSVRGRFTISQDATKNMFYLQMNTLKPEDTA MYYCAAASGRLRGKWFPYEYNYWGQGTQ VTVS (SEQ ID NO: 241) |
| QVQLQESGGGSVQAGGSLRLSCAASGYPYSN GYMGWFRQAPGKEREGVATIYTGDGRTYYAD SVKGRFTISRDNAKNTVDLQMSSLKPEDTAMY YCAARAAPLYSSGSPLTRARYNVWGQGTQVT VSS (SEQ ID NO: 234) | QVQLQESGGGSVQAGGSLRLSCVASGYVSCD YFLPSWYRQAPGKEREFVSIIDGTGSTSYAASV KGRFTASQDKGKNIAYLQMNTLKPEDTAMYY CKASCVRGRAISEYWGQGTQVTVS (SEQ ID NO: 242) |
| QVQLQESGGGSVQAGGSLRLSCAASGYPYSN GYMGWFRQAPGKEREGVATIYTGDGRTYYAD SVKGRFTISRDNAKNTVDLQMSSLKPEDTAMY YCAARAAPLYSSGSPLTRARYNVWGQGTQVT VSS (SEQ ID NO: 234) | QVQLQESGGGSVQAGGSLRLSCRASGSTYSNY CLGWFRQITGKEREGVAVINWVGGMLYFADS VKGRFTVSQDQAKNTVYLQMNSLKPEDTAMY YCAAESVSSFSCGGWLTRPDRVPYWGQGTQV TVS (SEQ ID NO: 243) |
| QVQLQESGGGSVQAGGSLRLSCAASGYPYSN GYMGWFRQAPGKEREGVATIYTGDGRTYYAD SVKGRFTISRDNAKNTVDLQMSSLKPEDTAMY YCAARAAPLYSSGSPLTRARYNVWGQGTQVT VSS (SEQ ID NO: 234) | QVQLQESGGGLVQPGGSLRLSCAASGFTFSLSS MSWVRQAPGKGLEWVSAISSGGASTYYTDSV KGRFTISRDNAKNMLYLQLNSLKTEDTAMYY CAKGGSGYGDASRMTSPGSQGTQVTVS (SEQ ID NO: 244) |

TABLE 2A-continued

| N-terminal Anti-gp130 V$_H$H | C-terminal Anti-IL27Rα V$_H$H |
|---|---|
| QVQLQESGGGSVQAGGSLRLSCVASASTYCTYDMHWYRQAPGKGREFVSAIDSDGTTRYADSVKGRFTISQGTAKNTVYLQMNSLQPEDTAMYYCKTVCVVGSRWSDYWGQGTQVTVSS (SEQ ID NO: 235) | QVQLQESGGGLVQPGGSLRLSCAASGFTFSSYPMSWVRQAPGKGLEWISTISAGGDTTLYADSVKGRFTSSRDNAKNTLYLQLNSLKTEDAAIYYCAKRIDCNSGYCYRRNYWGQGTQVTVS (SEQ ID NO: 238) |
| QVQLQESGGGSVQAGGSLRLSCVASASTYCTYDMHWYRQAPGKGREFVSAIDSDGTTRYADSVKGRFTISQGTAKNTVYLQMNSLQPEDTAMYYCKTVCVVGSRWSDYWGQGTQVTVSS (SEQ ID NO: 235) | QVQLQESGGGLVQPGESLRLSCTASGFTFSNYAMSWVRQAPGKGLEWVSGINVAYGITSYADSVKGRFTISRDNTKNTLYLQLNSLKTEDTAIYYCVKHSGTTIPRGFISYTKRGQGTQVTVS (SEQ ID NO: 239) |
| QVQLQESGGGSVQAGGSLRLSCVASASTYCTYDMHWYRQAPGKGREFVSAIDSDGTTRYADSVKGRFTISQGTAKNTVYLQMNSLQPEDTAMYYCKTVCVVGSRWSDYWGQGTQVTVSS (SEQ ID NO: 235) | QVQLQESGGGLVQPGGSLRLSCAASGFSFSSYAMKWVRQAPGKGLEWVSTISSGGSSTNYADSVKGRFTISRDNAKNTLYLQLNSLKIEDTAMYYCAKAIVPTGATMERGQGTQVTVS (SEQ ID NO: 240) |
| QVQLQESGGGSVQAGGSLRLSCVASASTYCTYDMHWYRQAPGKGREFVSAIDSDGTTRYADSVKGRFTISQGTAKNTVYLQMNSLQPEDTAMYYCKTVCVVGSRWSDYWGQGTQVTVSS (SEQ ID NO: 235) | QVQLQESGGGSVQSGGSLRLSCAASGFTYSTSNSWMAWFRQAPGKEREGVAAIYTVGGSIFYADSVRGRFTISQDATKNMFYLQMNTLKPEDTAMYYCAAASGRLRGKWFWPYEYNYWGQGTQVTVS (SEQ ID NO: 241) |
| QVQLQESGGGSVQAGGSLRLSCVASASTYCTYDMHWYRQAPGKGREFVSAIDSDGTTRYADSVKGRFTISQGTAKNTVYLQMNSLQPEDTAMYYCKTVCVVGSRWSDYWGQGTQVTVSS (SEQ ID NO: 235) | QVQLQESGGGSVQAGGSLRLSCVASGYVSCDYFLPSWYRQAPGKEREFVSIIDGTGSTSYAASVKGRFTASQDKGKNIAYLQMNTLKPEDTAMYYCKASCVRGRAISEYWGQGTQVTVS (SEQ ID NO: 242) |
| QVQLQESGGGSVQAGGSLRLSCVASASTYCTYDMHWYRQAPGKGREFVSAIDSDGTTRYADSVKGRFTISQGTAKNTVYLQMNSLQPEDTAMYYCKTVCVVGSRWSDYWGQGTQVTVSS (SEQ ID NO: 235) | QVQLQESGGGSVQAGGSLRLSCRASGSTYSNYCLGWFRQITGKEREGVAVINWVGGMLYFADSVKGRFTVSQDQAKNTVYLQMNSLKPEDTAMYYCAAESVSSFSCGGWLTRPDRVPYWGQGTQVTVS (SEQ ID NO: 243) |
| QVQLQESGGGSVQAGGSLRLSCVASASTYCTYDMHWYRQAPGKGREFVSAIDSDGTTRYADSVKGRFTISQGTAKNTVYLQMNSLQPEDTAMYYCKTVCVVGSRWSDYWGQGTQVTVSS (SEQ ID NO: 235) | QVQLQESGGGLVQPGGSLRLSCAASGFTFSLSSMSWVRQAPGKGLEWVSAISSGGASTYYTDSVKGRFTISRDNAKNMLYLQLNSLKTEDTAMYYCAKGGSGYGDASRMTSPGSQGTQVTVS (SEQ ID NO: 244) |
| QVQLQESGGGSVQAGGSLTLSCAASEYAYSTCNMGWYRQAPGKERELVSAFISDGSTYYADSVKGRFTITRDNAKNTVYLQMNSLKPEDTAIYYCSANCYRRLRNYWGQGTQVTVSS (SEQ ID NO: 236) | QVQLQESGGGLVQPGGSLRLSCAASGFTFSSYPMSWVRQAPGKGLEWISTISAGGDTTLYADSVKGRFTSSRDNAKNTLYLQLNSLKTEDAAIYYCAKRIDCNSGYCYRRNYWGQGTQVTVS (SEQ ID NO: 238) |
| QVQLQESGGGSVQAGGSLTLSCAASEYAYSTCNMGWYRQAPGKERELVSAFISDGSTYYADSVKGRFTITRDNAKNTVYLQMNSLKPEDTAIYYCSANCYRRLRNYWGQGTQVTVSS (SEQ ID NO: 236) | QVQLQESGGGLVQPGESLRLSCTASGFTFSNYAMSWVRQAPGKGLEWVSGINVAYGITSYADSVKGRFTISRDNTKNTLYLQLNSLKTEDTAIYYCVKHSGTTIPRGFISYTKRGQGTQVTVS (SEQ ID NO: 239) |
| QVQLQESGGGSVQAGGSLTLSCAASEYAYSTCNMGWYRQAPGKERELVSAFISDGSTYYADSVKGRFTITRDNAKNTVYLQMNSLKPEDTAIYYCSANCYRRLRNYWGQGTQVTVSS (SEQ ID NO: 236) | QVQLQESGGGLVQPGGSLRLSCAASGFSFSSYAMKWVRQAPGKGLEWVSTISSGGSSTNYADSVKGRFTISRDNAKNTLYLQLNSLKIEDTAMYYCAKAIVPTGATMERGQGTQVTVS (SEQ ID NO: 240) |
| QVQLQESGGGSVQAGGSLTLSCAASEYAYSTCNMGWYRQAPGKERELVSAFISDGSTYYADSVKGRFTITRDNAKNTVYLQMNSLKPEDTAIYYCSANCYRRLRNYWGQGTQVTVSS (SEQ ID NO: 236) | QVQLQESGGGSVQSGGSLRLSCAASGFTYSTSNSWMAWFRQAPGKEREGVAAIYTVGGSIFYADSVRGRFTISQDATKNMFYLQMNTLKPEDTAMYYCAAASGRLRGKWFWPYEYNYWGQGTQVTVS (SEQ ID NO: 241) |
| QVQLQESGGGSVQAGGSLTLSCAASEYAYSTCNMGWYRQAPGKERELVSAFISDGSTYYADSVKGRFTITRDNAKNTVYLQMNSLKPEDTAIYYCSANCYRRLRNYWGQGTQVTVSS (SEQ ID NO: 236) | QVQLQESGGGSVQAGGSLRLSCVASGYVSCDYFLPSWYRQAPGKEREFVSIIDGTGSTSYAASVKGRFTASQDKGKNIAYLQMNTLKPEDTAMYYCKASCVRGRAISEYWGQGTQVTVS (SEQ ID NO: 242) |
| QVQLQESGGGSVQAGGSLTLSCAASEYAYSTCNMGWYRQAPGKERELVSAFISDGSTYYADSVKGRFTITRDNAKNTVYLQMNSLKPEDTAIYYCSANCYRRLRNYWGQGTQVTVSS (SEQ ID NO: 236) | QVQLQESGGGSVQAGGSLRLSCRASGSTYSNYCLGWFRQITGKEREGVAVINWVGGMLYFADSVKGRFTVSQDQAKNTVYLQMNSLKPEDTAMYYCAAESVSSFSCGGWLTRPDRVPYWGQGTQVTVS (SEQ ID NO: 243) |

TABLE 2A-continued

| N-terminal Anti-gp130 V$_H$H | C-terminal Anti-IL27Rα V$_H$H |
|---|---|
| QVQLQESGGGSVQAGGSLTLSCAASEYAYSTC NMGWYRQAPGKERELVSAFISDGSTYYADSV KGRFTITRDNAKNTVYLQMNSLKPEDTAIYYC SANCYRRLRNYWGQGTQVTVSS (SEQ ID NO: 236) | QVQLQESGGGLVQPGGSLRLSCAASGFTFSLSS MSWVRQAPGKGLEWVSAISSGGASTYYTDSV KGRFTISRDNAKNMLYLQLNSLKTEDTAMYY CAKGGSGYGDASRMTSPGSQGTQVTVS (SEQ ID NO: 244) |
| QVQLQESGGGLVQPGGSLRLSCTASGLTFDDS VMGWFRQAPGKGREAVSCISSSGANAFYADS VKGRFTISRDNAKNTLYLQMNSLKPEDTATYY CKRGHACAGYYPIPYDDYWGQGTQVTVSS (SEQ ID NO: 237) | QVQLQESGGGLVQPGGSLRLSCAASGFTFSSY PMSWVRQAPGKGLEWISTISAGGDTTLYADSV KGRFTSSRDNAKNTLYLQLNSLKTEDAAIYYC AKRIDCNSGYCYRRNYWGQGTQVTVS (SEQ ID NO: 238) |
| QVQLQESGGGLVQPGGSLRLSCTASGLTFDDS VMGWFRQAPGKGREAVSCISSSGANAFYADS VKGRFTISRDNTKNTLYLQMNSLKPEDTATYY CKRGHACAGYYPIPYDDYWGQGTQVTVSS (SEQ ID NO: 237) | QVQLQESGGGLVQPGESLRLSCTASGFTFSNY AMSWVRQAPGKGLEWVSGINVAYGITSYADS VKHSGTTIPRGFISYTKRGQGTQVTVS (SEQ ID NO: 239) |
| QVQLQESGGGLVQPGGSLRLSCTASGLTFDDS VMGWFRQAPGKGREAVSCISSSGANAFYADS VKGRFTISRDNAKNTLYLQMNSLKPEDTATYY CKRGHACAGYYPIPYDDYWGQGTQVTVSS (SEQ ID NO: 237) | QVQLQESGGGLVQPGGSLRLSCAASGFSFSSY AMKWVRQAPGKGLEWVSTISSGGSSTNYADS VKGRFTISRDNAKNTLYLQLNSLKIEDTAMYY CAKAIVPTGATMERGQGTQVTVS (SEQ ID NO: 240) |
| QVQLQESGGGLVQPGGSLRLSCTASGLTFDDS VMGWFRQAPGKGREAVSCISSSGANAFYADS VKGRFTISRDNAKNTLYLQMNSLKPEDTATYY CKRGHACAGYYPIPYDDYWGQGTQVTVSS (SEQ ID NO: 237) | QVQLQESGGGSVQSGGSLRLSCAASGFTYSTS NSWMAWFRQAPGKEREGVAAIYTVGGSIFYA DSVRGRFTISQDATKNMFYLQMNTLKPEDTA MYYCAAASGRLRGKWFWPYEYNYWGQGTQ VTVS (SEQ ID NO: 241) |
| QVQLQESGGGLVQPGGSLRLSCTASGLTFDDS VMGWFRQAPGKGREAVSCISSSGANAFYADS VKGRFTISRDNAKNTLYLQMNSLKPEDTATYY CKRGHACAGYYPIPYDDYWGQGTQVTVSS (SEQ ID NO: 237) | QVQLQESGGGSVQAGGSLRLSCVASGYVSCD YFLPSWYRQAPGKEREFVSIIDGTGSTSYAASV KGRFTASQDKGKNIAYLQMNTLKPEDTAMYY CKASCVRGRAISEYWGQGTQVTVS (SEQ ID NO: 242) |
| QVQLQESGGGLVQPGGSLRLSCTASGLTFDDS VMGWFRQAPGKGREAVSCISSSGANAFYADS VKGRFTISRDNAKNTLYLQMNSLKPEDTATYY CKRGHACAGYYPIPYDDYWGQGTQVTVSS (SEQ ID NO: 237) | QVQLQESGGGSVQAGGSLRLSCRASGSTYSNY CLGWFRQITGKEREGVAVINWVGGMLYFADS VKGRFTVSQDQAKNTVYLQMNSLKPEDTAMY YCAAESVSSFSCGGWLTRPDRVPYWGQGTQV TVS (SEQ ID NO: 243) |
| QVQLQESGGGLVQPGGSLRLSCTASGLTFDDS VMGWFRQAPGKGREAVSCISSSGANAFYADS VKGRFTISRDNAKNTLYLQMNSLKPEDTATYY CKRGHACAGYYPIPYDDYWGQGTQVTVSS (SEQ ID NO: 237) | QVQLQESGGGLVQPGGSLRLSCAASGFTFSLSS MSWVRQAPGKGLEWVSAISSGGASTYYTDSV KGRFTISRDNAKNMLYLQLNSLKTEDTAMYY CAKGGSGYGDASRMTSPGSQGTQVTVS (SEQ ID NO: 244) |

In certain embodiments, the bispecific V$_H$H$^2$ comprises a sequence that is substantially identical to a sequence of any one of SEQ ID NOS: 1-42. Such a bispecific V$_H$HZ can have a sequence having at least 90% (e.g., 91%, 92%, 93%, 94%, 95%, 96%, 97%, 98%, 9900, or 1000%) sequence identity to a sequence of any one of SEQ ID NOS: 1-42, as shown in Table 2B below. In each of sequences of SEQ ID NOS: 1-42, the linker GGGS (SEQ ID NO: 108) is in bold. The sequence of the anti-gp130 V$_H$H is N-terminus to the linker and the sequence of the anti-IL27Rα V$_H$H is C-terminus to the linker. The CDR sequences in each V$_H$H are underlined.

TABLE 2B

| SEQ ID NO | Sequence |
|---|---|
| 1 | QVQLQESGGGSVQAGGSLRLSCTASGAIASGYIDSRWCMAWFRQAPGKEREGVAAIWPGG GLTVYADSVKGRFTISRDHAKNTLYLQMNNLKPEDTAMYYCAAGSPRMCPSLEFGFDYW GQGTQVTVSSGGGSQVQLQESGGGLVQPGGSLRLSCAASGFTFSSYPMSWVRQAPGKGLE WISTISAGGDTTLYADSVKGRFTSSRDNAKNTLYLQLNSLKTEDAAIYYCAKRIDCNSGYC YRRNYWGQGTQVTVSS |
| 2 | QVQLQESGGGSVQAGGSLRLSCTASGAIASGYIDSRWCMAWFRQAPGKEREGVAAIWPGG GLTVYADSVKGRFTISRDHAKNTLYLQMNNLKPEDTAMYYCAAGSPRMCPSLEFGFDYW GQGTQVTVSSGGGSQVQLQESGGGLVQPGESLRLSCTASGFTFSNYAMSWVRQAPGKGLE WVSGINVAYGITSYADSVKGRFTISRDNTKNTLYLQLNSLKTEDTAIYYCVKHSGTTIPRGFI SYTKRGQGTQVTVSS |

TABLE 2B-continued

| SEQ ID NO | Sequence |
|---|---|
| 3 | QVQLQESGGGSVQAGGSLRLSCTASGAIASGYIDSRWCMAWFRQAPGKEREGVAAIWPGG GLTVYADSVKGRFTISRDHAKNTLYLQMNNLKPEDTAMYYCAAGSPRMCPSLEFGFDYW GQGTQVTVSSGGGSQVQLQESGGGLVQPGGSLRLSCAASGFSFSSYAMKWVRQAPGKGL EWVSTISSGGSSTNYADSVKGRFTISRDNAKNTLYLQLNSLKIEDTAMYYCAKAIVPTGAT MERGQGTQVTVSS |
| 4 | QVQLQESGGGSVQAGGSLRLSCTASGAIASGYIDSRWCMAWFRQAPGKEREGVAAIWPGG GLTVYADSVKGRFTISRDHAKNTLYLQMNNLKPEDTAMYYCAAGSPRMCPSLEFGFDYW GQGTQVTVSSGGGSQVQLQESGGGSVQSGGSLRLSCAASGFTYSTSNSWMAWFRQAPGK EREGVAAIYTVGGSIFYADSVRGRFTISQDATKNMFYLQMNTLKPEDTAMYYCAAASGRL RGKWFWPYEYNYWGQGTQVTVSS |
| 5 | QVQLQESGGGSVQAGGSLRLSCTASGAIASGYIDSRWCMAWFRQAPGKEREGVAAIWPGG GLTVYADSVKGRFTISRDHAKNTLYLQMNNLKPEDTAMYYCAAGSPRMCPSLEFGFDYW GQGTQVTVSSGGGSQVQLQESGGGSVQAGGSLRLSCVASGYVSCDYFLPSWYRQAPGKE REFVSIIDGTGSTSYAASVKGRFTASQDKGKNIAYLQMNTLKPEDTAMYYCKASCVRGRAI SEYWGQGTQVTVSS |
| 6 | QVQLQESGGGSVQAGGSLRLSCTASGAIASGYIDSRWCMAWFRQAPGKEREGVAAIWPGG GLTVYADSVKGRFTISRDHAKNTLYLQMNNLKPEDTAMYYCAAGSPRMCPSLEFGFDYW GQGTQVTVSSGGGSQVQLQESGGGSVQAGGSLRLSCRASGSTYSNYCLGWFRQITGKERE GVAVINWVGGMLYFADSVKGRFTVSQDQAKNTVYLQMNSLKPEDTAMYYCAAESVSSFS CGGWLTRPDRVPYWGQGTQVTVSS |
| 7 | QVQLQESGGGSVQAGGSLRLSCTASGAIASGYIDSRWCMAWFRQAPGKEREGVAAIWPGG GLTVYADSVKGRFTISRDHAKNTLYLQMNNLKPEDTAMYYCAAGSPRMCPSLEFGFDYW GQGTQVTVSSGGGSQVQLQESGGGLVQPGGSLRLSCAASGFTFSLSSMSWVRQAPGKGLE WVSAISSGGASTYYTDSVKGRFTISRDNAKNMLYLQLNSLKTEDTAMYYCAKGGSGYGDA SRMTSPGSQGTQVTVSS |
| 8 | QVQLQESGGGSVQAGGSLRLSCTAPGFTSNSCGMDWYRQAPGKEREFVSSISTDGTTGYA DSVKGRFTISKDKAKDTVYLQMNSLKPEDTGMYSCKTKDGTIATMELCDFGYWGQGTQV TVSSGGGSQVQLQESGGGLVQPGGSLRLSCAASGFTFSSYPMSWVRQAPGKGLEWISTISA GGDTTLYADSVKGRFTSSRDNAKNTLYLQLNSLKTEDAAIYYCAKRIDCNSGYCYRRNYW GQGTQVTVSS |
| 9 | QVQLQESGGGSVQAGGSLRLSCTAPGFTSNSCGMDWYRQAPGKEREFVSSISTDGTTGYA DSVKGRFTISKDKAKDTVYLQMNSLKPEDTGMYSCKTKDGTIATMELCDFGYWGQGTQV TVSSGGGSQVQLQESGGGLVQPGESLRLSCTASGFTFSNYAMSWVRQAPGKGLEWVSGIN VAYGITSYADSVKGRFTISRDNTKNTLYLQLNSLKTEDTAIYYCVKHSGTTIPRGFISYTKRG QGTQVTVSS |
| 10 | QVQLQESGGGSVQAGGSLRLSCTAPGFTSNSCGMDWYRQAPGKEREFVSSISTDGTTGYA DSVKGRFTISKDKAKDTVYLQMNSLKPEDTGMYSCKTKDGTIATMELCDFGYWGQGTQV TVSSGGGSQVQLQESGGGLVQPGGSLRLSCAASGFSFSSYAMKWVRQAPGKGLEWVSTIS SGGSSTNYADSVKGRFTISRDNAKNTLYLQLNSLKIEDTAMYYCAKAIVPTGATMERGQGT QVTVSS |
| 11 | QVQLQESGGGSVQAGGSLRLSCTAPGFTSNSCGMDWYRQAPGKEREFVSSISTDGTTGYA DSVKGRFTISKDKAKDTVYLQMNSLKPEDTGMYSCKTKDGTIATMELCDFGYWGQGTQV TVSSGGGSQVQLQESGGGSVQSGGSLRLSCAASGFTYSTSNSWMAWFRQAPGKEREGVA AIYTVGGSIFYADSVRGRFTISQDATKNMFYLQMNTLKPEDTAMYYCAAASGRLRGKWFW PYEYNYWGQGTQVTVSS |
| 12 | QVQLQESGGGSVQAGGSLRLSCTAPGFTSNSCGMDWYRQAPGKEREFVSSISTDGTTGYA DSVKGRFTISKDKAKDTVYLQMNSLKPEDTGMYSCKTKDGTIATMELCDFGYWGQGTQV TVSSGGGSQVQLQESGGGSVQAGGSLRLSCVASGYVSCDYFLPSWYRQAPGKEREFVSIID GTGSTSYAASVKGRFTASQDKGKNIAYLQMNTLKPEDTAMYYCKASCVRGRAISEYWGQ GTQVTVSS |
| 13 | QVQLQESGGGSVQAGGSLRLSCTAPGFTSNSCGMDWYRQAPGKEREFVSSISTDGTTGYA DSVKGRFTISKDKAKDTVYLQMNSLKPEDTGMYSCKTKDGTIATMELCDFGYWGQGTQV TVSSGGGSQVQLQESGGGSVQAGGSLRLSCRASGSTYSNYCLGWFRQITGKEREGVAVIN WVGGMLYFADSVKGRFTVSQDQAKNTVYLQMNSLKPEDTAMYYCAAESVSSFSCGGWL TRPDRVPYWGQGTQVTVSS |
| 14 | QVQLQESGGGSVQAGGSLRLSCTAPGFTSNSCGMDWYRQAPGKEREFVSSISTDGTTGYA DSVKGRFTISKDKAKDTVYLQMNSLKPEDTGMYSCKTKDGTIATMELCDFGYWGQGTQV TVSSGGGSQVQLQESGGGLVQPGGSLRLSCAASGFTFSLSSMSWVRQAPGKGLEWVSAISS GGASTYYTDSVKGRFTISRDNAKNMLYLQLNSLKTEDTAMYYCAKGGSGYGDASRMTSP GSQGTQVTVSS |

TABLE 2B-continued

| SEQ ID NO | Sequence |
|---|---|
| 15 | QVQLQESGGGSVQAGGSLRLSCAASGYPYSNGYMGWFRQAPGKEREGVATIYTGDGRTY YADSVKGRFTISRDNAKNTVDLQMSSLKPEDTAMYYCAARAAPLYSSGSPLTRARYNVWG QGTQVTVSSGGGSQVQLQESGGGLVQPGGSLRLSCAASGFTFSSYPMSWVRQAPGKGLEW ISTISAGGDTTLYADSVKGRFTSSRDNAKNTLYLQLNSLKTEDAAIYYCAKRIDCNSGYCYR RNYWGQGTQVTVSS |
| 16 | QVQLQESGGGSVQAGGSLRLSCAASGYPYSNGYMGWFRQAPGKEREGVATIYTGDGRTY YADSVKGRFTISRDNAKNTVDLQMSSLKPEDTAMYYCAARAAPLYSSGSPLTRARYNVWG QGTQVTVSSGGGSQVQLQESGGGLVQPGESLRLSCTASGFTFSNYAMSWVRQAPGKGLE WVSGINVAYGITSYADSVKGRFTISRDNTKNTLYLQLNSLKTEDTAIYYCVKHSGTTIPRGFI SYTKRGQGTQVTVSS |
| 17 | QVQLQESGGGSVQAGGSLRLSCAASGYPYSNGYMGWFRQAPGKEREGVATIYTGDGRTY YADSVKGRFTISRDNAKNTVDLQMSSLKPEDTAMYYCAARAAPLYSSGSPLTRARYNVWG QGTQVTVSSGGGSQVQLQESGGGLVQPGGSLRLSCAASGFSFSSYAMKWVRQAPGKGLE WVSTISSGGSSTNYADSVKGRFTISRDNAKNTLYLQLNSLKIEDTAMYYCAKAIVPTGATM ERGQGTQVTVSS |
| 18 | QVQLQESGGGSVQAGGSLRLSCAASGYPYSNGYMGWFRQAPGKEREGVATIYTGDGRTY YADSVKGRFTISRDNAKNTVDLQMSSLKPEDTAMYYCAARAAPLYSSGSPLTRARYNVWG QGTQVTVSSGGGSQVQLQESGGGSVQSGGSLRLSCAASGFTYSTSNSWMAWFRQAPGKE REGVAAIYTVGGSIFYADSVRGRFTISQDATKNMFYLQMNTLKPEDTAMYYCAAASGRLR GKWFWPYEYNYWGQGTQVTVSS |
| 19 | QVQLQESGGGSVQAGGSLRLSCAASGYPYSNGYMGWFRQAPGKEREGVATIYTGDGRTY YADSVKGRFTISRDNAKNTVDLQMSSLKPEDTAMYYCAARAAPLYSSGSPLTRARYNVWG QGTQVTVSSGGGSQVQLQESGGGSVQAGGSLRLSCVASGYVSCDYFLPSWYRQAPGKERE FVSIIDGTGSTSYAASVKGRFTASQDKGKNIAYLQMNTLKPEDTAMYYCKASCVRGRAISE YWGQGTQVTVSS |
| 20 | QVQLQESGGGSVQAGGSLRLSCAASGYPYSNGYMGWFRQAPGKEREGVATIYTGDGRTY YADSVKGRFTISRDNAKNTVDLQMSSLKPEDTAMYYCAARAAPLYSSGSPLTRARYNVWG QGTQVTVSSGGGSQVQLQESGGGSVQAGGSLRLSCRASGSTYSNYCLGWFRQITGKEREG VAVINWVGGMLYFADSVKGRFTVSQDQAKNTVYLQMNSLKPEDTAMYYCAAESVSSFSC GGWLTRPDRVPYWGQGTQVTVSS |
| 21 | QVQLQESGGGSVQAGGSLRLSCAASGYPYSNGYMGWFRQAPGKEREGVATIYTGDGRTY YADSVKGRFTISRDNAKNTVDLQMSSLKPEDTAMYYCAARAAPLYSSGSPLTRARYNVWG QGTQVTVSSGGGSQVQLQESGGGLVQPGGSLRLSCAASGFTFSLSSMSWVRQAPGKGLEW VSAISSGGASTYYTDSVKGRFTISRDNAKNMLYLQLNSLKTEDTAMYYCAKGGSGYGDAS RMTSPGSQGTQVTVSS |
| 22 | QVQLQESGGGSVQAGGSLRLSCVASASTYCTYDMHWYRQAPGKGREFVSAIDSDGTTRYA DSVKGRFTISQGTAKNTVYLQMNSLQPEDTAMYYCKTVCVVGSRWSDYWGQGTQVTVSS GGGSQVQLQESGGGLVQPGGSLRLSCAASGFTFSSYPMSWVRQAPGKGLEWISTISAGGDT TLYADSVKGRFTSSRDNAKNTLYLQLNSLKTEDAAIYYCAKRIDCNSGYCYRRNYWGQGT QVTVSS |
| 23 | QVQLQESGGGSVQAGGSLRLSCVASASTYCTYDMHWYRQAPGKGREFVSAIDSDGTTRYA DSVKGRFTISQGTAKNTVYLQMNSLQPEDTAMYYCKTVCVVGSRWSDYWGQGTQVTVSS GGGSQVQLQESGGGLVQPGESLRLSCTASGFTFSNYAMSWVRQAPGKGLEWVSGINVAY GITSYADSVKGRFTISRDNTKNTLYLQLNSLKTEDTAIYYCVKHSGTTIPRGFISYTKRGQGT QVTVSS |
| 24 | QVQLQESGGGSVQAGGSLRLSCVASASTYCTYDMHWYRQAPGKGREFVSAIDSDGTTRYA DSVKGRFTISQGTAKNTVYLQMNSLQPEDTAMYYCKTVCVVGSRWSDYWGQGTQVTVSS GGGSQVQLQESGGGLVQPGGSLRLSCAASGFSFSSYAMKWVRQAPGKGLEWVSTISSGGS STNYADSVKGRFTISRDNAKNTLYLQLNSLKIEDTAMYYCAKAIVPTGATMERGQGTQVT VSS |
| 25 | QVQLQESGGGSVQAGGSLRLSCVASASTYCTYDMHWYRQAPGKGREFVSAIDSDGTTRYA DSVKGRFTISQGTAKNTVYLQMNSLQPEDTAMYYCKTVCVVGSRWSDYWGQGTQVTVSS GGGSQVQLQESGGGSVQSGGSLRLSCAASGFTYSTSNSWMAWFRQAPGKEREGVAAIYTV GGSIFYADSVRGRFTISQDATKNMFYLQMNTLKPEDTAMYYCAAASGRLRGKWFWPYEY NYWGQGTQVTVSS |
| 26 | QVQLQESGGGSVQAGGSLRLSCVASASTYCTYDMHWYRQAPGKGREFVSAIDSDGTTRYA DSVKGRFTISQGTAKNTVYLQMNSLQPEDTAMYYCKTVCVVGSRWSDYWGQGTQVTVSS GGGSQVQLQESGGGSVQAGGSLRLSCVASGYVSCDYFLPSWYRQAPGKEREFVSIIDGTGS TSYAASVKGRFTASQDKGKNIAYLQMNTLKPEDTAMYYCKASCVRGRAISEYWGQGTQV TVSS |

TABLE 2B-continued

| SEQ ID NO | Sequence |
|---|---|
| 27 | QVQLQESGGGSVQAGGSLRLSCVASASTYCTYDMHWYRQAPGKGREFVSAIDSDGTTRYA<br>DSVKGRFTISQGTAKNTVYLQMNSLQPEDTAMYYCKTVCVVGSRWSDYWGQGTQVTVSS<br>GGGSQVQLQESGGGSVQAGGSLRLSCRASGSTYSNYCLGWFRQITGKEREGVAVINWVGG<br>MLYFADSVKGRFTVSQDQAKNTVYLQMNSLKPEDTAMYYCAAESVSSFSCGGWLTRPDR<br>VPYWGQGTQVTVSS |
| 28 | QVQLQESGGGSVQAGGSLRLSCVASASTYCTYDMHWYRQAPGKGREFVSAIDSDGTTRYA<br>DSVKGRFTISQGTAKNTVYLQMNSLQPEDTAMYYCKTVCVVGSRWSDYWGQGTQVTVSS<br>GGGSQVQLQESGGGLVQPGGSLRLSCAASGFTFSLSSMSWVRQAPGKGLEWVSAISSGGA<br>STYYTDSVKGRFTISRDNAKNMLYLQLNSLKTEDTAMYYCAKGGSGYGDASRMTSPGSQG<br>TQVTVSS |
| 29 | QVQLQESGGGSVQAGGSLTLSCAASEYAYSTCNMGWYRQAPGKERELVSAFISDGSTYYA<br>DSVKGRFTITRDNAKNTVYLQMNSLKPEDTAIYYCSANCYRRLRNYWGQGTQVTVSSGG<br>GSQVQLQESGGGLVQPGGSLRLSCAASGFTFSSYPMSWVRQAPGKGLEWISTISAGGDTTL<br>YADSVKGRFTSSRDNAKNTLYLQLNSLKTEDAAIYYCAKRIDCNSGYCYRRNYWGQGTQV<br>TVSS |
| 30 | QVQLQESGGGSVQAGGSLTLSCAASEYAYSTCNMGWYRQAPGKERELVSAFISDGSTYYA<br>DSVKGRFTITRDNAKNTVYLQMNSLKPEDTAIYYCSANCYRRLRNYWGQGTQVTVSSGG<br>GSQVQLQESGGGLVQPGESLRLSCTASGFTFSNYAMSWVRQAPGKGLEWVSGINVAYGIT<br>SYADSVKGRFTISRDNTKNTLYLQLNSLKTEDTAIYYCVKHSGTTIPRGFISYTKRGQGTQV<br>TVSS |
| 31 | QVQLQESGGGSVQAGGSLTLSCAASEYAYSTCNMGWYRQAPGKERELVSAFISDGSTYYA<br>DSVKGRFTITRDNAKNTVYLQMNSLKPEDTAIYYCSANCYRRLRNYWGQGTQVTVSSGG<br>GSQVQLQESGGGLVQPGGSLRLSCAASGFSFSSYAMKWVRQAPGKGLEWVSTISSGGSSTN<br>YADSVKGRFTISRDNAKNTLYLQLNSLKIEDTAMYYCAKAIVPTGATMERGQGTQVTVSS |
| 32 | QVQLQESGGGSVQAGGSLTLSCAASEYAYSTCNMGWYRQAPGKERELVSAFISDGSTYYA<br>DSVKGRFTITRDNAKNTVYLQMNSLKPEDTAIYYCSANCYRRLRNYWGQGTQVTVSSGG<br>GSQVQLQESGGGSVQSGGSLRLSCAASGFTYSTSNSWMAWFRQAPGKEREGVAAIYTVGG<br>SIFYADSVRGRFTISQDATKNMFYLQMNTLKPEDTAMYYCAAASGRLRGKWFWPYEYNY<br>WGQGTQVTVSS |
| 33 | QVQLQESGGGSVQAGGSLTLSCAASEYAYSTCNMGWYRQAPGKERELVSAFISDGSTYYA<br>DSVKGRFTITRDNAKNTVYLQMNSLKPEDTAIYYCSANCYRRLRNYWGQGTQVTVSSGG<br>GSQVQLQESGGGSVQAGGSLRLSCVASGYVSCDYFLPSWYRQAPGKEREFVSIIDGTGSTS<br>YAASVKGRFTASQDKGKNIAYLQMNTLKPEDTAMYYCKASCVRGRAISEYWGQGTQVTV<br>SS |
| 34 | QVQLQESGGGSVQAGGSLTLSCAASEYAYSTCNMGWYRQAPGKERELVSAFISDGSTYYA<br>DSVKGRFTITRDNAKNTVYLQMNSLKPEDTAIYYCSANCYRRLRNYWGQGTQVTVSSGG<br>GSQVQLQESGGGSVQAGGSLRLSCRASGSTYSNYCLGWFRQITGKEREGVAVINWVGGML<br>YFADSVKGRFTVSQDQAKNTVYLQMNSLKPEDTAMYYCAAESVSSFSCGGWLTRPDRVP<br>YWGQGTQVTVSS |
| 35 | QVQLQESGGGSVQAGGSLTLSCAASEYAYSTCNMGWYRQAPGKERELVSAFISDGSTYYA<br>DSVKGRFTITRDNAKNTVYLQMNSLKPEDTAIYYCSANCYRRLRNYWGQGTQVTVSSGG<br>GSQVQLQESGGGLVQPGGSLRLSCAASGFTFSLSSMSWVRQAPGKGLEWVSAISSGGASTY<br>YTDSVKGRFTISRDNAKNMLYLQLNSLKTEDTAMYYCAKGGSGYGDASRMTSPGSQGTQ<br>VTVSS |
| 36 | QVQLQESGGGLVQPGGSLRLSCTASGLTFDDSVMGWFRQAPGKGREAVSCISSSGANAFY<br>ADSVKGRFTISRDNAKNTLYLQMNSLKPEDTATYYCKRGHACAGYYPIPYDDYWGQGTQ<br>VTVSSGGGSQVQLQESGGGLVQPGGSLRLSCAASGFTFSSYPMSWVRQAPGKGLEWISTIS<br>AGGDTTLYADSVKGRFTSSRDNAKNTLYLQLNSLKTEDAAIYYCAKRIDCNSGYCYRRNY<br>WGQGTQVTVSS |
| 37 | QVQLQESGGGLVQPGGSLRLSCTASGLTFDDSVMGWFRQAPGKGREAVSCISSSGANAFY<br>ADSVKGRFTISRDNAKNTLYLQMNSLKPEDTATYYCKRGHACAGYYPIPYDDYWGQGTQ<br>VTVSSGGGSQVQLQESGGGLVQPGESLRLSCTASGFTFSNYAMSWVRQAPGKGLEWVSGI<br>NVAYGITSYADSVKGRFTISRDNTKNTLYLQLNSLKTEDTAIYYCVKHSGTTIPRGFISYTKR<br>GQGTQVTVSS |
| 38 | QVQLQESGGGLVQPGGSLRLSCTASGLTFDDSVMGWFRQAPGKGREAVSCISSSGANAFY<br>ADSVKGRFTISRDNAKNTLYLQMNSLKPEDTATYYCKRGHACAGYYPIPYDDYWGQGTQ<br>VTVSSGGGSQVQLQESGGGLVQPGGSLRLSCAASGFSFSSYAMKWVRQAPGKGLEWVSTI<br>SSGGSSTNYADSVKGRFTISRDNAKNTLYLQLNSLKIEDTAMYYCAKAIVPTGATMERGQG<br>TQVTVSS |
| 39 | QVQLQESGGGLVQPGGSLRLSCTASGLTFDDSVMGWFRQAPGKGREAVSCISSSGANAFY<br>ADSVKGRFTISRDNAKNTLYLQMNSLKPEDTATYYCKRGHACAGYYPIPYDDYWGQGTQ<br>VTVSSGGGSQVQLQESGGGSVQSGGSLRLSCAASGFTYSTSNSWMAWFRQAPGKEREGV<br>AAIYTVGGSIFYADSVRGRFTISQDATKNMFYLQMNTLKPEDTAMYYCAAASGRLRGKWF<br>WPYEYNYWGQGTQVTVSS |

TABLE 2B-continued

| SEQ ID NO | Sequence |
|---|---|
| 40 | QVQLQESGGGLVQPGGSLRLSCTASGLTFDDSVMGWFRQAPGKGREAVSCISSSGANAFY<br>ADSVKGRFTISRDNAKNTLYLQMNSLKPEDTATYYCKRGHACAGYYPIPYDDYWGQGTQ<br>VTVSSGGGSQVQLQESGGGSVQAGGSLRLSCVASGYVSCDYFLPSWYRQAPGKEREFVSII<br>DGTGSTSYAASVKGRFTASQDKGKNIAYLQMNTLKPEDTAMYYCKASCVRGRAISEYWG<br>QGTQVTVSS |
| 41 | QVQLQESGGGLVQPGGSLRLSCTASGLTFDDSVMGWFRQAPGKGREAVSCISSSGANAFY<br>ADSVKGRFTISRDNAKNTLYLQMNSLKPEDTATYYCKRGHACAGYYPIPYDDYWGQGTQ<br>VTVSSGGGSQVQLQESGGGSVQAGGSLRLSCRASGSTYSNYCLGWFRQITGKEREGVAVI<br>NWVGGMLYFADSVKGRFTVSQDQAKNTVYLQMNSLKPEDTAMYYCAAESVSSFSCGGW<br>LTRPDRVPYWGQGTQVTVSS |
| 42 | QVQLQESGGGLVQPGGSLRLSCTASGLTFDDSVMGWFRQAPGKGREAVSCISSSGANAFY<br>ADSVKGRFTISRDNAKNTLYLQMNSLKPEDTATYYCKRGHACAGYYPIPYDDYWGQGTQ<br>VTVSSGGGSQVQLQESGGGLVQPGGSLRLSCAASGFTFSLSSMSWVRQAPGKGLEWVSAIS<br>SGGASTYYTDSVKGRFTISRDNAKNMLYLQLNSLKTEDTAMYYCAKGGSGYGDASRMTSP<br>GSQGTQVTVSS |

In some embodiments, an IL27R binding protein described herein (e.g., an IL27R binding protein comprising a sequence of any one of SEQ ID NOS: 1-42) is encoded by an isolated nucleic acid that is substantially identical to a sequence of any one of SEQ ID NOS: 109-150, as listed in Table 2C below. In some embodiments, an IL27R binding protein described herein (e.g., an IL27R binding protein comprising a sequence of any one of SEQ ID NOS: 1-42) is encoded by an isolated nucleic acid comprising a sequence having at least 90% (e.g., 91%, 92%, 93%, 94%, 95%, 96%, 97%, 98%, 99%, or 100%) sequence identity to a sequence of any one of SEQ ID NOS: 109-150, as listed in Table 2C below.

TABLE 2C

| SEQ ID NO | Sequence |
|---|---|
| 109 | CAGGTGCAGCTGCAGGAGAGCGGCGGCGGCAGCGTGCAGGCCGGCGGCAGCCTGAGG<br>CTGAGCTGCACCGCCAGCGGCGCCATCGCCAGCGGCTACATCGACAGCAGGTGGTGCA<br>TGGCCTGGTTCAGGCAGGCCCCCGGCAAGGAGAGGGAGGGCGTGGCCGCCATCTGGCC<br>CGGCGGCGGCCTGACCGTGTACGCCGACAGCGTGAAGGGCAGGTTCACCATCAGCAGG<br>GACCACGCCAAGAACACCCTGTACCTGCAGATGAACAACCTGAAGCCCGAGGACACCG<br>CCATGTACTACTGCGCCGCCGGCAGCCCCAGGATGTGCCCCAGCCTGGAGTTCGGCTTC<br>GACTACTGGGGCCAGGGCACCCAGGTGACCGTCTCGAGTGGCGGCGGATCCCAGGTGC<br>AGCTGCAGGAGAGCGGCGGCGGCCTGGTGCAGCCCGGCGGCAGCCTGAGGCTGAGCTG<br>CGCCGCCAGCGGCTTCACCTTCAGCAGCTACCCCATGAGCTGGGTGAGGCAGGCCCCC<br>GGCAAGGGCCTGGAGTGGATCAGCACCATCAGCGCCGGCGGCGACACCACCCTGTACG<br>CCGACAGCGTGAAGGGCAGGTTCACCAGCAGCAGGGACAACGCCAAGAACACCCTGTA<br>CCTGCAGCTGAACAGCCTGAAGACCGAGGACGCCGCCATCTACTACTGCGCCAAGAGG<br>ATCGACTGCAACAGCGGCTACTGCTACAGGAGGAACTACTGGGGCCAGGGCACCCAGG<br>TGACCGTGAGCGCTAGCCACCACCACCACCACCACCAC |
| 110 | CAGGTGCAGCTGCAGGAGAGCGGCGGCGGCAGCGTGCAGGCCGGCGGCAGCCTGAGG<br>CTGAGCTGCACCGCCAGCGGCGCCATCGCCAGCGGCTACATCGACAGCAGGTGGTGCA<br>TGGCCTGGTTCAGGCAGGCCCCCGGCAAGGAGAGGGAGGGCGTGGCCGCCATCTGGCC<br>CGGCGGCGGCCTGACCGTGTACGCCGACAGCGTGAAGGGCAGGTTCACCATCAGCAGG<br>GACCACGCCAAGAACACCCTGTACCTGCAGATGAACAACCTGAAGCCCGAGGACACCG<br>CCATGTACTACTGCGCCGCCGGCAGCCCCAGGATGTGCCCCAGCCTGGAGTTCGGCTTC<br>GACTACTGGGGCCAGGGCACCCAGGTGACCGTCTCGAGTGGCGGCGGATCCCAGGTGC<br>AGCTGCAGGAGAGCGGCGGCGGCCTGGTGCAGCCCGGCGAGAGCCTGAGGCTGAGCTG<br>CACCGCCAGCGGCTTCACCTTCAGCAACTACGCCATGAGCTGGGTGAGGCAGGCCCCC<br>GGCAAGGGCCTGGAGTGGGTGAGCGGCATCAACGTGGCCTACGGCATCACCAGCTACG<br>CCGACAGCGTGAAGGGCAGGTTCACCATCAGCAGGGACAACACCAAGAACACCCTGTA<br>CCTGCAGCTGAACAGCCTGAAGACCGAGGACACCGCCATCTACTACTGCGTGAAGCAC<br>AGCGGCACCACCATCCCCAGGGGCTTCATCAGCTACACCAAGAGGGGCCAGGGCACCC<br>AGGTGACCGTGAGCGCTAGCCACCACCACCACCACCACCAC |
| 111 | CAGGTGCAGCTGCAGGAGAGCGGCGGCGGCAGCGTGCAGGCCGGCGGCAGCCTGAGG<br>CTGAGCTGCACCGCCAGCGGCGCCATCGCCAGCGGCTACATCGACAGCAGGTGGTGCA<br>TGGCCTGGTTCAGGCAGGCCCCCGGCAAGGAGAGGGAGGGCGTGGCCGCCATCTGGCC<br>CGGCGGCGGCCTGACCGTGTACGCCGACAGCGTGAAGGGCAGGTTCACCATCAGCAGG<br>GACCACGCCAAGAACACCCTGTACCTGCAGATGAACAACCTGAAGCCCGAGGACACCG<br>CCATGTACTACTGCGCCGCCGGCAGCCCCAGGATGTGCCCCAGCCTGGAGTTCGGCTTC<br>GACTACTGGGGCCAGGGCACCCAGGTGACCGTCTCGAGTGGCGGCGGATCCCAGGTGC<br>AGCTGCAGGAGAGCGGCGGCGGCCTGGTGCAGCCCGGCGGCAGCCTGAGGCTGAGCTG<br>CGCCGCCAGCGGCTTCAGCTTCAGCAGCTACGCCATGAAGTGGGTGAGGCAGGCCCCC<br>GGCAAGGGCCTGGAGTGGGTGAGCACCATCAGCAGCGGCGGCAGCAGCACCAACTAC |

TABLE 2C-continued

| SEQ ID NO | Sequence |
|---|---|
| | GCCGACAGCGTGAAGGGCAGGTTCACCATCAGCAGGGACAACGCCAAGAACACCCTGT<br>ACCTGCAGCTGAACAGCCTGAAGATCGAGGACACCGCCATGTACTACTGCGCCAAGGC<br>CATCGTGCCCACCGGCGCCACCATGGAGAGGGGCCAGGGCACCCAGGTGACCGTGAGC<br>GCTAGCCACCACCACCACCACCACCAC |
| 112 | CAGGTGCAGCTGCAGGAGAGCGGCGGCGGCAGCGTGCAGGCCGGCGGCAGCCTGAGG<br>CTGAGCTGCACCGCCAGCGGCGCCATCGCCAGCGGCTACATCGACAGCAGGTGGTGCA<br>TGGCCTGGTTCAGGCAGGCCCCCGGCAAGGAGAGGGAGGGCGTGGCCGCCATCTGGCC<br>CGGCGGCGGCCTGACCGTGTACGCCGACAGCGTGAAGGGCAGGTTCACCATCAGCAGG<br>GACCACGCCAAGAACACCCTGTACCTGCAGATGAACAACCTGAAGCCCGAGGACACCG<br>CCATGTACTACTGCGCCGCCGGCAGCCCCAGGATGTGCCCCAGCCTGGAGTTCGGCTTC<br>GACTACTGGGGCCAGGGCACCCAGGTGACCGTCTCGAGTGGCGGCGGATCCCAGGTGC<br>AGCTGCAGGAGAGCGGCGGCGGCAGCGTGCAGAGCGGCGGCAGCCTGAGGCTGAGCT<br>GCGCCGCCAGCGGCTTCACCTACAGCACCAGCAACAGCTGGATGGCCTGGTTCAGGCA<br>GGCCCCCGGCAAGGAGAGGGAGGGCGTGGCCGCCATCTACACCGTGGGCGGCAGCATC<br>TTCTACGCCGACAGCGTGAGGGGCAGGTTCACCATCAGCCAGGACGCCACCAAGAACA<br>TGTTCTACCTGCAGATGAACACCCTGAAGCCCGAGGACACCGCCATGTACTACTGCGCC<br>GCCGCCAGCGGCAGGCTGAGGGGCAAGTGGTTCTGGCCCTACGAGTACAACTACTGGG<br>GCCAGGGCACCCAGGTGACCGTGAGCGCTAGCCACCACCACCACCACCACCAC |
| 113 | CAGGTGCAGCTGCAGGAGAGCGGCGGCGGCAGCGTGCAGGCCGGCGGCAGCCTGAGG<br>CTGAGCTGCACCGCCAGCGGCGCCATCGCCAGCGGCTACATCGACAGCAGGTGGTGCA<br>TGGCCTGGTTCAGGCAGGCCCCCGGCAAGGAGAGGGAGGGCGTGGCCGCCATCTGGCC<br>CGGCGGCGGCCTGACCGTGTACGCCGACAGCGTGAAGGGCAGGTTCACCATCAGCAGG<br>GACCACGCCAAGAACACCCTGTACCTGCAGATGAACAACCTGAAGCCCGAGGACACCG<br>CCATGTACTACTGCGCCGCCGGCAGCCCCAGGATGTGCCCCAGCCTGGAGTTCGGCTTC<br>GACTACTGGGGCCAGGGCACCCAGGTGACCGTCTCGAGTGGCGGCGGATCCCAGGTGC<br>AGCTGCAGGAGAGCGGCGGCGGCAGCGTGCAGGCCGGCGGCAGCCTGAGGCTGAGCT<br>GCGTGGCCAGCGGCTACGTGAGCTGCGACTACTTCCTGCCCAGCTGGTACAGGCAGGC<br>CCCCGGCAAGGAGAGGGAGTTCGTGAGCATCATCGACGGCACCGGCAGCACCAGCTAC<br>GCCGCCAGCGTGAAGGGCAGGTTCACCGCCAGCCAGGACAAGGGCAAGAACATCGCCT<br>ACCTGCAGATGAACACCCTGAAGCCCGAGGACACCGCCATGTACTACTGCAAGGCCAG<br>CTGCGTGAGGGGCAGGGCCATCAGCGAGTACTGGGGCCAGGGCACCCAGGTGACCGTG<br>AGCGCTAGCCACCACCACCACCACCACCAC |
| 114 | CAGGTGCAGCTGCAGGAGAGCGGCGGCGGCAGCGTGCAGGCCGGCGGCAGCCTGAGG<br>CTGAGCTGCACCGCCAGCGGCGCCATCGCCAGCGGCTACATCGACAGCAGGTGGTGCA<br>TGGCCTGGTTCAGGCAGGCCCCCGGCAAGGAGAGGGAGGGCGTGGCCGCCATCTGGCC<br>CGGCGGCGGCCTGACCGTGTACGCCGACAGCGTGAAGGGCAGGTTCACCATCAGCAGG<br>GACCACGCCAAGAACACCCTGTACCTGCAGATGAACAACCTGAAGCCCGAGGACACCG<br>CCATGTACTACTGCGCCGCCGGCAGCCCCAGGATGTGCCCCAGCCTGGAGTTCGGCTTC<br>GACTACTGGGGCCAGGGCACCCAGGTGACCGTCTCGAGTGGCGGCGGATCCCAGGTGC<br>AGCTGCAGGAGAGCGGCGGCGGCAGCGTGCAGGCCGGCGGCAGCCTGAGGCTGAGCT<br>GCAGGGCCAGCGGCAGCACCTACAGCAACTACTGCCTGGGCTGGTTCAGGCAGATCAC<br>CGGCAAGGAGAGGGAGGGCGTGGCCGTGATCAACTGGGTGGGCGGCATGCTGTACTTC<br>GCCGACAGCGTGAAGGGCAGGTTCACCGTGAGCCAGGACCAGGCCAAGAACACCGTGT<br>ACCTGCAGATGAACAGCCTGAAGCCCGAGGACACCGCCATGTACTACTGCGCCGCCGA<br>GAGCGTGAGCAGCTTCAGCTGCGGCGGCTGGCTGACCAGGCCCGACAGGGTGCCCTAC<br>TGGGGCCAGGGCACCCAGGTGACCGTGAGCGCTAGCCACCACCACCACCACCACCAC<br>AC |
| 115 | CAGGTGCAGCTGCAGGAGAGCGGCGGCGGCAGCGTGCAGGCCGGCGGCAGCCTGAGG<br>CTGAGCTGCACCGCCAGCGGCGCCATCGCCAGCGGCTACATCGACAGCAGGTGGTGCA<br>TGGCCTGGTTCAGGCAGGCCCCCGGCAAGGAGAGGGAGGGCGTGGCCGCCATCTGGCC<br>CGGCGGCGGCCTGACCGTGTACGCCGACAGCGTGAAGGGCAGGTTCACCATCAGCAGG<br>GACCACGCCAAGAACACCCTGTACCTGCAGATGAACAACCTGAAGCCCGAGGACACCG<br>CCATGTACTACTGCGCCGCCGGCAGCCCCAGGATGTGCCCCAGCCTGGAGTTCGGCTTC<br>GACTACTGGGGCCAGGGCACCCAGGTGACCGTCTCGAGTGGCGGCGGATCCCAGGTGC<br>AGCTGCAGGAGAGCGGCGGCGGCTGGTGCAGCCCGGCGGCAGCCTGAGGCTGAGCTG<br>CGCCGCCAGCGGCTTCACCTTCAGCCTGAGCAGCATGAGCTGGGTGAGGCAGGCCCCC<br>GGCAAGGGCCTGGAGTGGGTGAGCGCCATCAGCAGCGGCGGCGCCAGCACCTACTACA<br>CCGACAGCGTGAAGGGCAGGTTCACCATCAGCAGGGACAACGCCAAGAACATGCTGTA<br>CCTGCAGCTGAACAGCCTGAAGACCGAGGACACCGCCATGTACTACTGCGCCAAGGCC<br>GGCAGCGGCTACGGCGACGCCAGCAGGATGACCAGCCCCGGCAGCCAGGGCACCCAG<br>GTGACCGTGAGCGCTAGCCACCACCACCACCACCACCAC |
| 116 | CAGGTGCAGCTGCAGGAGAGCGGCGGCGGCAGCGTGCAGGCCGGCGGCAGCCTGAGG<br>CTGAGCTGCACCGCCCCCGGCTTCACCAGCAACAGCTGCGGCATGGACTGGTACAGGC<br>AGGCCCCCGGCAAGGAGAGGGAGTTCGTGAGCAGCATCAGCACCGACGGCACCACCG<br>GCTACGCCGACAGCGTGAAGGGCAGGTTCACCATCAGCAAGGACAAGGCCAAGGACA<br>CCGTGTACCTGCAGATGAACAGCCTGAAGCCCGAAGACACCGGCATGTACTACTGCAA<br>GACCAAGGACGGCACCATCGCCACCATGGAGCTGTGCGACTTCGGCTACTGGGGCCAG<br>GGCACCCAGGTGACCGTCTCGAGTGGCGGCGGATCCCAGGTGCAGCTGCAGGAGAGCG<br>GCGGCGGCCTGGTGCAGCCCGGCGGCAGCCTGAGGCTGAGCTGCGCCGCCAGCGGCTT<br>CACCTTCAGCAGCTACCCCATGAGCTGGGTGAGGCAGGCCCCCGGCAAGGGCCTGGAG<br>TGGATCAGCACCATCAGCGCCGGCGGCGACACCACCCTGTACGCCGACAGCGTGAAGG |

TABLE 2C-continued

| SEQ ID NO | Sequence |
|---|---|
| | GCAGGTTCACCAGCAGCAGGGACAACGCCAAGAACACCCTGTACCTGCAGCTGAACAG<br>CCTGAAGACCGAGGACGCCGCCATCTACTACTGCGCCAAGAGGATCGACTGCAACAGC<br>GGCTACTGCTACAGGAGGAACTACTGGGGCCAGGGCACCCAGGTGACCGTGAGCGCTA<br>GCCACCACCACCACCACCACCAC |
| 117 | CAGGTGCAGCTGCAGGAGAGCGGCGGCGGCAGCGTGCAGGCCGGCGGCAGCCTGAGG<br>CTGAGCTGCACCGCCCCCGGCTTCACCAGCAACAGCTGCGGCATGGACTGGTACAGGC<br>AGGCCCCCGGCAAGGAGAGGGAGTTCGTGAGCAGCATCAGCACCGACGGCACCACCG<br>GCTACGCCGACAGCGTGAAGGGCAGGTTCACCATCAGCAAGGACAAGGCCAAGGACA<br>CCGTGTACCTGCAGATGAACAGCCTGAAGCCCGAGGACACCGGCATGTACAGCTGCAA<br>GACCAAGGACGGCACCATCGCCACCATGGAGCTGTGCGACTTCGGCTACTGGGGCCAG<br>GGCACCCAGGTGACCGTCTCGAGTGGCGGCGGATCCCAGGTGCAGCTGCAGGAGAGCG<br>GCGGCGGCCTGGTGCAGCCCGGCGAGAGCCTGAGGCTGAGCTGCACCGCCAGCGGCTT<br>CACCTTCAGCAACTACGCCATGAGCTGGGTGAGGCAGGCCCCCGGCAAGGGCCTGGAG<br>TGGGTGAGCGGCATCAACGTGGCCTACGGCATCACCAGCTACGCCGACAGCGTGAAGG<br>GCAGGTTCACCATCAGCAGGGACAACACCAAGAACACCCTGTACCTGCAGCTGAACAG<br>CCTGAAGACCGAGGACACCGCCATCTACTACTGCGTGAAGCACAGCGGCACCACCATC<br>CCCAGGGGCTTCATCAGCTACACCAAGAGGGGCCAGGGCACCCAGGTGACCGTGAGCG<br>CTAGCCACCACCACCACCACCACCAC |
| 118 | CAGGTGCAGCTGCAGGAGAGCGGCGGCGGCAGCGTGCAGGCCGGCGGCAGCCTGAGG<br>CTGAGCTGCACCGCCCCCGGCTTCACCAGCAACAGCTGCGGCATGGACTGGTACAGGC<br>AGGCCCCCGGCAAGGAGAGGGAGTTCGTGAGCAGCATCAGCACCGACGGCACCACCG<br>GCTACGCCGACAGCGTGAAGGGCAGGTTCACCATCAGCAAGGACAAGGCCAAGGACA<br>CCGTGTACCTGCAGATGAACAGCCTGAAGCCCGAGGACACCGGCATGTACAGCTGCAA<br>GACCAAGGACGGCACCATCGCCACCATGGAGCTGTGCGACTTCGGCTACTGGGGCCAG<br>GGCACCCAGGTGACCGTCTCGAGTGGCGGCGGATCCCAGGTGCAGCTGCAGGAGAGCG<br>GCGGCGGCCTGGTGCAGCCCGGCGGCAGCCTGAGGCTGAGCTGCGCCGCCAGCGGCTT<br>CAGCTTCAGCAGCTACGCCATGAAGTGGGTGAGGCAGGCCCCCGGCAAGGGCCTGGAG<br>TGGGTGAGCACCATCAGCAGCGGCGGCAGCAGCACCAACTACGCCGACAGCGTGAAGG<br>GCAGGTTCACCATCAGCAGGGACAACGCCAAGAACACCCTGTACCTGCAGCTGAACAG<br>CCTGAAGATCGAGGACACCGCCATGTACTACTGCGCCAAGGCCATCGTGCCCACCGGC<br>GCCACCATGGAGAGGGGCCAGGGCACCCAGGTGACCGTGAGCGCTAGCCACCACCACC<br>ACCACCACCACCAC |
| 119 | CAGGTGCAGCTGCAGGAGAGCGGCGGCGGCAGCGTGCAGGCCGGCGGCAGCCTGAGG<br>CTGAGCTGCACCGCCCCCGGCTTCACCAGCAACAGCTGCGGCATGGACTGGTACAGGC<br>AGGCCCCCGGCAAGGAGAGGGAGTTCGTGAGCAGCATCAGCACCGACGGCACCACCG<br>GCTACGCCGACAGCGTGAAGGGCAGGTTCACCATCAGCAAGGACAAGGCCAAGGACA<br>CCGTGTACCTGCAGATGAACAGCCTGAAGCCCGAGGACACCGGCATGTACAGCTGCAA<br>GACCAAGGACGGCACCATCGCCACCATGGAGCTGTGCGACTTCGGCTACTGGGGCCAG<br>GGCACCCAGGTGACCGTCTCGAGTGGCGGCGGATCCCAGGTGCAGCTGCAGGAGAGCG<br>GCGGCGGCAGCGTGCAGAGCGGCGGCAGCCTGAGGCTGAGCTGCGCCGCCAGCGGCTT<br>CACCTACAGCACCAGCAACAGCTGGATGGCCTGGTTCAGGCAGGCCCCCGGCAAGGAG<br>AGGGAGGGCGTGGCCGCCATCTACACCGTGGGCGGCAGCATCTTCTACGCCGACAGCG<br>TGAGGGGCAGGTTCACCATCAGCCAGGACGCCACCAAGAACATGTTCTACCTGCAGAT<br>GAACACCCTGAAGCCCGAGGACACCGCCATGTACTACTGCGCCGCCGCCAGCGGCAGG<br>CTGAGGGGCAAGTGGTTCTGGCCCTACGAGTACAACTACTGGGGCCAGGGCACCCAGG<br>TGACCGTGAGCGCTAGCCACCACCACCACCACCACCAC |
| 120 | CAGGTGCAGCTGCAGGAGAGCGGCGGCGGCAGCGTGCAGGCCGGCGGCAGCCTGAGG<br>CTGAGCTGCACCGCCCCCGGCTTCACCAGCAACAGCTGCGGCATGGACTGGTACAGGC<br>AGGCCCCCGGCAAGGAGAGGGAGTTCGTGAGCAGCATCAGCACCGACGGCACCACCG<br>GCTACGCCGACAGCGTGAAGGGCAGGTTCACCATCAGCAAGGACAAGGCCAAGGACA<br>CCGTGTACCTGCAGATGAACAGCCTGAAGCCCGAGGACACCGGCATGTACAGCTGCAA<br>GACCAAGGACGGCACCATCGCCACCATGGAGCTGTGCGACTTCGGCTACTGGGGCCAG<br>GGCACCCAGGTGACCGTCTCGAGTGGCGGCGGATCCCAGGTGCAGCTGCAGGAGAGCG<br>GCGGCGGCAGCGTGCAGGCCGGCGGCAGCCTGAGGCTGAGCTGCGTGGCCAGCGGCTA<br>CGTGAGCTGCGACTACTTCCTGCCCAGCTGGTACAGGCAGGCCCCCGGCAAGGAGAGG<br>GAGTTCGTGAGCATCATCGACGGCACCGGCAGCACCAGCTACGCCGCCAGCGTGAAGG<br>GCAGGTTCACCGCCAGCCAGGACAAGGGCAAGAACATCGCCTACCTGCAGATGAACAC<br>CCTGAAGCCCGAGGACACCGCCATGTACTACTGCAAGGCCAGCTGCGTGAGGGGCAGG<br>GCCATCAGCGAGTACTGGGGCCAGGGCACCCAGGTGACCGTGAGCGCTAGCCACCACC<br>ACCACCACCACCAC |
| 121 | CAGGTGCAGCTGCAGGAGAGCGGCGGCGGCAGCGTGCAGGCCGGCGGCAGCCTGAGG<br>CTGAGCTGCACCGCCCCCGGCTTCACCAGCAACAGCTGCGGCATGGACTGGTACAGGC<br>AGGCCCCCGGCAAGGAGAGGGAGTTCGTGAGCAGCATCAGCACCGACGGCACCACCG<br>GCTACGCCGACAGCGTGAAGGGCAGGTTCACCATCAGCAAGGACAAGGCCAAGGACA<br>CCGTGTACCTGCAGATGAACAGCCTGAAGCCCGAGGACACCGGCATGTACAGCTGCAA<br>GACCAAGGACGGCACCATCGCCACCATGGAGCTGTGCGACTTCGGCTACTGGGGCCAG<br>GGCACCCAGGTGACCGTCTCGAGTGGCGGCGGATCCCAGGTGCAGCTGCAGGAGAGCG<br>GCGGCGGCAGCGTGCAGGCCGGCGGCAGCCTGAGGCTGAGCTGCAGGGCCAGCGGCA<br>GCACCTACAGCAACTACGCCTGGGCTGGTTCAGGCAGATCACCGGCAAGGAGAGGGA<br>GGGCGTGGCCGTGATCAACTGGGTGGGCGGCATGCTGTACTTCGCCGACAGCGTGAAG<br>GGCAGGTTCACCGTGAGCCAGGACCAGGCCAAGAACACCGTGTACCTGCAGATGAACA |

TABLE 2C-continued

| SEQ ID NO | Sequence |
|---|---|
|  | GCCTGAAGCCCGAGGACACCGCCATGTACTACTGCGCCGCCGAGAGCGTGAGCAGCTT<br>CAGCTGCGGCGGCTGGCTGACCAGGCCCGACAGGGTGCCCTACTGGGGCCAGGGCACC<br>CAGGTGACCGTGAGCGCTAGCCACCACCACCACCACCACCAC |
| 122 | CAGGTGCAGCTGCAGGAGAGCGGCGGCGGCAGCGTGCAGGCCGGCGGCAGCCTGAGG<br>CTGAGCTGCACCGCCCCCGGCTTCACCAGCAACAGCTGCGGCATGGACTGGTACAGGC<br>AGGCCCCCGGCAAGGAGAGGGAGTTCGTGAGCAGCATCAGCACCGACGGCACCACCG<br>GCTACGCCGACAGCGTGAAGGGCAGGTTCACCATCAGCAAGGACAAGGCCAAGGACA<br>CCGTGTACCTGCAGATGAACAGCCTGAAGCCCGAGGACACCGGCATGTACAGCTGCAA<br>GACCAAGGACGGCACCATCGCCACCATGGAGCTGTGCGACTTCGGCTACTGGGGCCAG<br>GGCACCCAGGTGACCGTCTCGAGTGGCGGCGGATCCCAGGTGCAGCTGCAGGAGAGCG<br>GCGGCGGCCTGGTGCAGCCCGGCGGCAGCCTGAGGCTGAGCTGCGCCGCCAGCGGCTT<br>CACCTTCAGCCTGAGCAGCATGAGCTGGGTGAGGCAGGCCCCCGGCAAGGGCCTGGAA<br>TGGGTGAGCGCCATCAGCAGCGGCGGCGCCAGCACCTACTACACCGACAGCGTGAAGG<br>GCAGGTTCACCATCAGCAGGGACAACGCCAAGAACATGCTGTACCTGCAGCTGAACAG<br>CCTGAAGACCGAGGACACCGCCATGTACTACTGCGCCAAGGGCGGCAGCGGCTACGGC<br>GACGCCAGCAGGATGACCAGCCCCGGCAGCCAGGGCACCCAGGTGACCGTGAGCGCTA<br>GCCACCACCACCACCACCACCAC |
| 123 | CAGGTGCAGCTGCAGGAGAGCGGCGGCGGCAGCGTGCAGGCCGGCGGCAGCCTGAGG<br>CTGAGCTGCGCCGCCAGCGGCTACCCCTACAGCAACGGCTACATGGGCTGGTTCAGGC<br>AGGCCCCCGGCAAGGAGAGGGAGGGCGTGGCCACCATCTACACCGGCGACGGCAGGA<br>CCTACTACGCCGACAGCGTGAAGGGCAGGTTCACCATCAGCAGGGACAACGCCAAGAA<br>CACCGTGGACCTGCAGATGAGCAGCCTGAAGCCCGAGGACACCGCCATGTACTACTGC<br>GCCGCCAGGGCCGCCCCCCTGTACAGCAGCGGCAGCCCCCTGACCAGGGCCAGGTACA<br>ACGTGTGGGGCCAGGGCACCCAGGTGACCGTCTCGAGTGGCGGCGGATCCCAGGTGCA<br>GCTGCAGGAGAGCGGCGGCGGCCTGGTGCAGCCCGGCGGCAGCCTGAGGCTGAGCTGC<br>GCCGCCAGCGGCTTCACCTTCAGCAGCTACCCCATGAGCTGGGTGAGGCAGGCCCCCG<br>GCAAGGGCCTGGAGTGGATCAGCACCATCAGCGCCGGCGGCGACACCCCCTGTACGC<br>CGACAGCGTGAAGGGCAGGTTCACCAGCAGCAGGGACAACGCCAAGAACACCCTGTAC<br>CTGCAGCTGAACAGCCTGAAGACCGAGGACGCCGCCATCTACTACTGCGCCAAGAGGA<br>TCGACTGCAACAGCGGCTACTGCTACAGGAGGAACTACTGGGGCCAGGGCACCCAGGT<br>GACCGTGAGCGCTAGCCACCACCACCACCACCACCAC |
| 124 | CAGGTGCAGCTGCAGGAGAGCGGCGGCGGCAGCGTGCAGGCCGGCGGCAGCCTGAGG<br>CTGAGCTGCGCCGCCAGCGGCTACCCCTACAGCAACGGCTACATGGGCTGGTTCAGGC<br>AGGCCCCCGGCAAGGAGAGGGAGGGCGTGGCCACCATCTACACCGGCGACGGCAGGA<br>CCTACTACGCCGACAGCGTGAAGGGCAGGTTCACCATCAGCAGGGACAACGCCAAGAA<br>CACCGTGGACCTGCAGATGAGCAGCCTGAAGCCCGAGGACACCGCCATGTACTACTGC<br>GCCGCCAGGGCCGCCCCCCTGTACAGCAGCGGCAGCCCCCTGACCAGGGCCAGGTACA<br>ACGTGTGGGGCCAGGGCACCCAGGTGACCGTCTCGAGTGGCGGCGGATCCCAGGTGCA<br>GCTGCAGGAGAGCGGCGGCGGCCTGGTGCAGCCCGGCGAGAGCCTGAGGCTGAGCTGC<br>ACCGCCAGCGGCTTCACCTTCAGCAACTACGCCATGAGCTGGGTGAGGCAGGCCCCCG<br>GCAAGGGCCTGGAGTGGGTGAGCGGCATCAACGTGGCCTACGGCATCACCAGCTACGC<br>CGACAGCGTGAAGGGCAGGTTCACCATCAGCAGGGACAACACCAAGAACACCCTGTAC<br>CTGCAGCTGAACAGCCTGAAGACCGAGGACACCGCCATCTACTACTGCGTGAAGCACA<br>GCGGCACCACCATCCCCAGGGGCTTCATCAGCTACACCAAGAGGGGCCAGGGCACCCA<br>GGTGACCGTGAGCGCTAGCCACCACCACCACCACCACCAC |
| 125 | CAGGTGCAGCTGCAGGAGAGCGGCGGCGGCAGCGTGCAGGCCGGCGGCAGCCTGAGG<br>CTGAGCTGCGCCGCCAGCGGCTACCCCTACAGCAACGGCTACATGGGCTGGTTCAGGC<br>AGGCCCCCGGCAAGGAGAGGGAGGGCGTGGCCACCATCTACACCGGCGACGGCAGGA<br>CCTACTACGCCGACAGCGTGAAGGGCAGGTTCACCATCAGCAGGGACAACGCCAAGAA<br>CACCGTGGACCTGCAGATGAGCAGCCTGAAGCCCGAGGACACCGCCATGTACTACTGC<br>GCCGCCAGGGCCGCCCCCCTGTACAGCAGCGGCAGCCCCCTGACCAGGGCCAGGTACA<br>ACGTGTGGGGCCAGGGCACCCAGGTGACCGTCTCGAGTGGCGGCGGATCCCAGGTGCA<br>GCTGCAGGAGAGCGGCGGCGGCCTGGTGCAGCCCGGCGGCAGCCTGAGGCTGAGCTGC<br>GCCGCCAGCGGCTTCAGCTTCAGCAGCTACGCCATGAAGTGGGTGAGGCAGGCCCCCG<br>GCAAGGGCCTGGAGTGGGTGAGCACCATCAGCAGCGGCGGCAGCAGCACCAACTACGC<br>CGACAGCGTGAAGGGCAGGTTCACCATCAGCAGGGACAACGCCAAGAACACCCTGTAC<br>CTGCAGCTGAACAGCCTGAAGATCGAGGACACCGCCATGTACTACTGCGCCAAGGCCA<br>TCGTGCCCACCGGCGCCACCATGGAGAGGGGCCAGGGCACCCAGGTGACCGTGAGCGC<br>TAGCCACCACCACCACCACCACCAC |
| 126 | CAGGTGCAGCTGCAGGAGAGCGGCGGCGGCAGCGTGCAGGCCGGCGGCAGCCTGAGG<br>CTGAGCTGCGCCGCCAGCGGCTACCCCTACAGCAACGGCTACATGGGCTGGTTCAGGC<br>AGGCCCCCGGCAAGGAGAGGGAGGGCGTGGCCACCATCTACACCGGCGACGGCAGGA<br>CCTACTACGCCGACAGCGTGAAGGGCAGGTTCACCATCAGCAGGGACAACGCCAAGAA<br>CACCGTGGACCTGCAGATGAGCAGCCTGAAGCCCGAGGACACCGCCATGTACTACTGC<br>GCCGCCAGGGCCGCCCCCCTGTACAGCAGCGGCAGCCCCCTGACCAGGGCCAGGTACA<br>ACGTGTGGGGCCAGGGCACCCAGGTGACCGTCTCGAGTGGCGGCGGATCCCAGGTGCA<br>GCTGCAGGAGAGCGGCGGCGGCAGCGTGCAGAGCGGCGGCAGCCTGAGGCTGAGCTG<br>CGCCGCCAGCGGCTTCACCTACAGCACCAGCAACAGCTGGATGGCCTGGTTCAGGCAG<br>GCCCCCGGCAAGGAGAGGGAGGGCGTGGCCGCCATCTACACCGTGGGCGGCAGCATCT<br>TCTACGCCGACAGCGTGAGGGGCAGGTTCACCATCAGCCAGGACGCCACCAAGAACAT<br>GTTCTACCTGCAGATGAACACCCTGAAGCCCGAGGACACCGCCATGTACTACTGCGCCG |

TABLE 2C-continued

| SEQ ID NO | Sequence |
|---|---|
|  | CCGCCAGCGGCAGGCTGAGGGGCAAGTGGTTCTGGCCCTACGAGTACAACTACTGGGG<br>CCAGGGCACCCAGGTGACCGTGAGCGCTAGCCACCACCACCACCACCACCAC |
| 127 | CAGGTGCAGCTGCAGGAGAGCGGCGGCGGCAGCGTGCAGGCCGGCGGCAGCCTGAGG<br>CTGAGCTGCGCCGCCAGCGGCTACCCCTACAGCAACGGCTACATGGGCTGGTTCAGGC<br>AGGCCCCCGGCAAGGAGAGGGAGGGCGTGGCCACCATCTACACCGGCGACGGCAGGA<br>CCTACTACGCCGACAGCGTGAAGGGCAGGTTCACCATCAGCAGGGACAACGCCAAGAA<br>CACCGTGGACCTGCAGATGAGCAGCCTGAAGCCCGAGGACACCGCCATGTACTACTGC<br>GCCGCCAGGGCCGCCCCCCTGTACAGCAGCGGCAGCCCCCTGACCAGGGCCAGGTACA<br>ACGTGTGGGGCCAGGGCACCCAGGTGACCGTCTCGAGTGGCGGCGGATCCCAGGTGCA<br>GCTGCAGGAGAGCGGCGGCGGCAGCGTGCAGGCCGGCGGCAGCCTGAGGCTGAGCTG<br>CGTGGCCAGCGGCTACGTGAGCTGCGACTACTTCCTGCCCAGCTGGTACAGGCAGGCCC<br>CCGGCAAGGAGAGGGAGTTCGTGAGCATCATCGACGGCACCGGCAGCAGCGCTACGC<br>CGCCAGCGTGAAGGGCAGGTTCACCGCCAGCCAGGACAAGGGCAAGAACATCGCCTAC<br>CTGCAGATGAACACCCTGAAGCCCGAGGACACCGCCATGTACTACTGCAAGGCCAGCT<br>GCGTGAGGGGCAGGGCCATCAGCGAGTACTGGGGCCAGGGCACCCAGGTGACCGTGA<br>GCGCTAGCCACCACCACCACCACCACCAC |
| 128 | CAGGTGCAGCTGCAGGAGAGCGGCGGCGGCAGCGTGCAGGCCGGCGGCAGCCTGAGG<br>CTGAGCTGCGCCGCCAGCGGCTACCCCTACAGCAACGGCTACATGGGCTGGTTCAGGC<br>AGGCCCCCGGCAAGGAGAGGGAGGGCGTGGCCACCATCTACACCGGCGACGGCAGGA<br>CCTACTACGCCGACAGCGTGAAGGGCAGGTTCACCATCAGCAGGGACAACGCCAAGAA<br>CACCGTGGACCTGCAGATGAGCAGCCTGAAGCCCGAGGACACCGCCATGTACTACTGC<br>GCCGCCAGGGCCGCCCCCCTGTACAGCAGCGGCAGCCCCCTGACCAGGGCCAGGTACA<br>ACGTGTGGGGCCAGGGCACCCAGGTGACCGTCTCGAGTGGCGGCGGATCCCAGGTGCA<br>GCTGCAGGAGAGCGGCGGCGGCAGCGTGCAGGCCGGCGGCAGCCTGAGGCTGAGCTG<br>CAGGGCCAGCGGCAGCACCTACAGCAACTACTGCCTGGGCTGGTTCAGGCAGATCACC<br>GGCAAGGAGAGGGAGGGCGTGGCCGTGATCAACTGGGTGGGCGGCATGCTGTACTTCG<br>CCGACAGCGTGAAGGGCAGGTTCACCGTGAGCCAGGACCAGGCCAAGAACACCGTGTA<br>CCTGCAGATGAACAGCCTGAAGCCCGAGGACACCGCCATGTACTACTGCGCCGCCGAG<br>AGCGTGAGCAGCTTCAGCTGCGGCGGCTGCTGACCAGGCCCGACAGGGTGCCCTACT<br>GGGGCCAGGGCACCCAGGTGACCGTGAGCGCTAGCCACCACCACCACCACCACCACCA<br>C |
| 129 | CAGGTGCAGCTGCAGGAGAGCGGCGGCGGCAGCGTGCAGGCCGGCGGCAGCCTGAGG<br>CTGAGCTGCGCCGCCAGCGGCTACCCCTACAGCAACGGCTACATGGGCTGGTTCAGGC<br>AGGCCCCCGGCAAGGAGAGGGAGGGCGTGGCCACCATCTACACCGGCGACGGCAGGA<br>CCTACTACGCCGACAGCGTGAAGGGCAGGTTCACCATCAGCAGGGACAACGCCAAGAA<br>CACCGTGGACCTGCAGATGAGCAGCCTGAAGCCCGAGGACACCGCCATGTACTACTGC<br>GCCGCCAGGGCCGCCCCCCTGTACAGCAGCGGCAGCCCCCTGACCAGGGCCAGGTACA<br>ACGTGTGGGGCCAGGGCACCCAGGTGACCGTCTCGAGTGGCGGCGGATCCCAGGTGCA<br>GCTGCAGGAGAGCGGCGGCGGCCTGGTGCAGCCCGGCGGCAGCCTGAGGCTGAGCTG<br>GCCGCCAGCGGCTTCACCTTCAGCCTGAGCAGCATGAGCTGGGTGAGGCAGGCCCCCG<br>GCAAGGGCCTGGAGTGGGTGAGCGCCATCAGCAGCGGCGGCGCCAGCACCTACTACAC<br>CGACAGCGTGAAGGGCAGGTTCACCATCAGCAGGGACAACGCCAAGAACATGCTGTAC<br>CTGCAGCTGAACAGCCTGAAGACCGAGGACACCGCCATGTACTACTGCGCCAAGGGCG<br>GCAGCGGCTACGGCGACGCCAGCAGGATGACCAGCCCCGGCAGCCAGGGCACCCAGGT<br>GACCGTGAGCGCTAGCCACCACCACCACCACCACCAC |
| 130 | CAGGTGCAGCTGCAGGAGAGCGGCGGCGGCAGCGTGCAGGCCGGCGGCAGCCTGAGG<br>CTGAGCTGCGTGGCCAGCGCCAGCACCTACTGCACCTACGACATGCACTGGTACAGGC<br>AGGCCCCCGGCAAGGGCAGGGAGTTCGTGAGCGCCATCGACAGCGACGGCACCACCAG<br>GTACGCCGACAGCGTGAAGGGCAGGTTCACCATCAGCCAGGGCACCGCCAAGAACACC<br>GTGTACCTGCAGATGAACAGCCTGCAGCCCGAGGACACCGCCATGTACTACTGCAAGA<br>CCGTGTGCGTGGTGGGCAGCAGGTGGAGCGACTACTGGGGCCAGGGCACCCAGGTGAC<br>CGTCTCGAGTGGCGGCGGATCCCAGGTGCAGCTGCAGGAGAGCGGCGGCGGCCTGGTG<br>CAGCCCGGCGGCAGCCTGAGGCTGAGCTGCGCCGCCAGCGGCTTCACCTTCAGCAGCT<br>ACCCCATGAGCTGGGTGAGGCAGGCCCCCGGCAAGGGCCTGGAGTGGATCAGCACCAT<br>CAGCGCCGGCGGCGACACCACCCTGTACGCCGACAGCGTGAAGGGCAGGTTCACCAGC<br>AGCAGGGACAACGCCAAGAACACCCTGTACCTGCAGCTGAACAGCCTGAAGACCGAGG<br>ACGCCGCCATCTACTACTGCGCCAAGAGGATCGACTGCAACAGCGGCTACTGCTACAG<br>GAGGAACTACTGGGGCCAGGGCACCCAGGTGACCGTGAGCGCTAGCCACCACCACCAC<br>CACCACCACCAC |
| 131 | CAGGTGCAGCTGCAGGAGAGCGGCGGCGGCAGCGTGCAGGCCGGCGGCAGCCTGAGG<br>CTGAGCTGCGTGGCCAGCGCCAGCACCTACTGCACCTACGACATGCACTGGTACAGGC<br>AGGCCCCCGGCAAGGGCAGGGAGTTCGTGAGCGCCATCGACAGCGACGGCACCACCAG<br>GTACGCCGACAGCGTGAAGGGCAGGTTCACCATCAGCCAGGGCACCGCCAAGAACACC<br>GTGTACCTGCAGATGAACAGCCTGCAGCCCGAGGACACCGCCATGTACTACTGCAAGA<br>CCGTGTGCGTGGTGGGCAGCAGGTGGAGCGACTACTGGGGCCAGGGCACCCAGGTGAC<br>CGTCTCGAGTGGCGGCGGATCCCAGGTGCAGCTGCAGGAGAGCGGCGGCGGCCTGGTG<br>CAGCCCGGCGAGAGCCTGAGGCTGAGCTGCACCGCCAGCGGCTTCACCTTCAGCAACT<br>ACGCCATGAGCTGGGTGAGGCAGGCCCCCGGCAAGGGCCTGGAGTGGGTGAGCGGCAT<br>CAACGTGGCCTACGGCATCACCAGCTACGCCGACAGCGTGAAGGGCAGGTTCACCATC<br>AGCAGGGACAACGCCAAGAACACCCTGTACCTGCAGCTGAACAGCCTGAAGACCGAGG<br>ACACCGCCATCTACTACTGCGTGAAGCACAGCGGCACCACCATCCCCAGGGGCTTCATC |

TABLE 2C-continued

| SEQ ID NO | Sequence |
|---|---|
| | AGCTACACCAAGAGGGGCCAGGGCACCCAGGTGACCGTGAGCGCTAGCCACCACCACC<br>ACCACCACCACCAC |
| 132 | CAGGTGCAGCTGCAGGAGAGCGGCGGCGGCAGCGTGCAGGCCGGCGGCAGCCTGAGG<br>CTGAGCTGCGTGGCCAGCGCCAGCACCTACTGCACCTACGACATGCACTGGTACAGGC<br>AGGCCCCCGGCAAGGGCAGGGAGTTCGTGAGCGCCATCGACAGCGACGGCACCACCAG<br>GTACGCCGACAGCGTGAAGGGCAGGTTCACCATCAGCCAGGGCACCGCCAAGAACACC<br>GTGTACCTGCAGATGAACAGCCTGCAGCCCGAGGACACCGCCATGTACTACTGCAAGA<br>CCGTGTGCGTGGTGGGCAGCAGGTGGAGCGACTACTGGGGCCAGGGCACCCAGGTGAC<br>CGTCTCGAGTGGCGGCGGATCCCAGGTGCAGCTGCAGGAGAGCGGCGGCGGCCTGGTG<br>CAGCCCGGCGGCAGCCTGAGGCTGAGCTGCGCCGCCAGCGGCTTCAGCTTCAGCAGCT<br>ACGCCATGAAGTGGGTGAGGCAGGCCCCCGGCAAGGGCCTGGAGTGGGTGAGCACCAT<br>CAGCAGCGGCGGCAGCAGCACCAACTACGCCGACAGCGTGAAGGGCAGGTTCACCATC<br>AGCAGGGACAACGCCAAGAACACCCTGTACCTGCAGCTGAACAGCCTGAAGATCGAGG<br>ACACCGCCATGTACTACTGCGCCAAGGCCATCGTGCCCACCGGCGCCACCATGGAGAG<br>GGGCCAGGGCACCCAGGTGACCGTGAGCGCTAGCCACCACCACCACCACCACCACCAC |
| 133 | CAGGTGCAGCTGCAGGAGAGCGGCGGCGGCAGCGTGCAGGCCGGCGGCAGCCTGAGG<br>CTGAGCTGCGTGGCCAGCGCCAGCACCTACTGCACCTACGACATGCACTGGTACAGGC<br>AGGCCCCCGGCAAGGGCAGGGAGTTCGTGAGCGCCATCGACAGCGACGGCACCACCAG<br>GTACGCCGACAGCGTGAAGGGCAGGTTCACCATCAGCCAGGGCACCGCCAAGAACACC<br>GTGTACCTGCAGATGAACAGCCTGCAGCCCGAGGACACCGCCATGTACTACTGCAAGA<br>CCGTGTGCGTGGTGGGCAGCAGGTGGAGCGACTACTGGGGCCAGGGCACCCAGGTGAC<br>CGTCTCGAGTGGCGGCGGATCCCAGGTGCAGCTGCAGGAGAGCGGCGGCGGCAGCGTG<br>CAGAGCGGCGGCAGCCTGAGGCTGAGCTGCGCCGCCAGCGGCTTCACCTACAGCACCA<br>GCAACAGCTGGATGGCCTGGTTCAGGCAGGCCCCCGGCAAGGAGAGGGAGGGCGTGG<br>CCGCCATCTACACCGTGGGCGGCAGCATCTTCTACGCCGACAGCGTGAGGGGCAGGTT<br>CACCATCAGCCAGGACGCCACCAAGAACATGTTCTACCTGCAGATGAACACCCTGAAG<br>CCCGAGGACACCGCCATGTACTACTGCGCCGCCGCCAGCGGCAGGCTGAGGGGCAAGT<br>GGTTCTGGCCCTACGAGTACAACTACTGGGGCCAGGGCACCCAGGTGACCGTGAGCGC<br>TAGCCACCACCACCACCACCACCAC |
| 134 | CAGGTGCAGCTGCAGGAGAGCGGCGGCGGCAGCGTGCAGGCCGGCGGCAGCCTGAGG<br>CTGAGCTGCGTGGCCAGCGCCAGCACCTACTGCACCTACGACATGCACTGGTACAGGC<br>AGGCCCCCGGCAAGGGCAGGGAGTTCGTGAGCGCCATCGACAGCGACGGCACCACCAG<br>GTACGCCGACAGCGTGAAGGGCAGGTTCACCATCAGCCAGGGCACCGCCAAGAACACC<br>GTGTACCTGCAGATGAACAGCCTGCAGCCCGAGGACACCGCCATGTACTACTGCAAGA<br>CCGTGTGCGTGGTGGGCAGCAGGTGGAGCGACTACTGGGGCCAGGGCACCCAGGTGAC<br>CGTCTCGAGTGGCGGCGGATCCCAGGTGCAGCTGCAGGAGAGCGGCGGCGGCAGCGTG<br>CAGGCCGGCGGCAGCCTGAGGCTGAGCTGCGTGGCCAGCGGCTACGTGAGCTGCGACT<br>ACTTCCTGCCCAGCTGGTACAGGCAGGCCCCCGGCAAGGAGAGGGAGTTCGTGAGCAT<br>CATCGACGGCACCGGCAGCACCAGCTACGCCGCCAGCGTGAAGGGCAGGTTCACCGTG<br>AGCCAGGACAAGGGCAAGAACATCGCCTACTGCAGATGAACACCCTGAAGCCCGAGG<br>ACACCGCCATGTACTACTGCAAGGCCAGCTGCGTGAGGGGCAGGGCCATCAGCGAGTA<br>CTGGGGCCAGGGCACCCAGGTGACCGTGAGCGCTAGCCACCACCACCACCACCACCAC<br>CAC |
| 135 | CAGGTGCAGCTGCAGGAGAGCGGCGGCGGCAGCGTGCAGGCCGGCGGCAGCCTGAGG<br>CTGAGCTGCGTGGCCAGCGCCAGCACCTACTGCACCTACGACATGCACTGGTACAGGC<br>AGGCCCCCGGCAAGGGCAGGGAGTTCGTGAGCGCCATCGACAGCGACGGCACCACCAG<br>GTACGCCGACAGCGTGAAGGGCAGGTTCACCATCAGCCAGGGCACCGCCAAGAACACC<br>GTGTACCTGCAGATGAACAGCCTGCAGCCCGAGGACACCGCCATGTACTACTGCAAGA<br>CCGTGTGCGTGGTGGGCAGCAGGTGGAGCGACTACTGGGGCCAGGGCACCCAGGTGAC<br>CGTCTCGAGTGGCGGCGGATCCCAGGTGCAGCTGCAGGAGAGCGGCGGCGGCAGCGTG<br>CAGGCCGGCGGCAGCCTGAGGCTGAGCTGCAGGGCCAGCGCAGCACCTACAGCAACT<br>ACTGCCTGGGCTGGTTCAGGCAGATCACCGGCAAGGAGAGGGAGGGCGTGGCCGTGAT<br>CAACTGGGTGGGCGGCATGCTGTACTTCGCCGACAGCGTGAAGGGCAGGTTCACCGTG<br>AGCCAGGACCAGGCCAAGAACACCGTGTACCTGCAGATGAACAGCCTGAAGCCCGAGG<br>ACACCGCCATGTACTACTGCGCCGCCGAGAGCGTGAGCAGCTTCAGCTGCGGCGGCTG<br>GCTGACCAGGCCCGACAGGGTGCCCTACTGGGGCCAGGGCACCCAGGTGACCGTGAGC<br>GCTAGCCACCACCACCACCACCACCAC |
| 136 | CAGGTGCAGCTGCAGGAGAGCGGCGGCGGCAGCGTGCAGGCCGGCGGCAGCCTGAGG<br>CTGAGCTGCGTGGCCAGCGCCAGCACCTACTGCACCTACGACATGCACTGGTACAGGC<br>AGGCCCCCGGCAAGGGCAGGGAGTTCGTGAGCGCCATCGACAGCGACGGCACCACCAG<br>GTACGCCGACAGCGTGAAGGGCAGGTTCACCATCAGCCAGGGCACCGCCAAGAACACC<br>GTGTACCTGCAGATGAACAGCCTGCAGCCCGAGGACACCGCCATGTACTACTGCAAGA<br>CCGTGTGCGTGGTGGGCAGCAGGTGGAGCGACTACTGGGGCCAGGGCACCCAGGTGAC<br>CGTCTCGAGTGGCGGCGGATCCCAGGTGCAGCTGCAGGAGAGCGGCGGCGGCCTGGTG<br>CAGCCCGGCGGCAGCCTGAGGCTGAGCTGCGCCGCCAGCGGCTTCACCTTCAGCCTGA<br>GCAGCATGAGCTGGGTGAGGCAGGCCCCCGGCAAGGGCCTGGAGTGGGTGAGCGCCAT<br>CAGCAGCGGCGGCGCCAGCACCTACTACACCGACAGCGTGAAGGGCAGGTTCACCATC<br>AGCAGGGACAACGCCAAGAACATGCTGTACCTGCAGCTGAACAGCCTGAAGACCGAGG<br>ACACCGCCATGTACTACTGCGCCAAGGGCGGCAGCGGCTACGGCGACGCCAGCAGGAT<br>GACCAGCCCCGGCAGCCAGGGCACCCAGGTGACCGTGAGCGCTAGCCACCACCACCAC<br>CACCACCACCAC |

TABLE 2C-continued

| SEQ ID NO | Sequence |
|---|---|
| 137 | CAGGTGCAGCTGCAGGAGAGCGGCGGCGGCAGCGTGCAGGCCGGCGGCAGCCTGACC<br>CTGAGCTGCGCCGCCAGCGAGTACGCCTACAGCACCTGCAACATGGGCTGGTACAGGC<br>AGGCCCCCGGCAAGGAGAGGGAGCTGGTGAGCGCCTTCATCAGCGACGGCAGCACCTA<br>CTACGCCGACAGCGTGAAGGGCAGGTTCACCATCACCAGGGACAACGCCAAGAACACC<br>GTGTACCTGCAGATGAACAGCCTGAAGCCCGAGGACACCGCCATCTACTACTGCAGCG<br>CCAACTGCTACAGGAGGCTGAGGAACTACTGGGGCCAGGGCACCCAGGTGACCGTCTC<br>GAGTGGCGGCGGATCCCAGGTGCAGCTGCAGGAGAGCGGCGGCGGCCTGGTGCAGCCC<br>GGCGGCAGCCTGAGGCTGAGCTGCGCCGCCAGCGGCTTCACCTTCAGCAGCTACCCCAT<br>GAGCTGGGTGAGGCAGGCCCCCGGCAAGGGCCTGGAGTGGATCAGCACCATCAGCGCC<br>GGCGGCGACACCACCCTGTACGCCGACAGCGTGAAGGGCAGGTTCACCAGCAGCAGGG<br>ACAACGCCAAGAACACCCTGTACCTGCAGCTGAACAGCCTGAAGACCGAGGACGCCGC<br>CATCTACTACTGCGCCAAGAGGATCGACTGCAACAGCGGCTACTGCTACAGGAGGAAC<br>TACTGGGGCCAGGGCACCCAGGTGACCGTGAGCGCTAGCCACCACCACCACCACCAC<br>ACCAC |
| 138 | CAGGTGCAGCTGCAGGAGAGCGGCGGCGGCAGCGTGCAGGCCGGCGGCAGCCTGACC<br>CTGAGCTGCGCCGCCAGCGAGTACGCCTACAGCACCTGCAACATGGGCTGGTACAGGC<br>AGGCCCCCGGCAAGGAGAGGGAGCTGGTGAGCGCCTTCATCAGCGACGGCAGCACCTA<br>CTACGCCGACAGCGTGAAGGGCAGGTTCACCATCACCAGGGACAACGCCAAGAACACC<br>GTGTACCTGCAGATGAACAGCCTGAAGCCCGAGGACACCGCCATCTACTACTGCAGCG<br>CCAACTGCTACAGGAGGCTGAGGAACTACTGGGGCCAGGGCACCCAGGTGACCGTCTC<br>GAGTGGCGGCGGATCCCAGGTGCAGCTGCAGGAGAGCGGCGGCGGCCTGGTGCAGCCC<br>GGCGAGAGCCTGAGGCTGAGCTGCACCGCCAGCGGCTTCACCTTCAGCAACTACGCCA<br>TGAGCTGGGTGAGGCAGGCCCCCGGCAAGGGCCTGGAGTGGGTGAGCGGCATCAACGT<br>GGCCTACGGCATCACCAGCTACGCCGACAGCGTGAAGGGCAGGTTCACCATCAGCAGG<br>GACAACACCAAGAACACCCTGTACCTGCAGCTGAACAGCCTGAAGACCGAGGACACCG<br>CCATCTACTACTGCGTGAAGCACAGCGGCACCACCATCCCCAGGGGCTTCATCAGCTAC<br>ACCAAGAGGGGCCAGGGCACCCAGGTGACCGTGAGCGCTAGCCACCACCACCACCACC<br>ACCACCAC |
| 139 | CAGGTGCAGCTGCAGGAGAGCGGCGGCGGCAGCGTGCAGGCCGGCGGCAGCCTGACC<br>CTGAGCTGCGCCGCCAGCGAGTACGCCTACAGCACCTGCAACATGGGCTGGTACAGGC<br>AGGCCCCCGGCAAGGAGAGGGAGCTGGTGAGCGCCTTCATCAGCGACGGCAGCACCTA<br>CTACGCCGACAGCGTGAAGGGCAGGTTCACCATCACCAGGGACAACGCCAAGAACACC<br>GTGTACCTGCAGATGAACAGCCTGAAGCCCGAGGACACCGCCATCTACTACTGCAGCG<br>CCAACTGCTACAGGAGGCTGAGGAACTACTGGGGCCAGGGCACCCAGGTGACCGTCTC<br>GAGTGGCGGCGGATCCCAGGTGCAGCTGCAGGAGAGCGGCGGCGGCCTGGTGCAGCCC<br>GGCGGCAGCCTGAGGCTGAGCTGCGCCGCCAGCGGCTTCAGCTTCAGCAGCTACGCCA<br>TGAAGTGGGTGAGGCAGGCCCCCGGCAAGGGCCTGGAGTGGGTGAGCACCATCAGCAG<br>CGGCGGCAGCAGCACCAACTACGCCGACAGCGTGAAGGGCAGGTTCACCATCAGCAGG<br>GACAACGCCAAGAACACCCTGTACCTGCAGCTGAACAGCCTGAAGATCGAGGACACCG<br>CCATGTACTACTGCGCCAAGGCCATCGTGCCCACCGGCGCCACCATGGAGAGGGGCCA<br>GGGCACCCAGGTGACCGTGAGCGCTAGCCACCACCACCACCACCACCAC |
| 140 | CAGGTGCAGCTGCAGGAGAGCGGCGGCGGCAGCGTGCAGGCCGGCGGCAGCCTGACC<br>CTGAGCTGCGCCGCCAGCGAGTACGCCTACAGCACCTGCAACATGGGCTGGTACAGGC<br>AGGCCCCCGGCAAGGAGAGGGAGCTGGTGAGCGCCTTCATCAGCGACGGCAGCACCTA<br>CTACGCCGACAGCGTGAAGGGCAGGTTCACCATCACCAGGGACAACGCCAAGAACACC<br>GTGTACCTGCAGATGAACAGCCTGAAGCCCGAGGACACCGCCATCTACTACTGCAGCG<br>CCAACTGCTACAGGAGGCTGAGGAACTACTGGGGCCAGGGCACCCAGGTGACCGTCTC<br>GAGTGGCGGCGGATCCCAGGTGCAGCTGCAGGAGAGCGGCGGCGGCAGCGTGCAGAG<br>CGGCGGCAGCCTGAGGCTGAGCTGCGCCGCCAGCGGCTTCACCTACAGCACCAGCAAC<br>AGCTGGATGGCCTGGTTCAGGCAGGCCCCCGGCAAGGAGAGGGAGGGCGTGGCCGCCA<br>TCTACACCGTGGGCGGCAGCATCTTCTACGCCGACAGCGTGAGGGGCAGGTTCACCATC<br>AGCCAGGACGCCACCAAGAACATGTTCTACCTGCAGATGAACACCCTGAAGCCCGAGG<br>ACACCGCCATGTACTACTGCGCCGCCGCCAGCGGCAGGCTGAGGGGCAAGTGGTTCTG<br>GCCCTACGAGTACAACTACTGGGGCCAGGGCACCCAGGTGACCGTGAGCGCTAGCCAC<br>CACCACCACCACCACCAC |
| 141 | CAGGTGCAGCTGCAGGAGAGCGGCGGCGGCAGCGTGCAGGCCGGCGGCAGCCTGACC<br>CTGAGCTGCGCCGCCAGCGAGTACGCCTACAGCACCTGCAACATGGGCTGGTACAGGC<br>AGGCCCCCGGCAAGGAGAGGGAGCTGGTGAGCGCCTTCATCAGCGACGGCAGCACCTA<br>CTACGCCGACAGCGTGAAGGGCAGGTTCACCATCACCAGGGACAACGCCAAGAACACC<br>GTGTACCTGCAGATGAACAGCCTGAAGCCCGAGGACACCGCCATCTACTACTGCAGCG<br>CCAACTGCTACAGGAGGCTGAGGAACTACTGGGGCCAGGGCACCCAGGTGACCGTCTC<br>GAGTGGCGGCGGATCCCAGGTGCAGCTGCAGGAGAGCGGCGGCGGCAGCGTGCAGGC<br>CGGCGGCAGCCTGAGGCTGAGCTGCGTGGCCAGCGGCTACGTGAGCTGCGACTACTTC<br>CTGCCCAGCTGGTACAGGCAGGCCCCCGGCAAGGAGAGGGAGTTCGTGAGCATCATCG<br>ACGGCACCGGCAGCACCAGCTACGCCGCCAGCGTGAAGGGCAGGTTCACCGCCAGCCA<br>GGACAAGGGCAAGAACATCGCCTACCTGCAGATGAACACCCTGAAGCCCGAGGACACC<br>GCCATGTACTACTGCAAGGCCAGCTGCGTGAGGGGCAGGGCCATCAGCGAGTACTGGG<br>GCCAGGGCACCCAGGTGACCGTGAGCGCTAGCCACCACCACCACCACCACCAC |
| 142 | CAGGTGCAGCTGCAGGAGAGCGGCGGCGGCAGCGTGCAGGCCGGCGGCAGCCTGACC<br>CTGAGCTGCGCCGCCAGCGAGTACGCCTACAGCACCTGCAACATGGGCTGGTACAGGC<br>AGGCCCCCGGCAAGGAGAGGGAGCTGGTGAGCGCCTTCATCAGCGACGGCAGCACCTA |

TABLE 2C-continued

| SEQ ID NO | Sequence |
|---|---|
| | CTACGCCGACAGCGTGAAGGGCAGGTTCACCATCACCAGGGACAACGCCAAGAACACC<br>GTGTACCTGCAGATGAACAGCCTGAAGCCCGAGGACACCGCCATCTACTACTGCAGCG<br>CCAACTGCTACAGGAGGCTGAGGAACTACTGGGGCCAGGGCACCCAGGTGACCGTCTC<br>GAGTGGCGGCGGATCCCAGGTGCAGCTGCAGGAGAGCGGCGGCGGCAGCGTGCAGGC<br>CGGCGGCAGCCTGAGGCTGAGCTGCAGGGCCAGCGGCAGCACCTACAGCAACTACTGC<br>CTGGGCTGGTTCAGGCAGATCACCGGCAAGGAGAGGGAGGGCGTGGCCGTGATCAACT<br>GGGTGGGCGGCATGCTGTACTTCGCCGACAGCGTGAAGGGCAGGTTCACCGTGAGCCA<br>GGACCAGGCCAAGAACACCGTGTACCTGCAGATGAACAGCCTGAAGCCCGAGGACACC<br>GCCATGTACTACTGCGCCGCCGAGAGCGTGAGCAGCTTCAGCTGCGGCGGCTGGCTGA<br>CCAGGCCCGACAGGGTGCCCTACTGGGGCCAGGGCACCCAGGTGACCGTGAGCGCTAG<br>CCACCACCACCACCACCACCAC |
| 143 | CAGGTGCAGCTGCAGGAGAGCGGCGGCGGCAGCGTGCAGGCCGGCGGCAGCCTGACC<br>CTGAGCTGCGCCGCCAGCGAGTACGCCTACAGCACCTGCAACATGGGCTGGTACAGGC<br>AGGCCCCCGGCAAGGAGAGGGAGCTGGTGAGCGCCTTCATCAGCGACGGCAGCACCTA<br>CTACGCCGACAGCGTGAAGGGCAGGTTCACCATCACCAGGGACAACGCCAAGAACACC<br>GTGTACCTGCAGATGAACAGCCTGAAGCCCGAGGACACCGCCATCTACTACTGCAGCG<br>CCAACTGCTACAGGAGGCTGAGGAACTACTGGGGCCAGGGCACCCAGGTGACCGTCTC<br>GAGTGGCGGCGGATCCCAGGTGCAGCTGCAGGAGAGCGGCGGCGGCCTGGTGCAGCCC<br>GGCGGCAGCCTGAGGCTGAGCTGCGCCGCCAGCGGCTTCACCTTCAGCCTGAGCAGCA<br>TGAGCTGGGTGAGGCAGGCCCCCGGCAAGGGCCTGGAGTGGGTGAGCGCCATCAGCAG<br>CGGCGGCGCCAGCACCTACTACACCGACAGCGTGAAGGGCAGGTTCACCATCAGCAGG<br>GACAACGCCAAGAACATGCTGTACCTGCAGCTGAACAGCCTGAAGACCGAGGACACCG<br>CCATGTACTACTGCGCCAAGGGCGGCAGCGGCTACGGCGACGCCAGCAGGATGACCAG<br>CCCCGGCAGCCAGGGCACCCAGGTGACCGTGAGCGCTAGCCACCACCACCACCACCAC<br>CACCAC |
| 144 | CAGGTGCAGCTGCAGGAGAGCGGCGGCGGCCTGGTGCAGCCCGGCGGCAGCCTGAGGC<br>TGAGCTGCACCGCCAGCGGCCTGACCTTCGACGACAGCGTGATGGGCTGGTTCAGGCA<br>GGCCCCCGGCAAGGGCAGGGAGGCCGTGAGCTGCATCAGCAGCAGCGGCGCCAACGC<br>CTTCTACGCCGACAGCGTGAAGGGCAGGTTCACCATCAGCAGGGACAACGCCAAGAAC<br>ACCCTGTACCTGCAGATGAACAGCCTGAAGCCCGAGGACACCGCCACCTACTACTGCA<br>AGAGGGGCCACGCCTGCGCCGGCTACTACCCCATCCCCTACGACGACTACTGGGGCCA<br>GGGCACCCAGGTGACCGTCTCGAGTGGCGGCGGATCCCAGGTGCAGCTGCAGGAGAGC<br>GGCGGCGGCCTGGTGCAGCCCGGCGGCAGCCTGAGGCTGAGCTGCGCCGCCAGCGGCT<br>TCACCTTCAGCAGCTACCCCATGAGCTGGGTGAGGCAGGCCCCCGGCAAGGGCCTGGA<br>GTGGATCAGCACCATCAGCGCCGGCGGCGACACCACCCTGTACGCCGACAGCGTGAAG<br>GGCAGGTTCACCAGCAGCAGGGACAACGCCAAGAACACCCTGTACCTGCAGCTGAACA<br>GCCTGAAGACCGAGGACGCCGCCATCTACTACTGCGCCAAGAGGATCGACTGCAACAG<br>CGGCTACTGCTACAGGAGGAACTACTGGGGCCAGGGCACCCAGGTGACCGTGAGCGCT<br>AGCCACCACCACCACCACCACCAC |
| 145 | CAGGTGCAGCTGCAGGAGAGCGGCGGCGGCCTGGTGCAGCCCGGCGGCAGCCTGAGGC<br>TGAGCTGCACCGCCAGCGGCCTGACCTTCGACGACAGCGTGATGGGCTGGTTCAGGCA<br>GGCCCCCGGCAAGGGCAGGGAGGCCGTGAGCTGCATCAGCAGCAGCGGCGCCAACGC<br>CTTCTACGCCGACAGCGTGAAGGGCAGGTTCACCATCAGCAGGGACAACGCCAAGAAC<br>ACCCTGTACCTGCAGATGAACAGCCTGAAGCCCGAGGACACCGCCACCTACTACTGCA<br>AGAGGGGCCACGCCTGCGCCGGCTACTACCCCATCCCCTACGACGACTACTGGGGCCA<br>GGGCACCCAGGTGACCGTCTCGAGTGGCGGCGGATCCCAGGTGCAGCTGCAGGAGAGC<br>GGCGGCGGCCTGGTGCAGCCCGGCGGAGAGCCTGAGGCTGAGCTGCACCGCCAGCGGCT<br>TCACCTTCAGCAACTACGCCATGAGCTGGGTGAGGCAGGCCCCCGGCAAGGGCCTGGA<br>GTGGGTGAGCGGCATCAACGTGGCCTACGGCATCACCAGCTACGCCGACAGCGTGAAG<br>GGCAGGTTCACCATCAGCAGGGACAACACCAAGAACACCCTGTACCTGCAGCTGAACA<br>GCCTGAAGACCGAGGACACCGCCATCTACTACTGCGTGAAGCACAGCGGCACCACCAT<br>CCCCAGGGGCTTCATCAGCTACACCAAGAGGGGCCAGGGCACCCAGGTGACCGTGAGC<br>GCTAGCCACCACCACCACCACCACCAC |
| 146 | CAGGTGCAGCTGCAGGAGAGCGGCGGCGGCCTGGTGCAGCCCGGCGGCAGCCTGAGGC<br>TGAGCTGCACCGCCAGCGGCCTGACCTTCGACGACAGCGTGATGGGCTGGTTCAGGCA<br>GGCCCCCGGCAAGGGCAGGGAGGCCGTGAGCTGCATCAGCAGCAGCGGCGCCAACGC<br>CTTCTACGCCGACAGCGTGAAGGGCAGGTTCACCATCAGCAGGGACAACGCCAAGAAC<br>ACCCTGTACCTGCAGATGAACAGCCTGAAGCCCGAGGACACCGCCACCTACTACTGCA<br>AGAGGGGCCACGCCTGCGCCGGCTACTACCCCATCCCCTACGACGACTACTGGGGCCA<br>GGGCACCCAGGTGACCGTCTCGAGTGGCGGCGGATCCCAGGTGCAGCTGCAGGAGAGC<br>GGCGGCGGCCTGGTGCAGCCCGGCGGCAGCCTGAGGCTGAGCTGCGCCGCCAGCGGCT<br>TCAGCTTCAGCAGCTACGCCATGAAGTGGGTGAGGCAGGCCCCCGGCAAGGGCCTGGA<br>GTGGGTGAGCACCATCAGCAGCGGCGGCAGCAGCACCAACTACGCCGACAGCGTGAAG<br>GGCAGGTTCACCATCAGCAGGGACAACGCCAAGAACACCCTGTACCTGCAGCTGAACA<br>GCCTGAAGATCGAGGACACCGCCATGTACTACTGCGCCAAGGCCATCGTGCCCACCGG<br>CGCCACCATGGAGAGGGGCCAGGGCACCCAGGTGACCGTGAGCGCTAGCCACCACCAC<br>CACCACCACCACCAC |
| 147 | CAGGTGCAGCTGCAGGAGAGCGGCGGCGGCCTGGTGCAGCCCGGCGGCAGCCTGAGGC<br>TGAGCTGCACCGCCAGCGGCCTGACCTTCGACGACAGCGTGATGGGCTGGTTCAGGCA<br>GGCCCCCGGCAAGGGCAGGGAGGCCGTGAGCTGCATCAGCAGCAGCGGCGCCAACGC<br>CTTCTACGCCGACAGCGTGAAGGGCAGGTTCACCATCAGCAGGGACAACGCCAAGAAC |

TABLE 2C-continued

| SEQ ID NO | Sequence |
|---|---|
| | ACCCTGTACCTGCAGATGAACAGCCTGAAGCCCGAGGACACCGCCACCTACTACTGCA<br>AGAGGGGCCACGCCTGCGCCGGCTACTACCCCATCCCCTACGACGACTACTGGGGCCA<br>GGGCACCCAGGTGACCGTCTCGAGTGGCGGCGGATCCCAGGTGCAGCTGCAGGAGAGC<br>GGCGGCGGCAGCGTGCAGAGCGGCGGCAGCCTGAGGCTGAGCTGCGCCGCCAGCGGCT<br>TCACCTACAGCACCAGCAACAGCTGGATGGCCTGGTTCAGGCAGGCCCCCGGCAAGGA<br>GAGGGAGGGCGTGGCCGCCATCTACACCGTGGGCGGCAGCATCTTCTACGCCGACAGC<br>GTGAGGGGCAGGTTCACCATCAGCCAGGACGCCACCAAGAACATGTTCTACCTGCAGA<br>TGAACACCCTGAAGCCCGAGGACACCGCCATGTACTACTGCGCCGCCGCCAGCGGCAG<br>GCTGAGGGGCAAGTGGTTCTGGCCCTACGAGTACAACTACTGGGGCCAGGGCACCCAG<br>GTGACCGTGAGCGCTAGCCACCACCACCACCACCACCAC |
| 148 | CAGGTGCAGCTGCAGGAGAGCGGCGGCGGCCTGGTGCAGCCCGGCGGCAGCCTGAGGC<br>TGAGCTGCACCGCCAGCGGCCTGACCTTCGACGACAGCGTGATGGGCTGGTTCAGGCA<br>GGCCCCCGGCAAGGGCAGGGAGGCCGTGAGCTGCATCAGCAGCAGCGGCGCCAACGC<br>CTTCTACGCCGACAGCGTGAAGGGCAGGTTCACCATCAGCAGGGACAACGCCAAGAAC<br>ACCCTGTACCTGCAGATGAACAGCCTGAAGCCCGAGGACACCGCCACCTACTACTGCA<br>AGAGGGGCCACGCCTGCGCCGGCTACTACCCCATCCCCTACGACGACTACTGGGGCCA<br>GGGCACCCAGGTGACCGTCTCGAGTGGCGGCGGATCCCAGGTGCAGCTGCAGGAGAGC<br>GGCGGCGGCAGCGTGCAGGCCGGCGGCAGCCTGAGGCTGAGCTGCGTGGCCAGCGGCT<br>ACGTGAGCTGCGACTACTTCCTGCCCAGCTGGTACAGGCAGGCCCCCGGCAAGGAGAG<br>GGAGTTCGTGAGCATCATCGACGGCACCGGCAGCACCAGCTACGCCGCCAGCGTGAAG<br>GGCAGGTTCACCGCCAGCCAGGACAAGGGCAAGAACATCGCCTACCTGCAGATGAACA<br>CCCTGAAGCCCGAGGACACCGCCATGTACTACTGCAAGGCCAGCTGCGTGAGGGGCAG<br>GGCCATCAGCGAGTACGGGGCCAGGGCACCCAGGTGACCGTGAGCGCTAGCCACCAC<br>CACCACCACCACCACCAC |
| 149 | CAGGTGCAGCTGCAGGAGAGCGGCGGCGGCCTGGTGCAGCCCGGCGGCAGCCTGAGGC<br>TGAGCTGCACCGCCAGCGGCCTGACCTTCGACGACAGCGTGATGGGCTGGTTCAGGCA<br>GGCCCCCGGCAAGGGCAGGGAGGCCGTGAGCTGCATCAGCAGCAGCGGCGCCAACGC<br>CTTCTACGCCGACAGCGTGAAGGGCAGGTTCACCATCAGCAGGGACAACGCCAAGAAC<br>ACCCTGTACCTGCAGATGAACAGCCTGAAGCCCGAGGACACCGCCACCTACTACTGCA<br>AGAGGGGCCACGCCTGCGCCGGCTACTACCCCATCCCCTACGACGACTACTGGGGCCA<br>GGGCACCCAGGTGACCGTCTCGAGTGGCGGCGGATCCCAGGTGCAGCTGCAGGAGAGC<br>GGCGGCGGCAGCGTGCAGGCCGGCGGCAGCCTGAGGCTGAGCTGCAGGGCCAGCGGC<br>AGCACCTACAGCAACTACTGCCTGGGCTGGTTCAGGCAGATCACCGGCAAGGAGAGGG<br>AGGGCGTGGCCGTGATCAACTGGGTGGGCGGCATGCTGTACTTCGCCGACAGCGTGAA<br>GGGCAGGTTCACCGTGAGCCAGGACCAGGCCAAGAACACCGTGTACCTGCAGATGAAC<br>AGCCTGAAGCCCGAGGACACCGCCATGTACTACTGCGCCGCCGAGAGCGTGAGCAGCT<br>TCAGCTGCGGCGGCTGGCTGACCAGGCCCGACAGGGTGCCCTACTGGGGCCAGGGCAC<br>CCAGGTGACCGTGAGCGCTAGCCACCACCACCACCACCACCACCAC |
| 150 | CAGGTGCAGCTGCAGGAGAGCGGCGGCGGCCTGGTGCAGCCCGGCGGCAGCCTGAGGC<br>TGAGCTGCACCGCCAGCGGCCTGACCTTCGACGACAGCGTGATGGGCTGGTTCAGGCA<br>GGCCCCCGGCAAGGGCAGGGAGGCCGTGAGCTGCATCAGCAGCAGCGGCGCCAACGC<br>CTTCTACGCCGACAGCGTGAAGGGCAGGTTCACCATCAGCAGGGACAACGCCAAGAAC<br>ACCCTGTACCTGCAGATGAACAGCCTGAAGCCCGAGGACACCGCCACCTACTACTGCA<br>AGAGGGGCCACGCCTGCGCCGGCTACTACCCCATCCCCTACGACGACTACTGGGGCCA<br>GGGCACCCAGGTGACCGTCTCGAGTGGCGGCGGATCCCAGGTGCAGCTGCAGGAGAGC<br>GGCGGCGGCCTGGTGCAGCCCGGCGGCAGCCTGAGGCTGAGCTGCGCCGCCAGCGGCT<br>TCACCTTCAGCCTGAGCAGCATGAGCTGGGTGAGGCAGGCCCCCGGCAAGGGCCTGGA<br>GTGGGTGAGCGCCATCAGCAGCGGCGGCGCCAGCACCTACTACACCGACAGCGTGAAG<br>GGCAGGTTCACCATCAGCAGGGACAACGCCAAGAACATGCTGTACCTGCAGCTGAACA<br>GCCTGAAGACCGAGGACACCGCCATGTACTACTGCGCCAAGGGCGGCAGCGGCTACGG<br>CGACGCCAGCAGGATGACCAGCCCCGGCAGCCAGGGCACCCAGGTGACCGTGAGCGCT<br>AGCCACCACCACCACCACCACCAC |

Anti-IL27Rα V$_H$H-Linker-Anti-GP130 V$_H$H

A bispecific V$_H$H$^2$ can contain, from the N-terminus to the C-terminus, a first V$_H$H binding to IL27Rα (an anti-IL27Rα V$_H$H antibody), a linker, and a second V$_H$H binding to gp130 (an anti-gp130 V$_H$H antibody). In other words, the linker joins the C-terminus of the anti-IL27Rα V$_H$H in the binding protein to the N-terminus of the anti-gp130 V$_H$H in the binding protein. In some embodiments, a purification peptide, e.g., a six-histidine peptide ((His)$_6$ (SEQ ID NO: 1531) or His-tag) or an Fc tag can be included in the bispecific V$_H$H$^2$.

In certain embodiments, a bispecific V$_H$H$^2$ described herein comprises an anti-IL27Rα V$_H$H antibody comprising a sequence having at least 90% (e.g., 91%, 92%, 93%, 94%, 95%, 96%, 97%, 98%, 99%, or 100%) sequence identity to a sequence of any one of SEQ ID NOS:245-251; and an anti-gp130 V$_H$H antibody comprising a sequence having at least 90% (e.g., 91%, 92%, 93%, 94%, 95%, 96%, 97%, 98%, 99%, or 100%) sequence identity to a sequence of any one of SEQ ID NOS:252-257.

In certain embodiments, a bispecific V$_H$H$^2$ described herein comprises an anti-IL27Rα V$_H$H antibody and an anti-gp130 V$_H$H antibody as described in each row of Table 3A below or Table A above. In some embodiments, in each row of Table 3A, the anti-IL27Rα V$_H$H antibody and the anti-gp130 V$_H$H antibody can each, independently, comprise at least 90% (e.g., 91%, 92%, 93%, 94%, 95%, 96%, 97%, 98%, 99%, or 100%) sequence identity to the sequence described in each row of Table 3A. In some embodiments, the bispecific V$_H$H$^2$ can comprise a linker (e.g., linkers described in Section IV) between the anti-IL27Rα V_HH antibody and the anti-gp130 V_HH antibody as described in each row of Table 3A below. In particular embodiments, the linker is GGGS (SEQ ID NO:108). The sequence of the anti-IL27Rα V_HH is N-terminal to the linker and the sequence of the anti-gp130 V_HH is C-terminal to the linker. Examples of linkers are further described in Section IV below. The CDR sequences in each V_HH are underlined.

TABLE 3A

| N-terminal Anti-IL27Rα V_HH | C-terminal Anti-gp130 V_HH |
|---|---|
| QVQLQESGGGLVQPGGSLRLSCAASGFTFSSYPMSWVRQAPGKGLEWISTISAGGDTTLYADSVKGRFTSSRDNAKNTLYLQLNSLKTEDAAIYYCAKRIDCNSGYCYRRNYWGQGTQVTVSS (SEQ ID NO: 245) | QVQLQESGGGSVQAGGSLRLSCTASGAIASGYIDSRWCMAWFRQAPGKEREGVAAIWPGGGLTVYADSVKGRFTISRDHAKNTLYLQMNNLKPEDTAMYYCAAGSPRMCPSLEFGFDYWGQGTQVTVS (SEQ ID NO: 252) |
| QVQLQESGGGLVQPGGSLRLSCAASGFTFSSYPMSWVRQAPGKGLEWISTISAGGDTTLYADSVKGRFTSSRDNAKNTLYLQLNSLKTEDAAIYYCAKRIDCNSGYCYRRNYWGQGTQVTVSS (SEQ ID NO: 245) | QVQLQESGGGSVQAGGSLRLSCTAPGFTSNSCGMDWYRQAPGKEREFVSSISTDGTTGYADSVKGRFTISKDKAKDTVYLQMNSLKPEDTGMYSCKTKDGTIATMELCDFGYWGQGTQVTVS (SEQ ID NO: 253) |
| QVQLQESGGGLVQPGGSLRLSCAASGFTFSSYPMSWVRQAPGKGLEWISTISAGGDTTLYADSVKGRFTSSRDNAKNTLYLQLNSLKTEDAAIYYCAKRIDCNSGYCYRRNYWGQGTQVTVSS (SEQ ID NO: 245) | QVQLQESGGGSVQAGGSLRLSCAASGYPYSNGYMGWFRQAPGKEREGVATIYTGDGRTYYADSVKGRFTISRDNAKNTVDLQMSSLKPEDTAMYYCAARAAPLYSSGSPLTRARYNVWGQGTQVTVS (SEQ ID NO: 254) |
| QVQLQESGGGLVQPGGSLRLSCAASGFTFSSYPMSWVRQAPGKGLEWISTISAGGDTTLYADSVKGRFTSSRDNAKNTLYLQLNSLKTEDAAIYYCAKRIDCNSGYCYRRNYWGQGTQVTVSS (SEQ ID NO: 245) | QVQLQESGGGSVQAGGSLRLSCVASASTYCTYDMHWYRQAPGKGREFVSAIDSDGTTRYADSVKGRFTISQGTAKNTVYLQMNSLQPEDTAMYYCKTVCVVGSRWSDYWGQGTQVTVS (SEQ ID NO: 255) |
| QVQLQESGGGLVQPGGSLRLSCAASGFTFSSYPMSWVRQAPGKGLEWISTISAGGDTTLYADSVKGRFTSSRDNAKNTLYLQLNSLKTEDAAIYYCAKRIDCNSGYCYRRNYWGQGTQVTVSS (SEQ ID NO: 245) | QVQLQESGGGSVQAGGSLTLSCAASEYAYSTCNMGWYRQAPGKERELVSAFISDGSTYYADSVKGRFTITRDNAKNTVYLQMNSLKPEDTAIYYCSANCYRRLRNYWGQGTQVTVS (SEQ ID NO: 256) |
| QVQLQESGGGLVQPGGSLRLSCAASGFTFSSYPMSWVRQAPGKGLEWISTISAGGDTTLYADSVKGRFTSSRDNAKNTLYLQLNSLKTEDAAIYYCAKRIDCNSGYCYRRNYWGQGTQVTVSS (SEQ ID NO: 245) | QVQLQESGGGLVQPGGSLRLSCTASGLTFDDSVMGWFRQAPGKGREAVSCISSSGANAFYADSVKGRFTISRDNAKNTLYLQMNSLKPEDTATYYCKRGHACAGYYPIPYDDYWGQGTQVTVS (SEQ ID NO: 257) |
| QVQLQESGGGLVQPGESLRLSCTASGFTFSNYAMSWVRQAPGKGLEWVSGINVAYGITSYADSVKGRFTISRDNTKNTLYLQLNSLKTEDTAIYYCVKHSGTTIPRGFISYTKRGQGTQVTVSS (SEQ ID NO: 246) | QVQLQESGGGSVQAGGSLRLSCTASGAIASGYIDSRWCMAWFRQAPGKEREGVAAIWPGGGLTVYADSVKGRFTISRDHAKNTLYLQMNNLKPEDTAMYYCAAGSPRMCPSLEFGFDYWGQGTQVTVS (SEQ ID NO: 252) |
| QVQLQESGGGLVQPGESLRLSCTASGFTFSNYAMSWVRQAPGKGLEWVSGINVAYGITSYADSVKGRFTISRDNTKNTLYLQLNSLKTEDTAIYYCVKHSGTTIPRGFISYTKRGQGTQVTVSS (SEQ ID NO: 246) | QVQLQESGGGSVQAGGSLRLSCTAPGFTSNSCGMDWYRQAPGKEREFVSSISTDGTTGYADSVKGRFTISKDKAKDTVYLQMNSLKPEDTGMYSCKTKDGTIATMELCDFGYWGQGTQVTVS (SEQ ID NO: 253) |
| QVQLQESGGGLVQPGESLRLSCTASGFTFSNYAMSWVRQAPGKGLEWVSGINVAYGITSYADSVKGRFTISRDNTKNTLYLQLNSLKTEDTAIYYCVKHSGTTIPRGFISYTKRGQGTQVTVSS (SEQ ID NO: 246) | QVQLQESGGGSVQAGGSLRLSCAASGYPYSNGYMGWFRQAPGKEREGVATIYTGDGRTYYADSVKGRFTISRDNAKNTVDLQMSSLKPEDTAMYYCAARAAPLYSSGSPLTRARYNVWGQGTQVTVS (SEQ ID NO: 254) |
| QVQLQESGGGLVQPGESLRLSCTASGFTFSNYAMSWVRQAPGKGLEWVSGINVAYGITSYADSVKGRFTISRDNTKNTLYLQLNSLKTEDTAIYYCVKHSGTTIPRGFISYTKRGQGTQVTVSS (SEQ ID NO: 246) | QVQLQESGGGSVQAGGSLRLSCVASASTYCTYDMHWYRQAPGKGREFVSAIDSDGTTRYADSVKGRFTISQGTAKNTVYLQMNSLQPEDTAMYYCKTVCVVGSRWSDYWGQGTQVTVS (SEQ ID NO: 255) |
| QVQLQESGGGLVQPGESLRLSCTASGFTFSNYAMSWVRQAPGKGLEWVSGINVAYGITSYADSVKGRFTISRDNTKNTLYLQLNSLKTEDTAIYYCVKHSGTTIPRGFISYTKRGQGTQVTVSS (SEQ ID NO: 246) | QVQLQESGGGSVQAGGSLTLSCAASEYAYSTCNMGWYRQAPGKERELVSAFISDGSTYYADSVKGRFTITRDNAKNTVYLQMNSLKPEDTAIYYCSANCYRRLRNYWGQGTQVTVS (SEQ ID NO: 256) |
| QVQLQESGGGLVQPGESLRLSCTASGFTFSNYAMSWVRQAPGKGLEWVSGINVAYGITSYADSVKGRFTISRDNTKNTLYLQLNSLKTEDTAIYYCVKHSGTTIPRGFISYTKRGQGTQVTVSS (SEQ ID NO: 246) | QVQLQESGGGLVQPGGSLRLSCTASGLTFDDSVMGWFRQAPGKGREAVSCISSSGANAFYADSVKGRFTISRDNAKNTLYLQMNSLKPEDTATYYCKRGHACAGYYPIPYDDYWGQGTQVTVS (SEQ ID NO: 257) |

TABLE 3A-continued

| N-terminal Anti-IL27Rα V$_H$H | C-terminal Anti-gp130 V$_H$H |
|---|---|
| QVQLQESGGGLVQPGGSLRLSCAASGFSFSSY AMKWVRQAPGKGLEWVSTISSGGSSTNYADS VKGRFTISRDNAKNTYLQLNSLKIEDTAMYY CAKAIVPTGATMERGQGTQVTVSS (SEQ ID NO: 247) | QVQLQESGGGSVQAGGSLRLSCTASGAIASGY IDSRWCMAWFRQAPGKEREGVAAIWPGGGLT VYADSVKGRFTISRDHAKNTLYLQMNNLKPE DTAMYYCAAGSPRMCPSLEFGFDYWGQGTQV TVS (SEQ ID NO: 252) |
| QVQLQESGGGLVQPGGSLRLSCAASGFSFSSY AMKWVRQAPGKGLEWVSTISSGGSSTNYADS VKGRFTISRDNAKNTYLQLNSLKIEDTAMYY CAKAIVPTGATMERGQGTQVTVSS (SEQ ID NO: 247) | QVQLQESGGGSVQAGGSLRLSCTAPGFTSNSC GMDWYRQAPGKEREFVSSISTDGTTGYADSV KGRFTISKDKAKDTVYLQMNSLKPEDTGMYS CKTKDGTIATMELCDFGYWGQGTQVTVS (SEQ ID NO: 253) |
| QVQLQESGGGLVQPGGSLRLSCAASGFSFSSY AMKWVRQAPGKGLEWVSTISSGGSSTNYADS VKGRFTISRDNAKNTYLQLNSLKIEDTAMYY CAKAIVPTGATMERGQGTQVTVSS (SEQ ID NO: 247) | QVQLQESGGGSVQAGGSLRLSCAASGYPYSN GYMGWFRQAPGKEREGVATIYTGDGRTYYAD SVKGRFTISRDNAKNTVDLQMSSLKPEDTAMY YCAARAAPLYSSGSPLTRARYNVWGQGTQVT VS (SEQ ID NO: 254) |
| QVQLQESGGGLVQPGGSLRLSCAASGFSFSSY AMKWVRQAPGKGLEWVSTISSGGSSTNYADS VKGRFTISRDNAKNTYLQLNSLKIEDTAMYY CAKAIVPTGATMERGQGTQVTVSS (SEQ ID NO: 247) | QVQLQESGGGSVQAGGSLRLSCVASASTYCTY DMHWYRQAPGKGREFVSAIDSDGTTRYADSV KGRFTISQGTAKNTVYLQMNSLQPEDTAMYY CKTVCVVGSRWSDYWGQGTQVTVS (SEQ ID NO: 255) |
| QVQLQESGGGLVQPGGSLRLSCAASGFSFSSY AMKWVRQAPGKGLEWVSTISSGGSSTNYADS VKGRFTISRDNAKNTYLQLNSLKIEDTAMYY CAKAIVPTGATMERGQGTQVTVSS (SEQ ID NO: 247) | QVQLQESGGGSVQAGGSLTLSCAASEYAYSTC NMGWYRQAPGKERELVSAFISDGSTYYADSV KGRFTITRDNAKNTVYLQMNSLKPEDTAIYYC SANCYRRLRNYWGQGTQVTVS(SEQ ID NO: 256) |
| QVQLQESGGGLVQPGGSLRLSCAASGFSFSSY AMKWVRQAPGKGLEWVSTISSGGSSTNYADS VKGRFTISRDNAKNTYLQLNSLKIEDTAMYY CAKAIVPTGATMERGQGTQVTVSS (SEQ ID NO: 247) | QVQLQESGGGLVQPGGSLRLSCTASGLTFDDS VMGWFRQAPGKGREAVSCISSSGANAFYADS VKGRFTISRDNAKNTLYLQMNSLKPEDTATYY CKRGHACAGYYPIPYDDYWGQGTQVTVS (SEQ ID NO: 257) |
| QVQLQESGGGSVQSGGSLRLSCAASGFTYSTS NSWMAWFRQAPGKEREGVAAIYTVGGSIFYA DSVRGRFTISQDATKNMFYLQMNTLKPEDTA MYYCAAASGRLRGKWFWPYEYNYWGQGTQ VTVSS (SEQ ID NO: 248) | QVQLQESGGGSVQAGGSLRLSCTASGAIASGY IDSRWCMAWFRQAPGKEREGVAAIWPGGGLT VYADSVKGRFTISRDHAKNTLYLQMNNLKPE DTAMYYCAAGSPRMCPSLEFGFDYWGQGTQV TVS (SEQ ID NO: 252) |
| QVQLQESGGGSVQSGGSLRLSCAASGFTYSTS NSWMAWFRQAPGKEREGVAAIYTVGGSIFYA DSVRGRFTISQDATKNMFYLQMNTLKPEDTA MYYCAAASGRLRGKWFWPYEYNYWGQGTQ VTVSS (SEQ ID NO: 248) | QVQLQESGGGSVQAGGSLRLSCTAPGFTSNSC GMDWYRQAPGKEREFVSSISTDGTTGYADSV KGRFTISKDKAKDTVYLQMNSLKPEDTGMYS CKTKDGTIATMELCDFGYWGQGTQVTVS (SEQ ID NO: 253) |
| QVQLQESGGGSVQSGGSLRLSCAASGFTYSTS NSWMAWFRQAPGKEREGVAAIYTVGGSIFYA DSVRGRFTISQDATKNMFYLQMNTLKPEDTA MYYCAAASGRLRGKWFWPYEYNYWGQGTQ VTVSS (SEQ ID NO: 248) | QVQLQESGGGSVQAGGSLRLSCAASGYPYSN GYMGWFRQAPGKEREGVATIYTGDGRTYYAD SVKGRFTISRDNAKNTVDLQMSSLKPEDTAMY YCAARAAPLYSSGSPLTRARYNVWGQGTQVT VS (SEQ ID NO: 254) |
| QVQLQESGGGSVQSGGSLRLSCAASGFTYSTS NSWMAWFRQAPGKEREGVAAIYTVGGSIFYA DSVRGRFTISQDATKNMFYLQMNTLKPEDTA MYYCAAASGRLRGKWFWPYEYNYWGQGTQ VTVSS (SEQ ID NO: 248) | QVQLQESGGGSVQAGGSLRLSCVASASTYCTY DMHWYRQAPGKGREFVSAIDSDGTTRYADSV KGRFTISQGTAKNTVYLQMNSLQPEDTAMYY CKTVCVVGSRWSDYWGQGTQVTVS (SEQ ID NO: 255) |
| QVQLQESGGGSVQSGGSLRLSCAASGFTYSTS NSWMAWFRQAPGKEREGVAAIYTVGGSIFYA DSVRGRFTISQDATKNMFYLQMNTLKPEDTA MYYCAAASGRLRGKWFWPYEYNYWGQGTQ VTVSS (SEQ ID NO: 248) | QVQLQESGGGSVQAGGSLTLSCAASEYAYSTC NMGWYRQAPGKERELVSAFISDGSTYYADSV KGRFTITRDNAKNTVYLQMNSLKPEDTAIYYC SANCYRRLRNYWGQGTQVTVS(SEQ ID NO: 256) |
| QVQLQESGGGSVQSGGSLRLSCAASGFTYSTS NSWMAWFRQAPGKEREGVAAIYTVGGSIFYA DSVRGRFTISQDATKNMFYLQMNTLKPEDTA MYYCAAASGRLRGKWFWPYEYNYWGQGTQ VTVSS (SEQ ID NO: 248) | QVQLQESGGGLVQPGGSLRLSCTASGLTFDDS VMGWFRQAPGKGREAVSCISSSGANAFYADS VKGRFTISRDNAKNTLYLQMNSLKPEDTATYY CKRGHACAGYYPIPYDDYWGQGTQVTVS (SEQ ID NO: 257) |
| QVQLQESGGGSVQAGGSLRLSCVASGYVSCD YFLPSWYRQAPGKEREFVSIIDGTGSTSYAASV KGRFTASQDKGKNIAYLQMNTLKPEDTAMYY CKASCVRGRAISEYWGQGTQVTVSS (SEQ ID NO: 249) | QVQLQESGGGSVQAGGSLRLSCTASGAIASGY IDSRWCMAWFRQAPGKEREGVAAIWPGGGLT VYADSVKGRFTISRDHAKNTLYLQMNNLKPE DTAMYYCAAGSPRMCPSLEFGFDYWGQGTQV TVS (SEQ ID NO: 252) |

TABLE 3A-continued

| N-terminal Anti-IL27Rα V$_H$H | C-terminal Anti-gp130 V$_H$H |
|---|---|
| QVQLQESGGGSVQAGGSLRLSCVASGYVSCD YFLPSWYRQAPGKEREFVSIIDGTGSTSYAASV KGRFTASQDKGKNIAYLQMNTLKPEDTAMYY CKASCVRGRAISEYWGQGTQVTVSS (SEQ ID NO: 249) | QVQLQESGGGSVQAGGSLRLSCTAPGFTSNSC GMDWYRQAPGKEREFVSSISTDGTTGYADSV KGRFTISKDKAKDTVYLQMNSLKPEDTGMYS CKTKDGTIATMELCDFGYWGQGTQVTVS (SEQ ID NO: 253) |
| QVQLQESGGGSVQAGGSLRLSCVASGYVSCD YFLPSWYRQAPGKEREFVSIIDGTGSTSYAASV KGRFTASQDKGKNIAYLQMNTLKPEDTAMYY CKASCVRGRAISEYWGQGTQVTVSS (SEQ ID NO: 249) | QVQLQESGGGSVQAGGSLRLSCAASGYPYSN GYMGWFRQAPGKEREGVATIYTGDGRTYYAD SVKGRFTISRDNAKNTVDLQMSSLKPEDTAMY YCAARAAPLYSSGSPLTRARYNVWGQGTQVT VS (SEQ ID NO: 254) |
| QVQLQESGGGSVQAGGSLRLSCVASGYVSCD YFLPSWYRQAPGKEREFVSIIDGTGSTSYAASV KGRFTASQDKGKNIAYLQMNTLKPEDTAMYY CKASCVRGRAISEYWGQGTQVTVSS (SEQ ID NO: 249) | QVQLQESGGGSVQAGGSLRLSCVASASTYCTY DMHWYRQAPGKGREFVSAIDSDGTTRYADSV KGRFTISQGTAKNTVYLQMNSLQPEDTAMYY CKTVCVVGSRWSDYWGQGTQVTVS (SEQ ID NO: 255) |
| QVQLQESGGGSVQAGGSLRLSCVASGYVSCD YFLPSWYRQAPGKEREFVSIIDGTGSTSYAASV KGRFTASQDKGKNIAYLQMNTLKPEDTAMYY CKASCVRGRAISEYWGQGTQVTVSS (SEQ ID NO: 249) | QVQLQESGGGSVQAGGSLTLSCAASEYAYSTC NMGWYRQAPGKERELVSAFISDGSTYYADSV KGRFTITRDNAKNTVYLQMNSLKPEDTAIYYC SANCYRRLRNYWGQGTQVTVS(SEQ ID NO: 256) |
| QVQLQESGGGSVQAGGSLRLSCVASGYVSCD YFLPSWYRQAPGKEREFVSIIDGTGSTSYAASV KGRFTASQDKGKNIAYLQMNTLKPEDTAMYY CKASCVRGRAISEYWGQGTQVTVSS (SEQ ID NO: 249) | QVQLQESGGGLVQPGGSLRLSCTASGLTFDDS VMGWFRQAPGKGREAVSCISSSGANAFYADS VKGRFTISRDNAKNTLYLQMNSLKPEDTATYY CKRGHACAGYYPIPYDDYWGQGTQVTVS (SEQ ID NO: 257) |
| QVQLQESGGGSVQAGGSLRLSCRASGSTYSNY CLGWFRQITGKEREGVAVINWVGGMLYFADS VKGRFTVSQDQAKNTVYLQMNSLKPEDTAMY YCAAESVSSFSCGGWLTRPDRVPYWGQGTQV TVSS (SEQ ID NO: 250) | QVQLQESGGGSVQAGGSLRLSCTASGAIASGY IDSRWCMAWFRQAPGKEREGVAAIWPGGGLT VYADSVKGRFTISRDHAKNTLYLQMNNLKPE DTAMYYCAAGSPRMCPSLEFGFDYWGQGTQV TVS (SEQ ID NO: 252) |
| QVQLQESGGGSVQAGGSLRLSCRASGSTYSNY CLGWFRQITGKEREGVAVINWVGGMLYFADS VKGRFTVSQDQAKNTVYLQMNSLKPEDTAMY YCAAESVSSFSCGGWLTRPDRVPYWGQGTQV TVSS (SEQ ID NO: 250) | QVQLQESGGGSVQAGGSLRLSCTAPGFTSNSC GMDWYRQAPGKEREFVSSISTDGTTGYADSV KGRFTISKDKAKDTVYLQMNSLKPEDTGMYS CKTKDGTIATMELCDFGYWGQGTQVTVS (SEQ ID NO: 253) |
| QVQLQESGGGSVQAGGSLRLSCRASGSTYSNY CLGWFRQITGKEREGVAVINWVGGMLYFADS VKGRFTVSQDQAKNTVYLQMNSLKPEDTAMY YCAAESVSSFSCGGWLTRPDRVPYWGQGTQV TVSS (SEQ ID NO: 250) | QVQLQESGGGSVQAGGSLRLSCAASGYPYSN GYMGWFRQAPGKEREGVATIYTGDGRTYYAD SVKGRFTISRDNAKNTVDLQMSSLKPEDTAMY YCAARAAPLYSSGSPLTRARYNVWGQGTQVT VS (SEQ ID NO: 254) |
| QVQLQESGGGSVQAGGSLRLSCRASGSTYSNY CLGWFRQITGKEREGVAVINWVGGMLYFADS VKGRFTVSQDQAKNTVYLQMNSLKPEDTAMY YCAAESVSSFSCGGWLTRPDRVPYWGQGTQV TVSS (SEQ ID NO: 250) | QVQLQESGGGSVQAGGSLRLSCVASASTYCTY DMHWYRQAPGKGREFVSAIDSDGTTRYADSV KGRFTISQGTAKNTVYLQMNSLQPEDTAMYY CKTVCVVGSRWSDYWGQGTQVTVS (SEQ ID NO: 255) |
| QVQLQESGGGSVQAGGSLRLSCRASGSTYSNY CLGWFRQITGKEREGVAVINWVGGMLYFADS VKGRFTVSQDQAKNTVYLQMNSLKPEDTAMY YCAAESVSSFSCGGWLTRPDRVPYWGQGTQV TVSS (SEQ ID NO: 250) | QVQLQESGGGSVQAGGSLTLSCAASEYAYSTC NMGWYRQAPGKERELVSAFISDGSTYYADSV KGRFTITRDNAKNTVYLQMNSLKPEDTAIYYC SANCYRRLRNYWGQGTQVTVS(SEQ ID NO: 256) |
| QVQLQESGGGSVQAGGSLRLSCRASGSTYSNY CLGWFRQITGKEREGVAVINWVGGMLYFADS VKGRFTVSQDQAKNTVYLQMNSLKPEDTAMY YCAAESVSSFSCGGWLTRPDRVPYWGQGTQV TVSS (SEQ ID NO: 250) | QVQLQESGGGLVQPGGSLRLSCTASGLTFDDS VMGWFRQAPGKGREAVSCISSSGANAFYADS VKGRFTISRDNAKNTLYLQMNSLKPEDTATYY CKRGHACAGYYPIPYDDYWGQGTQVTVS (SEQ ID NO: 257) |
| QVQLQESGGGLVQPGGSLRLSCAASGFTFSLSS MSWVRQAPGKGLEWVSAISSGGASTYYTDSV KGRFTISRDNAKNMLYLQLNSLKTEDTAMYY CAKGGSGYGDASRMTSPGSQGTQVTVSS (SEQ ID NO: 251) | QVQLQESGGGSVQAGGSLRLSCTASGAIASGY IDSRWCMAWFRQAPGKEREGVAAIWPGGGLT VYADSVKGRFTISRDHAKNTLYLQMNNLKPE DTAMYYCAAGSPRMCPSLEFGFDYWGQGTQV TVS (SEQ ID NO: 252) |
| QVQLQESGGGLVQPGGSLRLSCAASGFTFSLSS MSWVRQAPGKGLEWVSAISSGGASTYYTDSV KGRFTISRDNAKNMLYLQLNSLKTEDTAMYY CAKGGSGYGDASRMTSPGSQGTQVTVSS (SEQ ID NO: 251) | QVQLQESGGGSVQAGGSLRLSCTAPGFTSNSC GMDWYRQAPGKEREFVSSISTDGTTGYADSV KGRFTISKDKAKDTVYLQMNSLKPEDTGMYS CKTKDGTIATMELCDFGYWGQGTQVTVS (SEQ ID NO: 253) |

TABLE 3A-continued

| N-terminal Anti-IL27Rα V$_H$H | C-terminal Anti-gp130 V$_H$H |
|---|---|
| QVQLQESGGGLVQPGGSLRLSCAASG<u>FTFSLSS MSW</u>VRQAPGKGLEWVS<u>AISSGGASTYYTDSV</u> KGRFTISRDNAKNMLYLQLNSLKTEDTAMYY C<u>AKGGSYGDASRMTSPGS</u>QGTQVTVSS (SEQ ID NO: 251) | QVQLQESGGGSVQAGGSLRLSCAASG<u>YPYSN GYM</u>GWVRQAPGKEREGVATI<u>YTGDGRTYYAD SV</u>KGRFTISRDNAKNTVDLQMSSLKPEDTAMY YCA<u>ARAAPLYSSGSPLTRARYNV</u>WGQGTQVT VS (SEQ ID NO: 254) |
| QVQLQESGGGLVQPGGSLRLSCAASG<u>FTFSLSS MSW</u>VRQAPGKGLEWVS<u>AISSGGASTYYTDSV</u> KGRFTISRDNAKNMLYLQLNSLKTEDTAMYY C<u>AKGGSYGDASRMTSPGS</u>QGTQVTVSS (SEQ ID NO: 251) | QVQLQESGGGSVQAGGSLRLSCVASA<u>STYCTY DMH</u>WYRQAPGKGREFVS<u>AIDSDGTTRYADSV</u> KGRFTISQGTAKNTVYLQMNSLQPEDTAMYY CKT<u>VCVVGSRWSDYWG</u>QGTQVTVS (SEQ ID NO: 255) |
| QVQLQESGGGLVQPGGSLRLSCAASG<u>FTFSLSS MSW</u>VRQAPGKGLEWVS<u>AISSGGASTYYTDSV</u> KGRFTISRDNAKNMLYLQLNSLKTEDTAMYY C<u>AKGGSYGDASRMTSPGS</u>QGTQVTVSS (SEQ ID NO: 251) | QVQLQESGGGSVQAGGSLTLSCAASE<u>YAYSTC NMG</u>WYRQAPGKERELVS<u>AFISDGSTYYADSV</u> KGRFTITRDNAKNTVYLQMNSLKPEDTAIYYC SAN<u>CYRRLRNYW</u>GQGTQVTVS(SEQ ID NO: 256) |
| QVQLQESGGGLVQPGGSLRLSCAASG<u>FTFSLSS MSW</u>VRQAPGKGLEWVS<u>AISSGGASTYYTDSV</u> KGRFTISRDNAKNMLYLQLNSLKTEDTAMYY C<u>AKGGSYGDASRMTSPGS</u>QGTQVTVSS (SEQ ID NO: 251) | QVQLQESGGGLVQPGGSLRLSCTASG<u>LTFDDS VMG</u>WFRQAPGKGREAVS<u>CISSSGANAFYADS V</u>KGRFTISRDNAKNTLYLQMNSLKPEDTATYY CK<u>RGHACAGYYPIPYDDY</u>WGQGTQVTVS (SEQ ID NO: 257) |

In certain embodiments, the bispecific V$_H$H$^2$ comprises a sequence that is substantially identical to a sequence of any one of SEQ ID NOS:43-84. Such a bispecific V$_H$HZ can have a sequence having at least 90% (e.g., 91%, 92%, 93%, 94%, 95%, 96%, 97%, 98%, 99%, or 100%) sequence identity to the sequence of any one of SEQ ID NOS:43-84, as shown in Table 3B below. In each of sequences of SEQ ID NOS:43-84, the linker GGGS (SEQ ID NO: 108) is in bold. The sequence of the anti-IL27Rα V$_H$H is N-terminus to the linker and the sequence of the anti-gp130 V$_H$H is C-terminus to the linker. The CDR sequences in each V$_H$H are underlined.

TABLE 3B

| SEQ ID NO | Sequence |
|---|---|
| 43 | QVQLQESGGGLVQPGGSLRLSCAASG<u>FTFSSYPMSW</u>VRQAPGKGLEWIS<u>TISAGGDTTLYA DSV</u>KGRFTSSRDNAKNTLYLQLNSLKTEDAAIYYCAKR<u>IDCNSGYCYRRNYW</u>GQGTQVTV SSGGGSQVQLQESGGGSVQAGGSLRLSCTASG<u>AIASGYIDSRWCMAW</u>FRQAPGKEREGVA AIWPGGGLTVYADSVKGRFTISRDHAKNTLYLQ<u>MNNLKPEDTAMYYCAAGSPRMCPSLEF GFDYW</u>GQGTQVTVS |
| 44 | QVQLQESGGGLVQPGGSLRLSCAASG<u>FTFSSYPMSW</u>VRQAPGKGLEWIS<u>TISAGGDTTLYA DSV</u>KGRFTSSRDNAKNTLYLQLNSLK<u>TEDAAIYYCAKRIDCNSGYCYRRNYW</u>GQGTQVTV SSGGGSQVQLQESGGGSVQAGGSLRLSCTAP<u>GFTSNSCGMDWYRQAPGKEREFVSSISTDG TTGYADSVKGRFTISKDKAKDTVYLQMNSLKPEDTGMYSCKT</u><u>KDGTIATMELCDFGYWG</u> QGTQVTVS |
| 45 | QVQLQESGGGLVQPGGSLRLSCAASG<u>FTFSSYPMSW</u>VRQAPGKGLEWIS<u>TISAGGDTTLYA DSV</u>KGRFTSSRDNAKNTLYLQLNSLKTEDAAIYYCAKR<u>IDCNSGYCYRRNYW</u>GQGTQVTV SSGGGSQVQLQESGGGSVQAGGSLRLSCAASG<u>YPYSNGYMGW</u>FRQAPGKEREGVATIYT GDGRTYYADSVKGRFTISRDNAKNTVDLQMSSLKPEDTAMYYCAA<u>RAAPLYSSGSPLTRA RYNVW</u>GQGTQVTVS |
| 46 | QVQLQESGGGLVQPGGSLRLSCAASG<u>FTFSSYPMSW</u>VRQAPGKGLEWIS<u>TISAGGDTTLYA DSV</u>KGRFTSSRDNAKNTLYLQLNSLKTEDAAIYYCAKR<u>IDCNSGYCYRRNYW</u>GQGTQVTV SSGGGSQVQLQESGGGSVQAGGSLRLSCVASA<u>STYCTYDMHW</u>YRQAPGKGREFVS<u>AIDSD GTTRYADSV</u>KGRFTISQGTAKNTVYLQMNSLQPEDTAMYYCKT<u>VCVVGSRWSDYW</u>GQGT QVTVS |
| 47 | QVQLQESGGGLVQPGGSLRLSCAASG<u>FTFSSYPMSW</u>VRQAPGKGLEWIS<u>TISAGGDTTLYA DSV</u>KGRFTSSRDNAKNTLYLQLNSLKTEDAAIYYCAKR<u>IDCNSGYCYRRNYW</u>GQGTQVTV SSGGGSQVQLQESGGGSVQAGGSLTLSCAASE<u>YAYSTCNMGW</u>YRQAPGKERELVS<u>AFISD GSTYYADSV</u>KGRFTITRDNAKNTVYLQMNSLKPEDTAIYYCSAN<u>CYRRLRNYW</u>GQGTQVT VS |
| 48 | QVQLQESGGGLVQPGGSLRLSCAASG<u>FTFSSYPMSW</u>VRQAPGKGLEWIS<u>TISAGGDTTLYA DSV</u>KGRFTSSRDNAKNTLYLQLNSLKTEDAAIYYCAKR<u>IDCNSGYCYRRNYW</u>GQGTQVTV SSGGGSQVQLQESGGGLVQPGGSLRLSCTASG<u>LTFDDSVMGW</u>FRQAPGKGREAVS<u>CISSSG ANAFYADSV</u>KGRFTISRDNAKNTLYLQMNSLKPEDTATYYCK<u>RGHACAGYYPIPYDDYW</u> GQGTQVTVS |

TABLE 3B-continued

| SEQ ID NO | Sequence |
|---|---|
| 49 | QVQLQESGGGLVQPGESLRLSCTASGFTFSNYAMSWVRQAPGKGLEWVSGINVAYGITSYADSVKGRFTISRDNTKNTLYLQLNSLKTEDTAIYYCVKHSGTTIPRGFISYTKRGQGTQVTVSSGGGSQVQLQESGGGSVQAGGSLRLSCTASGAIASGYIDSRWCMAWFRQAPGKEREGVAAIWPGGGLTVYADSVKGRFTISRDHAKNTLYLQMNNLKPEDTAMYYCAAGSPRMCPSLEFGFDYWGQGTQVTVS |
| 50 | QVQLQESGGGLVQPGESLRLSCTASGFTFSNYAMSWVRQAPGKGLEWVSGINVAYGITSYADSVKGRFTISRDNTKNTLYLQLNSLKTEDTAIYYCVKHSGTTIPRGFISYTKRGQGTQVTVSSGGGSQVQLQESGGGSVQAGGSLRLSCTAPGFTSNSCGMDWYRQAPGKEREFVSSISTDGTTGYADSVKGRFTISKDKAKDTVYLQMNSLKPEDTGMYSCKTKDGTIATMELCDFGYWGQGTQVTVS |
| 51 | QVQLQESGGGLVQPGESLRLSCTASGFTFSNYAMSWVRQAPGKGLEWVSGINVAYGITSYADSVKGRFTISRDNTKNTLYLQLNSLKTEDTAIYYCVKHSGTTIPRGFISYTKRGQGTQVTVSSGGGSQVQLQESGGGSVQAGGSLRLSCAASGYPYSNGYMGWFRQAPGKEREGVATIYTGDGRTYYADSVKGRFTISRDNAKNTVDLQMSSLKPEDTAMYYCAARAAPLYSSGSPLTRARYNVWGQGTQVTVS |
| 52 | QVQLQESGGGLVQPGESLRLSCTASGFTFSNYAMSWVRQAPGKGLEWVSGINVAYGITSYADSVKGRFTISRDNTKNTLYLQLNSLKTEDTAIYYCVKHSGTTIPRGFISYTKRGQGTQVTVSSGGGSQVQLQESGGGSVQAGGSLRLSCVASASTYCTYDMHWYRQAPGKGREFVSAIDSDGTTRYADSVKGRFTISQGTAKNTVYLQMNSLQPEDTAMYYCKTVCVVGSRWSDYWGQGTQVTVS |
| 53 | QVQLQESGGGLVQPGESLRLSCTASGFTFSNYAMSWVRQAPGKGLEWVSGINVAYGITSYADSVKGRFTISRDNTKNTLYLQLNSLKTEDTAIYYCVKHSGTTIPRGFISYTKRGQGTQVTVSSGGGSQVQLQESGGGSVQAGGSLTLSCAASEYAYSTCNMGWYRQAPGKERELVSAFISDGSTYYADSVKGRFTITRDNAKNTVYLQMNSLKPEDTAIYYCSANCYRRLRNYWGQGTQVTVS |
| 54 | QVQLQESGGGLVQPGESLRLSCTASGFTFSNYAMSWVRQAPGKGLEWVSGINVAYGITSYADSVKGRFTISRDNTKNTLYLQLNSLKTEDTAIYYCVKHSGTTIPRGFISYTKRGQGTQVTVSSGGGSQVQLQESGGGLVQPGGSLRLSCTASGLTFDDSVMGWFRQAPGKGREAVSCISSSGANAFYADSVKGRFTISRDNAKNTLYLQMNSLKPEDTATYYCKRGHACAGYYPIPYDDYWGQGTQVTVS |
| 55 | QVQLQESGGGLVQPGGSLRLSCAASGFSFSSYAMKWVRQAPGKGLEWVSTISSGGSSTNYADSVKGRFTISRDNAKNTLYLQLNSLKIEDTAMYYCAKAIVPTGATMERGQGTQVTVSSGGGSQVQLQESGGGSVQAGGSLRLSCTASGAIASGYIDSRWCMAWFRQAPGKEREGVAAIWPGGGLTVYADSVKGRFTISRDHAKNTLYLQMNNLKPEDTAMYYCAAGSPRMCPSLEFGFDYWGQGTQVTVS |
| 56 | QVQLQESGGGLVQPGGSLRLSCAASGFSFSSYAMKWVRQAPGKGLEWVSTISSGGSSTNYADSVKGRFTISRDNAKNTLYLQLNSLKIEDTAMYYCAKAIVPTGATMERGQGTQVTVSSGGGSQVQLQESGGGSVQAGGSLRLSCTAPGFTSNSCGMDWYRQAPGKEREFVSSISTDGTTGYADSVKGRFTISKDKAKDTVYLQMNSLKPEDTGMYSCKTKDGTIATMELCDFGYWGQGTQVTVS |
| 57 | QVQLQESGGGLVQPGGSLRLSCAASGFSFSSYAMKWVRQAPGKGLEWVSTISSGGSSTNYADSVKGRFTISRDNAKNTLYLQLNSLKIEDTAMYYCAKAIVPTGATMERGQGTQVTVSSGGGSQVQLQESGGGSVQAGGSLRLSCAASGYPYSNGYMGWFRQAPGKEREGVATIYTGDGRTYYADSVKGRFTISRDNAKNTVDLQMSSLKPEDTAMYYCAARAAPLYSSGSPLTRARYNVWGQGTQVTVS |
| 58 | QVQLQESGGGLVQPGGSLRLSCAASGFSFSSYAMKWVRQAPGKGLEWVSTISSGGSSTNYADSVKGRFTISRDNAKNTLYLQLNSLKIEDTAMYYCAKAIVPTGATMERGQGTQVTVSSGGGSQVQLQESGGGSVQAGGSLRLSCVASASTYCTYDMHWYRQAPGKGREFVSAIDSDGTTRYADSVKGRFTISQGTAKNTVYLQMNSLQPEDTAMYYCKTVCVVGSRWSDYWGQGTQVTVS |
| 59 | QVQLQESGGGLVQPGGSLRLSCAASGFSFSSYAMKWVRQAPGKGLEWVSTISSGGSSTNYADSVKGRFTISRDNAKNTLYLQLNSLKIEDTAMYYCAKAIVPTGATMERGQGTQVTVSSGGGSQVQLQESGGGSVQAGGSLTLSCAASEYAYSTCNMGWYRQAPGKERELVSAFISDGSTYYADSVKGRFTITRDNAKNTVYLQMNSLKPEDTAIYYCSANCYRRLRNYWGQGTQVTVS |
| 60 | QVQLQESGGGLVQPGGSLRLSCAASGFSFSSYAMKWVRQAPGKGLEWVSTISSGGSSTNYADSVKGRFTISRDNAKNTLYLQLNSLKIEDTAMYYCAKAIVPTGATMERGQGTQVTVSSGGGSQVQLQESGGGLVQPGGSLRLSCTASGLTFDDSVMGWFRQAPGKGREAVSCISSSGANAFYADSVKGRFTISRDNAKNTLYLQMNSLKPEDTATYYCKRGHACAGYYPIPYDDYWGQGTQVTVS |
| 61 | QVQLQESGGGSVQSGGSLRLSCAASGFTYSTSNSWMAWFRQAPGKEREGVAAIYTVGGSIFYADSVRGRFTISQDATKNMFYLQMNTLKPEDTAMYYCAASGRLRGKWFWPYEYNYWGQGTQVTVSSGGGSQVQLQESGGGSVQAGGSLRLSCTASGAIASGYIDSRWCMAWFRQAPGKEREGVAAIWPGGGLTVYADSVKGRFTISRDHAKNTLYLQMNNLKPEDTAMYYCAAGSPRMCPSLEFGFDYWGQGTQVTVS |

TABLE 3B-continued

| SEQ ID NO | Sequence |
|---|---|
| 62 | QVQLQESGGGSVQSGGSLRLSCAASGFTYSTSNSWMAWFRQAPGKEREGVAAIYTVGGSIF YADSVRGRFTISQDATKNMFYLQMNTLKPEDTAMYYCAAASGRLRGKWFWPYEYNYWG QGTQVTVSGGGSQVQLQESGGGSVQAGGSLRLSCTAPGFTSNSCGMDWYRQAPGKEREF VSSISTDGTTGYADSVKGRFTISKDKAKDTVYLQMNSLKPEDTGMYSCKTKDGTIATMELC DFGYWGQGTQVTVS |
| 63 | QVQLQESGGGSVQSGGSLRLSCAASGFTYSTSNSWMAWFRQAPGKEREGVAAIYTVGGSIF YADSVRGRFTISQDATKNMFYLQMNTLKPEDTAMYYCAAASGRLRGKWFWPYEYNYWG QGTQVTVSGGGSQVQLQESGGGSVQAGGSLRLSCAASGYPYSNGYMGWFRQAPGKERE GVATIYTGDGRTYYADSVKGRFTISRDNAKNTVDLQMSSLKPEDTAMYYCAARAAPLYSS GSPLTRARYNVWGQGTQVTVS |
| 64 | QVQLQESGGGSVQSGGSLRLSCAASGFTYSTSNSWMAWFRQAPGKEREGVAAIYTVGGSIF YADSVRGRFTISQDATKNMFYLQMNTLKPEDTAMYYCAAASGRLRGKWFWPYEYNYWG QGTQVTVSGGGSQVQLQESGGGSVQAGGSLRLSCVASASTYCTYDMHWYRQAPGKGRE FVSAIDSDGTTRYADSVKGRFTISQGTAKNTVYLQMNSLQPEDTAMYYCKTVCVVGSRWS DYWGQGTQVTVS |
| 65 | QVQLQESGGGSVQSGGSLRLSCAASGFTYSTSNSWMAWFRQAPGKEREGVAAIYTVGGSIF YADSVRGRFTISQDATKNMFYLQMNTLKPEDTAMYYCAAASGRLRGKWFWPYEYNYWG QGTQVTVSGGGSQVQLQESGGGSVQAGGSLTLSCAASEYAYSTCNMGWYRQAPGKERE LVSAFISDGSTYYADSVKGRFTITRDNAKNTVYLQMNSLKPEDTAIYYCSANCYRRLRNYW GQGTQVTVS |
| 66 | QVQLQESGGGSVQSGGSLRLSCAASGFTYSTSNSWMAWFRQAPGKEREGVAAIYTVGGSIF YADSVRGRFTISQDATKNMFYLQMNTLKPEDTAMYYCAAASGRLRGKWFWPYEYNYWG QGTQVTVSGGGSQVQLQESGGGLVQPGGSLRLSCTASGLTFDDSVMGWFRQAPGKGRE AVSCISSSGANAFYADSVKGRFTISRDNAKNTLYLQMNSLKPEDTATYYCKRGHACAGYY PIPYDDYWGQGTQVTVS |
| 67 | QVQLQESGGGSVQAGGSLRLSCVASGYVSCDYFLPSWYRQAPGKEREFVSIIDGTGSTSYA ASVKGRFTASQDKGKNIAYLQMNTLKPEDTAMYYCKASCVRGRAISEYWGQGTQVTVSS GGGSQVQLQESGGGSVQAGGSLRLSCTASGAIASGYIDSRWCMAWFRQAPGKEREGVAAI WPGGGLTVYADSVKGRFTISRDHAKNTLYLQMNNLKPEDTAMYYCAAGSPRMCPSLEFGF DYWGQGTQVTVS |
| 68 | QVQLQESGGGSVQAGGSLRLSCVASGYVSCDYFLPSWYRQAPGKEREFVSIIDGTGSTSYA ASVKGRFTASQDKGKNIAYLQMNTLKPEDTAMYYCKASCVRGRAISEYWGQGTQVTVSS GGGSQVQLQESGGGSVQAGGSLRLSCTAPGFTSNCGMDWYRQAPGKEREFVSSISTDGT TGYADSVKGRFTISKDKAKDTVYLQMNSLKPEDTGMYSCKTKDGTIATMELCDFGYWGQ GTQVTVS |
| 69 | QVQLQESGGGSVQAGGSLRLSCVASGYVSCDYFLPSWYRQAPGKEREFVSIIDGTGSTSYA ASVKGRFTASQDKGKNIAYLQMNTLKPEDTAMYYCKASCVRGRAISEYWGQGTQVTVSS GGGSQVQLQESGGGSVQAGGSLRLSCAASGYPYSNGYMGWFRQAPGKEREGVATIYTGD GRTYYADSVKGRFTISRDNAKNTVDLQMSSLKPEDTAMYYCAARAAPLYSSGSPLTRARY NVWGQGTQVTVS |
| 70 | QVQLQESGGGSVQAGGSLRLSCVASGYVSCDYFLPSWYRQAPGKEREFVSIIDGTGSTSYA ASVKGRFTASQDKGKNIAYLQMNTLKPEDTAMYYCKASCVRGRAISEYWGQGTQVTVSS GGGSQVQLQESGGGSVQAGGSLRLSCVASASTYCTYDMHWYRQAPGKGREFVSAIDSDG TTRYADSVKGRFTISQGTAKNTVYLQMNSLQPEDTAMYYCKTVCVVGSRWSDYWGQGTQ VTVS |
| 71 | QVQLQESGGGSVQAGGSLRLSCVASGYVSCDYFLPSWYRQAPGKEREFVSIIDGTGSTSYA ASVKGRFTASQDKGKNIAYLQMNTLKPEDTAMYYCKASCVRGRAISEYWGQGTQVTVSS GGGSQVQLQESGGGSVQAGGSLTLSCAASEYAYSTCNMGWYRQAPGKERELVSAFISDGS TYYADSVKGRFTITRDNAKNTVYLQMNSLKPEDTAIYYCSANCYRRLRNYWGQGTQVTVS |
| 72 | QVQLQESGGGSVQAGGSLRLSCVASGYVSCDYFLPSWYRQAPGKEREFVSIIDGTGSTSYA ASVKGRFTASQDKGKNIAYLQMNTLKPEDTAMYYCKASCVRGRAISEYWGQGTQVTVSS GGGSQVQLQESGGGLVQPGGSLRLSCTASGLTFDDSVMGWFRQAPGKGREAVSCISSSGA NAFYADSVKGRFTISRDNAKNTLYLQMNSLKPEDTATYYCKRGHACAGYYPIPYDDYWG QGTQVTVS |
| 73 | QVQLQESGGGSVQAGGSLRLSCRASGSTYSNYCLGWFRQITGKEREGVAVINWVGGMLYF ADSVKGRFTVSQDQAKNTVYLQMNSLKPEDTAMYYCAAESVSSFSCGGWLTRPDRVPYW GQGTQVTVSSGGGSQVQLQESGGGSVQAGGSLRLSCTASGAIASGYIDSRWCMAWFRQAP GKEREGVAAIWPGGGLTVYADSVKGRFTISRDHAKNTLYLQMNNLKPEDTAMYYCAAGS PRMCPSLEFGFDYWGQGTQVTVS |
| 74 | QVQLQESGGGSVQAGGSLRLSCRASGSTYSNYCLGWFRQITGKEREGVAVINWVGGMLYF ADSVKGRFTVSQDQAKNTVYLQMNSLKPEDTAMYYCAAESVSSFSCGGWLTRPDRVPYW GQGTQVTVSSGGGSQVQLQESGGGSVQAGGSLRLSCTAPGFTSNCGMDWYRQAPGKER EFVSSISTDGTTGYADSVKGRFTISKDKAKDTVYLQMNSLKPEDTGMYSCKTKDGTIATME LCDFGYWGQGTQVTVS |

TABLE 3B-continued

| SEQ ID NO | Sequence |
|---|---|
| 75 | QVQLQESGGGSVQAGGSLRLSCRASGSTYSNYCLGWFRQITGKEREGVAVINWVGGMLYF<br>ADSVKGRFTVSQDQAKNTVYLQMNSLKPEDTAMYYCAAESVSSFSCGGWLTRPDRVPYW<br>GQGTQVTVSGGGSQVQLQESGGGSVQAGGSLRLSCAASGYPYSNGYMGWFRQAPGKER<br>EGVATIYTGDGRTYYADSVKGRFTISRDNAKNTVDLQMSSLKPEDTAMYYCAARAAPLYS<br>SGSPLTRARYNVWGQGTQVTVS |
| 76 | QVQLQESGGGSVQAGGSLRLSCRASGSTYSNYCLGWFRQITGKEREGVAVINWVGGMLYF<br>ADSVKGRFTVSQDQAKNTVYLQMNSLKPEDTAMYYCAAESVSSFSCGGWLTRPDRVPYW<br>GQGTQVTVSGGGSQVQLQESGGGSVQAGGSLRLSCVASASTYCTYDMHWYRQAPGKGR<br>EFVSAIDSDGTTRYADSVKGRFTISQGTAKNTVYLQMNSLQPEDTAMYYCKTVCVVGSRW<br>SDYWGQGTQVTVS |
| 77 | QVQLQESGGGSVQAGGSLRLSCRASGSTYSNYCLGWFRQITGKEREGVAVINWVGGMLYF<br>ADSVKGRFTVSQDQAKNTVYLQMNSLKPEDTAMYYCAAESVSSFSCGGWLTRPDRVPYW<br>GQGTQVTVSGGGSQVQLQESGGGSVQAGGSLTLSCAASEYAYSTCNMGWYRQAPGKER<br>ELVSAFISDGSTYYADSVKGRFTITRDNAKNTVYLQMNSLKPEDTAIYYCSANCYRRLRNY<br>WGQGTQVTVS |
| 78 | QVQLQESGGGSVQAGGSLRLSCRASGSTYSNYCLGWFRQITGKEREGVAVINWVGGMLYF<br>ADSVKGRFTVSQDQAKNTVYLQMNSLKPEDTAMYYCAAESVSSFSCGGWLTRPDRVPYW<br>GQGTQVTVSGGGSQVQLQESGGGLVQPGGSLRLSCTASGLTFDDSVMGWFRQAPGKGR<br>EAVSCISSSGANAFYADSVKGRFTISRDNAKNTLYLQMNSLKPEDTATYYCKRGHACAGY<br>YPIPYDDYWGQGTQVTVS |
| 79 | QVQLQESGGGLVQPGGSLRLSCAASGFTFSLSSMSWVRQAPGKGLEWVSAISSGGASTYYT<br>DSVKGRFTISRDNAKNMLYLQLNSLKTEDTAMYYCAKGGSGYGDASRMTSPGSQGTQVT<br>VSSGGGSQVQLQESGGGSVQAGGSLRLSCTASGAIASGYIDSRWCMAWFRQAPGKEREGV<br>AAIWPGGGLTVYADSVKGRFTISRDHAKNTLYLQMNNLKPEDTAMYYCAAGSPRMCPSLE<br>FGFDYWGQGTQVTVS |
| 80 | QVQLQESGGGLVQPGGSLRLSCAASGFTFSLSSMSWVRQAPGKGLEWVSAISSGGASTYYT<br>DSVKGRFTISRDNAKNMLYLQLNSLKTEDTAMYYCAKGGSGYGDASRMTSPGSQGTQVT<br>VSSGGGSQVQLQESGGGSVQAGGSLRLSCTAPGFTSNSCGMDWYRQAPGKEREFVSSISTD<br>GTTGYADSVKGRFTISKDKAKDTVYLQMNSLKPEDTGMYSCKTKDGTIATMELCDFGYW<br>GQGTQVTVS |
| 81 | QVQLQESGGGLVQPGGSLRLSCAASGFTFSLSSMSWVRQAPGKGLEWVSAISSGGASTYYT<br>DSVKGRFTISRDNAKNMLYLQLNSLKTEDTAMYYCAKGGSGYGDASRMTSPGSQGTQVT<br>VSSGGGSQVQLQESGGGSVQAGGSLRLSCAASGYPYSNGYMGWFRQAPGKEREGVATIY<br>TGDGRTYYADSVKGRFTISRDNAKNTVDLQMSSLKPEDTAMYYCAARAAPLYSSGSPLTR<br>ARYNVWGQGTQVTVS |
| 82 | QVQLQESGGGLVQPGGSLRLSCAASGFTFSLSSMSWVRQAPGKGLEWVSAISSGGASTYYT<br>DSVKGRFTISRDNAKNMLYLQLNSLKTEDTAMYYCAKGGSGYGDASRMTSPGSQGTQVT<br>VSSGGGSQVQLQESGGGSVQAGGSLRLSCVASASTYCTYDMHWYRQAPGKGREFVSAIDS<br>DGTTRYADSVKGRFTISQGTAKNTVYLQMNSLQPEDTAMYYCKTVCVVGSRWSDYWGQ<br>GTQVTVS |
| 83 | QVQLQESGGGLVQPGGSLRLSCAASGFTFSLSSMSWVRQAPGKGLEWVSAISSGGASTYYT<br>DSVKGRFTISRDNAKNMLYLQLNSLKTEDTAMYYCAKGGSGYGDASRMTSPGSQGTQVT<br>VSSGGGSQVQLQESGGGSVQAGGSLTLSCAASEYAYSTCNMGWYRQAPGKERELVSAFIS<br>DGSTYYADSVKGRFTITRDNAKNTVYLQMNSLKPEDTAIYYCSANCYRRLRNYWGQGTQ<br>VTVS |

TABLE 3B-continued

| SEQ ID NO | Sequence |
|---|---|
| 84 | QVQLQESGGGLVQPGGSLRLSCAASGFTFSLSSMSWVRQAPGKGLEWVSAISSGGASTYYT DSVKGRFTISRDNAKNMLYLQLNSLKTEDTAMYYCAKGGSGYGDASRMTSPGSQGTQVT VSSGGGSQVQLQESGGGLVQPGGSLRLSCTASGLTFDDSVMGWFRQAPGKGREAVSCISSS GANAFYADSVKGRFTISRDNAKNTLYLQMNSLKPEDTATYYCKRGHACAGYYPIPYDDY WGQGTQVTVS |

In some embodiments, an IL27R binding protein described herein (e.g., an IL27R binding protein comprising a sequence of any one of SEQ ID NOS:43-84) is encoded by an isolated nucleic acid that is substantially identical to a sequence of any one of SEQ ID NOS: 151-192, as listed in Table 3C below. In some embodiments, an IL27R binding protein described herein (e.g., an IL27R binding protein comprising a sequence of any one of SEQ ID NOS:43-84) is encoded by an isolated nucleic acid comprising a sequence having at least 90% (e.g., 91%, 92%, 93%, 94%, 95%, 96%, 97%, 98%, 99%, or 100%) sequence identity to a sequence of any one of SEQ ID NOS: 151-192, as listed in Table 3C below.

TABLE 3C

| SEQ ID NO | Sequence |
|---|---|
| 151 | CAGGTGCAGCTGCAGGAGAGCGGCGGCGGCCTGGTGCAGCCCGGCGGCAGCCTGAGGC TGAGCTGCGCCGCCAGCGGCTTCACCTTCAGCAGCTACCCCATGAGCTGGGTGAGGCA GGCCCCCGGCAAGGGCCTGGAGTGGATCAGCACCATCAGCGCCGGCGGCGACACCACC CTGTACGCCGACAGCGTGAAGGGCAGGTTCACCAGCAGCAGGGACAACGCCAAGAAC ACCCTGTACCTGCAGCTGAACAGCCTGAAGACCGAGGACGCCGCCATCTACTACTGCG CCAAGAGGATCGACTGCAACAGCGGCTACTGCTACAGGAGGAACTACTGGGGCCAGGG CACCCAGGTGACCGTCTCGAGTGGCGGCGGATCCCAGGTGCAGCTGCAGGAGAGCGGC GGCGGCAGCGTGCAGGCCGGCGGCAGCCTGAGGCTGAGCTGCACCGCCAGCGGCGCCA TCGCCAGCGGCTACATCGACAGCAGGTGGTGCATGGCCTGGTTCAGGCAGGCCCCCGG CAAGGAGAGGGAGGGCGTGGCCGCCATCTGGCCCGGCGGCGGCCTGACCGTGTACGCC GACAGCGTGAAGGGCAGGTTCACCATCAGCAGGGACCACGCCAAGAACACCCTGTACC TGCAGATGAACAACCTGAAGCCCGAGGACACCGCCATGTACTACTGCGCCGCCGGCAG CCCCAGGATGTGCCCCAGCCTGGAGTTCGGCTTCGACTACTGGGGCCAGGGCACCCAG GTGACCGTGAGCGCTAGCCACCACCACCACCACCACCAC |
| 152 | CAGGTGCAGCTGCAGGAGAGCGGCGGCGGCCTGGTGCAGCCCGGCGGCAGCCTGAGGC TGAGCTGCGCCGCCAGCGGCTTCACCTTCAGCAGCTACCCCATGAGCTGGGTGAGGCA GGCCCCCGGCAAGGGCCTGGAGTGGATCAGCACCATCAGCGCCGGCGGCGACACCACC CTGTACGCCGACAGCGTGAAGGGCAGGTTCACCAGCAGCAGGGACAACGCCAAGAAC ACCCTGTACCTGCAGCTGAACAGCCTGAAGACCGAGGACGCCGCCATCTACTACTGCG CCAAGAGGATCGACTGCAACAGCGGCTACTGCTACAGGAGGAACTACTGGGGCCAGGG CACCCAGGTGACCGTCTCGAGTGGCGGCGGATCCCAGGTGCAGCTGCAGGAGAGCGGC GGCGGCAGCGTGCAGGCCGGCGGCAGCCTGAGGCTGAGCTGCACCGCCCCCGGCTTCA CCAGCAACAGCTGCATGGACTGGTACAGGCAGGCCCCCGGCAAGGAGAGGGAGTT CGTGAGCAGCATCAGCACCGACGGCACCACCGGCTACGCCGACAGCGTGAAGGGCAGG TTCACCATCAGCAAGGACAAGGCCAAGGACACCGTGTACCTGCAGATGAACAGCCTGA AGCCCGAGGACACCGGCATGTACAGCTGCAAGACCAAGGACGGCACCATCGCCACCAT GGAGCTGTGCGACTTCGGCTACTGGGGCCAGGGCACCCAGGTGACCGTGAGCGCTAGC CACCACCACCACCACCACCAC |
| 153 | CAGGTGCAGCTGCAGGAGAGCGGCGGCGGCCTGGTGCAGCCCGGCGGCAGCCTGAGGC TGAGCTGCGCCGCCAGCGGCTTCACCTTCAGCAGCTACCCCATGAGCTGGGTGAGGCA GGCCCCCGGCAAGGGCCTGGAGTGGATCAGCACCATCAGCGCCGGCGGCGACACCACC CTGTACGCCGACAGCGTGAAGGGCAGGTTCACCAGCAGCAGGGACAACGCCAAGAAC ACCCTGTACCTGCAGCTGAACAGCCTGAAGACCGAGGACGCCGCCATCTACTACTGCG CCAAGAGGATCGACTGCAACAGCGGCTACTGCTACAGGAGGAACTACTGGGGCCAGGG CACCCAGGTGACCGTCTCGAGTGGCGGCGGATCCCAGGTGCAGCTGCAGGAGAGCGGC GGCGGCAGCGTGCAGGCCGGCGGCAGCCTGAGGCTGAGCTGCGCCGCCAGCGGCTACC CCTACAGCAACGGCTACATGGGCTGGTTCAGGCAGGCCCCCGGCAAGGAGAGGGAGGG CGTGGCCACCATCTACACCGGCGACGGCAGGACCTACTACGCCGACAGCGTGAAGGGC AGGTTCACCATCAGCAGGGACAACGCCAAGAACACCGTGGACCTGCAGATGAGCAGCC TGAAGCCCGAGGACACCGCCATGTACTACTGCGCCGCCAGGGCCGCCCCCCTGTACAG CAGCGGCAGCCCCCTGACCAGGGCCAGGTACAACGTGTGGGGCCAGGGCACCCAGGTG ACCGTGAGCGCTAGCCACCACCACCACCACCACCAC |
| 154 | CAGGTGCAGCTGCAGGAGAGCGGCGGCGGCCTGGTGCAGCCCGGCGGCAGCCTGAGGC TGAGCTGCGCCGCCAGCGGCTTCACCTTCAGCAGCTACCCCATGAGCTGGGTGAGGCA GGCCCCCGGCAAGGGCCTGGAGTGGATCAGCACCATCAGCGCCGGCGGCGACACCACC CTGTACGCCGACAGCGTGAAGGGCAGGTTCACCAGCAGCAGGGACAACGCCAAGAAC ACCCTGTACCTGCAGCTGAACAGCCTGAAGACCGAGGACGCCGCCATCTACTACTGCG CCAAGAGGATCGACTGCAACAGCGGCTACTGCTACAGGAGGAACTACTGGGGCCAGGG CACCCAGGTGACCGTCTCGAGTGGCGGCGGATCCCAGGTGCAGCTGCAGGAGAGCGGC |

TABLE 3C-continued

| SEQ ID NO | Sequence |
|---|---|
| | GGCGGCAGCGTGCAGGCCGGCGGCAGCCTGAGGCTGAGCTGCGTGGCCAGCGCCAGCA<br>CCTACTGCACCTACGACATGCACTGGTACAGGCAGGCCCCCGGCAAGGGCAGGGAGTT<br>CGTGAGCGCCATCGACAGCGACGGCACCACCAGGTACGCCGACAGCGTGAAGGGCAG<br>GTTCACCATCAGCCAGGGCACCGCCAAGAACACCGTGTACCTGCAGATGAACAGCCTG<br>CAGCCCGAGGACACCGCCATGTACTACTGCAAGACCGTGTGCGTGGTGGGCAGCAGGT<br>GGAGCGACTACTGGGGCCAGGGCACCCAGGTGACCGTGAGCGCTAGCCACCACCACCA<br>CCACCACCACCAC |
| 155 | CAGGTGCAGCTGCAGGAGAGCGGCGGCGGCCTGGTGCAGCCCGGCGGCAGCCTGAGGC<br>TGAGCTGCGCCGCCAGCGGCTTCACCTTCAGCAGCTACCCCATGAGCTGGGTGAGGCA<br>GGCCCCCGGCAAGGGCCTGGAGTGGATCAGCACCATCAGCGCCGGCGGCGACACCACC<br>CTGTACGCCGACAGCGTGAAGGGCAGGTTCACCAGCAGCAGGGACAACGCCAAGAAC<br>ACCCTGTACCTGCAGCTGAACAGCCTGAAGACCGAGGACGCCGCCATCTACTACTGCG<br>CCAAGAGGATCGACTGCAACAGCGGCTACTGCTACAGGAGGAACTACTGGGGCCAGGG<br>CACCCAGGTGACCGTCTCGAGTGGCGGCGGATCCCAGGTGCAGCTGCAGGAGAGCGGC<br>GGCGGCAGCGTGCAGGCCGGCGGCAGCCTGACCCTGAGCTGCGCCGCCAGCGAGTACG<br>CCTACAGCACCTGCAACATGGGCTGGTACAGGCAGGCCCCCGGCAAGGAGAGGGAGCT<br>GGTGAGCGCCTTCATCAGCGACGGCAGCACCTACTACGCCGACAGCGTGAAGGGCAGG<br>TTCACCATCACCAGGGACAACGCCAAGAACACCGTGTACCTGCAGATGAACAGCCTGA<br>AGCCCGAGGACACCGCCATCTACTACTGCAGCGCCAACTGCTACAGGAGGCTGAGGAA<br>CTACTGGGGCCAGGGCACCCAGGTGACCGTGAGCGCTAGCCACCACCACCACCACCAC<br>CACCAC |
| 156 | CAGGTGCAGCTGCAGGAGAGCGGCGGCGGCCTGGTGCAGCCCGGCGGCAGCCTGAGGC<br>TGAGCTGCGCCGCCAGCGGCTTCACCTTCAGCAGCTACCCCATGAGCTGGGTGAGGCA<br>GGCCCCCGGCAAGGGCCTGGAGTGGATCAGCACCATCAGCGCCGGCGGCGACACCACC<br>CTGTACGCCGACAGCGTGAAGGGCAGGTTCACCAGCAGCAGGGACAACGCCAAGAAC<br>ACCCTGTACCTGCAGCTGAACAGCCTGAAGACCGAGGACGCCGCCATCTACTACTGCG<br>CCAAGAGGATCGACTGCAACAGCGGCTACTGCTACAGGAGGAACTACTGGGGCCAGGG<br>CACCCAGGTGACCGTCTCGAGTGGCGGCGGATCCCAGGTGCAGCTGCAGGAGAGCGGC<br>GGCGGCCTGGTGCAGCCCGGCGGCAGCCTGAGGCTGAGCTGCACCGCCAGCGGCCTGA<br>CCTTCGACGACAGCGTGATGGGCTGGTTCAGGCAGGCCCCCGGCAAGGGCAGGGAGGC<br>CGTGAGCTGCATCAGCAGCAGCGGCGCCAACGCCTTCTACGCCGACAGCGTGAAGGGC<br>AGGTTCACCATCAGCAGGGACAACGCCAAGAACACCCTGTACCTGCAGATGAACAGCC<br>TGAAGCCCGAGGACACCGCCACCTACTACTGCAAGAGGGCCACGCCTGCGCCGGCTA<br>CTACCCCATCCCCTACGACGACTACTGGGGCCAGGGCACCCAGGTGACCGTGAGCGCT<br>AGCCACCACCACCACCACCACCAC |
| 157 | CAGGTGCAGCTGCAGGAGAGCGGCGGCGGCCTGGTGCAGCCCGGCGAGAGCCTGAGG<br>CTGAGCTGCACCGCCAGCGGCTTCACCTTCAGCAACTACGCCATGAGCTGGGTGAGGC<br>AGGCCCCCGGCAAGGGCCTGGAGTGGGTGAGCGGCATCAACGTGGCCTACGGCATCAC<br>CAGCTACGCCGACAGCGTGAAGGGCAGGTTCACCATCAGCAGGGACAACACCAAGAAC<br>ACCCTGTACCTGCAGCTGAACAGCCTGAAGACCGAGGACACCGCCATCTACTACTGCGT<br>GAAGCACAGCGGCACCACCATCCCCAGGGGCTTCATCAGCTACACCAAGAGGGGCCAG<br>GGCACCCAGGTGACCGTCTCGAGTGGCGGCGGATCCCAGGTGCAGCTGCAGGAGAGCG<br>GCGGCGGCAGCGTGCAGGCCGGCGGCAGCCTGAGGCTGAGCTGCACCGCCAGCGGCGC<br>CATCGCCAGCGGCTACATCGACAGCAGGTGGTGCATGGCCTGGTTCAGGCAGGCCCCC<br>GGCAAGGAGAGGGAGGGCGTGGCCGCCATCTGGCCCGGCGGCGGCCTGACCGTGTACG<br>CCGACAGCGTGAAGGGCAGGTTCACCATCAGCAGGGACCACGCCAAGAACACCCTGTA<br>CCTGCAGATGAACAACCTGAAGCCCGAGGACACCGCCATGTACTACTGCGCCGCCGGC<br>AGCCCCAGGATGTGCCCCAGCCTGGAGTTCGGCTTCGACTACTGGGGCCAGGGCACCC<br>AGGTGACCGTGAGCGCTAGCCACCACCACCACCACCACCAC |
| 158 | CAGGTGCAGCTGCAGGAGAGCGGCGGCGGCCTGGTGCAGCCCGGCGAGAGCCTGAGG<br>CTGAGCTGCACCGCCAGCGGCTTCACCTTCAGCAACTACGCCATGAGCTGGGTGAGGC<br>AGGCCCCCGGCAAGGGCCTGGAGTGGGTGAGCGGCATCAACGTGGCCTACGGCATCAC<br>CAGCTACGCCGACAGCGTGAAGGGCAGGTTCACCATCAGCAGGGACAACACCAAGAAC<br>ACCCTGTACCTGCAGCTGAACAGCCTGAAGACCGAGGACACCGCCATCTACTACTGCGT<br>GAAGCACAGCGGCACCACCATCCCCAGGGGCTTCATCAGCTACACCAAGAGGGGCCAG<br>GGCACCCAGGTGACCGTCTCGAGTGGCGGCGGATCCCAGGTGCAGCTGCAGGAGAGCG<br>GCGGCGGCAGCGTGCAGGCCGGCGGCAGCCTGAGGCTGAGCTGCACCGCCCCCGGCTT<br>CACCAGCAACAGCTGCGGCATGGACTGGTACAGGCAGGCCCCCGGCAAGGAGAGGGA<br>GTTCGTGAGCAGCATCAGCACCGACGGCACCACCGGCTACGCCGACAGCGTGAAGGGC<br>AGGTTCACCATCAGCAAGGACAAGGCCAAGGACACCGTGTACCTGCAGATGAACAGCC<br>TGAAGCCCGAGGACACCGGCATGTACAGCTGCAAGACCAAGGACGGCACCATCGCCAC<br>CATGGAGCTGTGCGACTTCGGCTACTGGGGCCAGGGCACCCAGGTGACCGTGAGCGCT<br>AGCCACCACCACCACCACCACCAC |
| 159 | CAGGTGCAGCTGCAGGAGAGCGGCGGCGGCCTGGTGCAGCCCGGCGAGAGCCTGAGG<br>CTGAGCTGCACCGCCAGCGGCTTCACCTTCAGCAACTACGCCATGAGCTGGGTGAGGC<br>AGGCCCCCGGCAAGGGCCTGGAGTGGGTGAGCGGCATCAACGTGGCCTACGGCATCAC<br>CAGCTACGCCGACAGCGTGAAGGGCAGGTTCACCATCAGCAGGGACAACACCAAGAAC<br>ACCCTGTACCTGCAGCTGAACAGCCTGAAGACCGAGGACACCGCCATCTACTACTGCGT<br>GAAGCACAGCGGCACCACCATCCCCAGGGGCTTCATCAGCTACACCAAGAGGGGCCAG<br>GGCACCCAGGTGACCGTCTCGAGTGGCGGCGGATCCCAGGTGCAGCTGCAGGAGAGCG<br>GCGGCGGCAGCGTGCAGGCCGGCGGCAGCCTGAGGCTGAGCTGCGCCGCCAGCGGCTA |

TABLE 3C-continued

| SEQ ID NO | Sequence |
|---|---|
| | CCCCTACAGCAACGGCTACATGGGCTGGTTCAGGCAGGCCCCCGGCAAGGAGAGGGAG<br>GGCGTGGCCACCATCTACACCGGCGACGGCAGGACCTACTACGCCGACAGCGTGAAGG<br>GCAGGTTCACCATCAGCAGGGACAACGCCAAGAACACCGTGGACCTGCAGATGAGCAG<br>CCTGAAGCCCGAGGACACCGCCATGTACTACTGCGCCGCCAGGGCCGCCCCCCTGTAC<br>AGCAGCGGCAGCCCCCTGACCAGGGCCAGGTACAACGTGTGGGGCCAGGGCACCCAGG<br>TGACCGTGAGCGCTAGCCACCACCACCACCACCACCAC |
| 160 | CAGGTGCAGCTGCAGGAGAGCGGCGGCGGCCTGGTGCAGCCCGGCGAGAGCCTGAGG<br>CTGAGCTGCACCGCCAGCGGCTTCACCTTCAGCAACTACGCCATGAGCTGGGTGAGGC<br>AGGCCCCCGGCAAGGGCCTGGAGTGGGTGAGCGGCATCAACGTGGCCTACGGCATCAC<br>CAGCTACGCCGACAGCGTGAAGGGCAGGTTCACCATCAGCAGGGACAACACCAAGAAC<br>ACCCTGTACCTGCAGCTGAACAGCCTGAAGACCGAGGACACCGCCATCTACTACTGCGT<br>GAAGCACAGCGGCACCACCATCCCCAGGGGCTTCATCAGCTACACCAAGAGGGGCCAG<br>GGCACCCAGGTGACCGTCTCGAGTGGCGGCGGATCCCAGGTGCAGCTGCAGGAGAGCG<br>GCGGCGGCAGCGTGCAGGCCGGCGGCAGCCTGAGGCTGAGCTGCGTGGCCAGCGCCAG<br>CACCTACTGCACCTACGACATGCACTGGTACAGGCAGGCCCCCGGCAAGGGCAGGGAG<br>TTCGTGAGCGCCATCGACAGCGACGGCACCACCAGGTACGCCGACAGCGTGAAGGGCA<br>GGTTCACCATCAGCCAGGGCACCGCCAAGAACACCGTGTACCTGCAGATGAACAGCCT<br>GCAGCCCGAGGACACCGCCATGTACTACTGCAAGACCGTGTGCGTGGTGGGCAGCAGG<br>TGGAGCGACTACTGGGGCCAGGGCACCCAGGTGACCGTGAGCGCTAGCCACCACCACC<br>ACCACCACCACCAC |
| 161 | CAGGTGCAGCTGCAGGAGAGCGGCGGCGGCCTGGTGCAGCCCGGCGAGAGCCTGAGG<br>CTGAGCTGCACCGCCAGCGGCTTCACCTTCAGCAACTACGCCATGAGCTGGGTGAGGC<br>AGGCCCCCGGCAAGGGCCTGGAGTGGGTGAGCGGCATCAACGTGGCCTACGGCATCAC<br>CAGCTACGCCGACAGCGTGAAGGGCAGGTTCACCATCAGCAGGGACAACACCAAGAAC<br>ACCCTGTACCTGCAGCTGAACAGCCTGAAGACCGAGGACACCGCCATCTACTACTGCGT<br>GAAGCACAGCGGCACCACCATCCCCAGGGGCTTCATCAGCTACACCAAGAGGGGCCAG<br>GGCACCCAGGTGACCGTCTCGAGTGGCGGCGGATCCCAGGTGCAGCTGCAGGAGAGCG<br>GCGGCGGCAGCGTGCAGGCCGGCGGCAGCCTGACCCTGAGCTGCGCCGCCAGCGAGTA<br>CGCCTACAGCACCTGCAACATGGGCTGGTACAGGCAGGCCCCCGGCAAGGAGAGGGAG<br>CTGGTGAGCGCCTTCATCAGCGACGGCAGCACCTACTACGCCGACAGCGTGAAGGGCA<br>GGTTCACCATCACCAGGGACAACGCCAAGAACACCGTGTACCTGCAGATGAACAGCCT<br>GAAGCCCGAGGACACCGCCATCTACTACTGCAGCGCCAACTGCTACAGGAGGCTGAGG<br>AACTACTGGGGCCAGGGCACCCAGGTGACCGTGAGCGCTAGCCACCACCACCACCACC<br>ACCACCAC |
| 162 | CAGGTGCAGCTGCAGGAGAGCGGCGGCGGCCTGGTGCAGCCCGGCGAGAGCCTGAGG<br>CTGAGCTGCACCGCCAGCGGCTTCACCTTCAGCAACTACGCCATGAGCTGGGTGAGGC<br>AGGCCCCCGGCAAGGGCCTGGAGTGGGTGAGCGGCATCAACGTGGCCTACGGCATCAC<br>CAGCTACGCCGACAGCGTGAAGGGCAGGTTCACCATCAGCAGGGACAACACCAAGAAC<br>ACCCTGTACCTGCAGCTGAACAGCCTGAAGACCGAGGACACCGCCATCTACTACTGCGT<br>GAAGCACAGCGGCACCACCATCCCCAGGGGCTTCATCAGCTACACCAAGAGGGGCCAG<br>GGCACCCAGGTGACCGTCTCGAGTGGCGGCGGATCCCAGGTGCAGCTGCAGGAGAGCG<br>GCGGCGGCCTGGTGCAGCCCGGCGGCAGCCTGAGGCTGAGCTGCACCGCCAGCGGCCT<br>GACCTTCGACGACAGCGTGATGGGCTGGTTCAGGCAGGCCCCCGGCAAGGGCAGGGAG<br>GCCGTGAGCTGCATCAGCAGCAGCGGCGCCAACGCCTTCTACGCCGACAGCGTGAAGG<br>GCAGGTTCACCATCAGCAGGGACAACGCCAAGAACACCCTGTACCTGCAGATGAACAG<br>CCTGAAGCCCGAGGACACCGCCACCTACTACTGCAAGAGGGGCCACGCCTGCGCCGGC<br>TACTACCCCATCCCCTACGACGACTACTGGGGCCAGGGCACCCAGGTGACCGTGAGCG<br>CTAGCCACCACCACCACCACCACCAC |
| 163 | CAGGTGCAGCTGCAGGAGAGCGGCGGCGGCCTGGTGCAGCCCGGCGGCAGCCTGAGGC<br>TGAGCTGCGCCGCCAGCGGCTTCAGCTTCAGCAGCTACGCCATGAAGTGGGTGAGGCA<br>GGCCCCCGGCAAGGGCCTGGAGTGGGTGAGCACCATCAGCAGCGGCGGCAGCAGCACC<br>AACTACGCCGACAGCGTGAAGGGCAGGTTCACCATCAGCAGGGACAACGCCAAGAAC<br>ACCCTGTACCTGCAGCTGAACAGCCTGAAGATCGAGGACACCGCCATGTACTACTGCG<br>CCAAGGCCATCGTGCCCACCGGCGCCACCATGGAGAGGGCCAGGGCACCCAGGTGAC<br>CGTCTCGAGTGGCGGCGGATCCCAGGTGCAGCTGCAGGAGAGCGGCGGCGGCAGCGTG<br>CAGGCCGGCGGCAGCCTGAGGCTGAGCTGCACCGCCAGCGGCGCCATCGCCAGCGGCT<br>ACATCGACAGCAGGTGGTGCATGGCCTGGTTCAGGCAGGCCCCCGGCAAGGAGAGGGA<br>GGGCGTGGCCGCCATCTGGCCCGGCGGCGGCCTGACCGTGTACGCCGACAGCGTGAAG<br>GGCAGGTTCACCATCAGCAGGGACCACGCCAAGAACACCCTGTACCTGCAGATGAACA<br>ACCTGAAGCCCGAGGACACCGCCATGTACTACTGCGCCGCCGGCAGCCCCAGGATGTG<br>CCCCAGCCTGGAGTTCGGCTTCGACTACTGGGGCCAGGGCACCCAGGTGACCGTGAGC<br>GCTAGCCACCACCACCACCACCACCAC |
| 164 | CAGGTGCAGCTGCAGGAGAGCGGCGGCGGCCTGGTGCAGCCCGGCGGCAGCCTGAGGC<br>TGAGCTGCGCCGCCAGCGGCTTCAGCTTCAGCAGCTACGCCATGAGTGGGTGAGGCA<br>GGCCCCCGGCAAGGGCCTGGAGTGGGTGAGCACCATCAGCAGCGGCGGCAGCAGCACC<br>AACTACGCCGACAGCGTGAAGGGCAGGTTCACCATCAGCAGGGACAACGCCAAGAAC<br>ACCCTGTACCTGCAGCTGAACAGCCTGAAGATCGAGGACACCGCCATGTACTACTGCG<br>CCAAGGCCATCGTGCCCACCGGCGCCACCATGGAGAGGGCCAGGGCACCCAGGTGAC<br>CGTCTCGAGTGGCGGCGGATCCCAGGTGCAGCTGCAGGAGAGCGGCGGCGGCAGCGTG<br>CAGGCCGGCGGCAGCCTGAGGCTGAGCTGCACCGCCCCCGGCTTCACCAGCAACAGCT<br>GCGGCATGGACTGGTACAGGCAGGCCCCCGGCAAGGAGAGGGAGTTCGTGAGCAGCAT |

TABLE 3C-continued

| SEQ ID NO | Sequence |
|---|---|
|  | CAGCACCGACGGCACCACCGGCTACGCCGACAGCGTGAAGGGCAGGTTCACCATCAGC<br>AAGGACAAGGCCAAGGACACCGTGTACCTGCAGATGAACAGCCTGAAGCCCGAGGAC<br>ACCGGCATGTACAGCTGCAAGACCAAGGACGGCACCATCGCCACCATGGAGCTGTGCG<br>ACTTCGGCTACTGGGCCAGGGCACCCAGGTGACCGTGAGCGCTAGCCACCACCACCA<br>CCACCACCACCAC |
| 165 | CAGGTGCAGCTGCAGGAGAGCGGCGGCGGCCTGGTGCAGCCCGGCGGCAGCCTGAGGC<br>TGAGCTGCGCCGCCAGCGGCTTCAGCTTCAGCAGCTACGCCATGAAGTGGGTGAGGCA<br>GGCCCCCGGCAAGGGCCTGGAGTGGGTGAGCACCATCAGCAGCGGCGGCAGCAGCACC<br>AACTACGCCGACAGCGTGAAGGGCAGGTTCACCATCAGCAGGGACAACGCCAAGAAC<br>ACCCTGTACCTGCAGCTGAACAGCCTGAAGATCGAGGACACCGCCATGTACTACTGCG<br>CCAAGGCCATCGTGCCCACCGGCGCCACCATGGAGAGGGGCCAGGGCACCCAGGTGAC<br>CGTCTCGAGTGGCGGCGGATCCCAGGTGCAGCTGCAGGAGAGCGGCGGCGGCAGCGTG<br>CAGGCCGGCGGCAGCCTGAGGCTGAGCTGCGCCGCCAGCGGCTACCCCTACAGCAACG<br>GCTACATGGGCTGGTTCAGGCAGGCCCCCGGCAAGGAGAGGGAGGGCGTGGCCACCAT<br>CTACACCGGCGACGGCAGGACCTACTACGCCGACAGCGTGAAGGGCAGGTTCACCATC<br>AGCAGGGACAACGCCAAGAACACCGTGGACCTGCAGATGAGCAGCCTGAAGCCCGAG<br>GACACCGCCATGTACTACTGCGCCGCCAGGGCCGCCCCCCTGTACAGCAGCGGCAGCC<br>CCTGACCAGGGCCAGGTACAACGTGTGGGCCAGGGCACCCAGGTGACCGTGAGCGC<br>TAGCCACCACCACCACCACCACCAC |
| 166 | CAGGTGCAGCTGCAGGAGAGCGGCGGCGGCCTGGTGCAGCCCGGCGGCAGCCTGAGGC<br>TGAGCTGCGCCGCCAGCGGCTTCAGCTTCAGCAGCTACGCCATGAAGTGGGTGAGGCA<br>GGCCCCCGGCAAGGGCCTGGAGTGGGTGAGCACCATCAGCAGCGGCGGCAGCAGCACC<br>AACTACGCCGACAGCGTGAAGGGCAGGTTCACCATCAGCAGGGACAACGCCAAGAAC<br>ACCCTGTACCTGCAGCTGAACAGCCTGAAGATCGAGGACACCGCCATGTACTACTGCG<br>CCAAGGCCATCGTGCCCACCGGCGCCACCATGGAGAGGGGCCAGGGCACCCAGGTGAC<br>CGTCTCGAGTGGCGGCGGATCCCAGGTGCAGCTGCAGGAGAGCGGCGGCGGCAGCGTG<br>CAGGCCGGCGGCAGCCTGAGGCTGAGCTGCGTGGCCAGCGCCAGCACCTACTGCACCT<br>ACGACATGCACTGGTACAGGCAGGCCCCCGGCAAGGGCAGGGAGTTCGTGAGCGCCAT<br>CGACAGCGACGGCACCACCAGGTACGCCGACAGCGTGAAGGGCAGGTTCACCATCAGC<br>CAGGGCACCGCCAAGAACACCGTGTACCTGCAGATGAACAGCCTGCAGCCCGAGGACA<br>CCGCCATGTACTACTGCAAGACCGTGTGCGTGGTGGGCAGCAGGTGGAGCGACTACTG<br>GGGCCAGGGCACCCAGGTGACCGTGAGCGCTAGCCACCACCACCACCACCACCACCAC |
| 167 | CAGGTGCAGCTGCAGGAGAGCGGCGGCGGCCTGGTGCAGCCCGGCGGCAGCCTGAGGC<br>TGAGCTGCGCCGCCAGCGGCTTCAGCTTCAGCAGCTACGCCATGAAGTGGGTGAGGCA<br>GGCCCCCGGCAAGGGCCTGGAGTGGGTGAGCACCATCAGCAGCGGCGGCAGCAGCACC<br>AACTACGCCGACAGCGTGAAGGGCAGGTTCACCATCAGCAGGGACAACGCCAAGAAC<br>ACCCTGTACCTGCAGCTGAACAGCCTGAAGATCGAGGACACCGCCATGTACTACTGCG<br>CCAAGGCCATCGTGCCCACCGGCGCCACCATGGAGAGGGGCCAGGGCACCCAGGTGAC<br>CGTCTCGAGTGGCGGCGGATCCCAGGTGCAGCTGCAGGAGAGCGGCGGCGGCAGCGTG<br>CAGGCCGGCGGCAGCCTGACCCTGAGCTGCGCCGCCAGCGAGTACGCCTACAGCACCT<br>GCAACATGGGCTGGTACAGGCAGGCCCCCGGCAAGGAGAGGGAGCTGGTGAGCGCCTT<br>CATCAGCGACGGCAGCACCTACTACGCCGACAGCGTGAAGGGCAGGTTCACCATCACC<br>AGGGACAACGCCAAGAACACCGTGTACCTGCAGATGAACAGCCTGAAGCCCGAGGAC<br>ACCGCCATCTACTACTGCAGCGCCAACTGCTACAGGAGGCTGAGGAACTACTGGGGCC<br>AGGGCACCCAGGTGACCGTGAGCGCTAGCCACCACCACCACCACCACCAC |
| 168 | CAGGTGCAGCTGCAGGAGAGCGGCGGCGGCCTGGTGCAGCCCGGCGGCAGCCTGAGGC<br>TGAGCTGCGCCGCCAGCGGCTTCAGCTTCAGCAGCTACGCCATGAAGTGGGTGAGGCA<br>GGCCCCCGGCAAGGGCCTGGAGTGGGTGAGCACCATCAGCAGCGGCGGCAGCAGCACC<br>AACTACGCCGACAGCGTGAAGGGCAGGTTCACCATCAGCAGGGACAACGCCAAGAAC<br>ACCCTGTACCTGCAGCTGAACAGCCTGAAGATCGAGGACACCGCCATGTACTACTGCG<br>CCAAGGCCATCGTGCCCACCGGCGCCACCATGGAGAGGGGCCAGGGCACCCAGGTGAC<br>CGTCTCGAGTGGCGGCGGATCCCAGGTGCAGCTGCAGGAGAGCGGCGGCGGCCTGGTG<br>CAGCCCGGCGGCAGCCTGAGGCTGAGCTGCACCGCCAGCGGCCTGACCTTCGACGACA<br>GCGTGATGGGCTGGTTCAGGCAGGCCCCCGGCAAGGGCAGGGAGGCCGTGAGCTGCAT<br>CAGCAGCAGCGGCGCCAACGCCTTCTACGCCGACAGCGTGAAGGGCAGGTTCACCATC<br>AGCAGGGACAACGCCAAGAACACCCTGTACCTGCAGATGAACAGCCTGAAGCCCGAGG<br>ACACCGCCACCTACTACTGCAAGAGGGGCCACGCCTGCGCCGGCTACTACCCCATCCCC<br>TACGACGACTACTGGGGCCAGGGCACCCAGGTGACCGTGAGCGCTAGCCACCACCACC<br>ACCACCACCACCAC |
| 169 | CAGGTGCAGCTGCAGGAGAGCGGCGGCGGCAGCGTGCAGAGCGGCGGCAGCCTGAGG<br>CTGAGCTGCGCCGCCAGCGGCTTCACCTACAGCACCAGCAACAGCTGGATGGCCTGGTT<br>CAGGCAGGCCCCCGGCAAGGAGAGGGAGGGCGTGGCCGCCATCTACACCGTGGGCGG<br>CAGCATCTTCTACGCCGACAGCGTGAGGGGCAGGTTCACCATCAGCCAGGACGCCACC<br>AAGAACATGTTCTACCTGCAGATGAACACCCTGAAGCCCGAGGACACCGCCATGTACT<br>ACTGCGCCGCCGCCAGCGGCAGGCTGAGGGGCAAGTGGTTCTGGCCCTACGAGTACAA<br>CTACTGGGGCCAGGGCACCCAGGTGACCGTCTCGAGTGGCGGCGGATCCCAGGTGCAG<br>CTGCAGGAGAGCGGCGGCGGCAGCGTGCAGGCCGGCGGCAGCCTGAGGCTGAGCTGC<br>ACCGCCAGCGGCGCCATCGCCAGCGGCTACATCGACAGCAGGTGGTGCATGGCCTGGT<br>TCAGGCAGGCCCCCGGCAAGGAGAGGGAGGGCGTGGCCGCCATCTGGCCCGGCGGCG<br>GCCTGACCGTGTACGCCGACAGCGTGAAGGGCAGGTTCACCATCAGCAGGGACCACGC<br>CAAGAACACCCTGTACCTGCAGATGAACAACCTGAAGCCCGAGGACACCGCCATGTAC |

TABLE 3C-continued

| SEQ ID NO | Sequence |
|---|---|
| | TACTGCGCCGCCGGCAGCCCCAGGATGTGCCCCAGCCTGGAGTTCGGCTTCGACTACTG GGGCCAGGGCACCCAGGTGACCGTGAGCGCTAGCCACCACCACCACCACCACCACCAC |
| 170 | CAGGTGCAGCTGCAGGAGAGCGGCGGCGGCAGCGTGCAGAGCGGCGGCAGCCTGAGG CTGAGCTGCGCCGCCAGCGGCTTCACCTACAGCACCAGCAACAGCTGGATGGCCTGGTT CAGGCAGGCCCCCGGCAAGGAGAGGGAGGGCGTGGCCGCCATCTACACCGTGGGCGG CAGCATCTTCTACGCCGACAGCGTGAGGGGCAGGTTCACCATCAGCCAGGACGCCACC AAGAACATGTTCTACCTGCAGATGAACACCCTGAAGCCCGAGGACACCGCCATGTACT ACTGCGCCGCCGCCAGCGGCAGGCTGAGGGGCAAGTGGTTCTGGCCCTACGAGTACAA CTACTGGGGCCAGGGCACCCAGGTGACCGTCTCGAGTGGCGGCGGATCCCAGGTGCAG CTGCAGGAGAGCGGCGGCGGCAGCGTGCAGGCCGGCGGCAGCCTGAGGCTGAGCTGC ACCGCCCCCGGCTTCACCAGCAACAGCTGCGGCATGGACTGGTACAGGCAGGCCCCCG GCAAGGAGAGGGAGTTCGTGAGCAGCATCAGCACCGACGGCAACACCAGGCTACGCCGA CAGCGTGAAGGGCAGGTTCACCATCAGCAAGGACAAGGCCAAGGACACCGTGTACCTG CAGATGAACAGCCTGAAGCCCGAGGACACCGGCATGTACAGCTGCAAGACCAAGGAC GGCACCATCGCCACCATGGAGCTGTGCGACTTCGGCTACTGGGGCCAGGGCACCCAGG TGACCGTGAGCGCTAGCCACCACCACCACCACCACCAC |
| 171 | CAGGTGCAGCTGCAGGAGAGCGGCGGCGGCAGCGTGCAGAGCGGCGGCAGCCTGAGG CTGAGCTGCGCCGCCAGCGGCTTCACCTACAGCACCAGCAACAGCTGGATGGCCTGGTT CAGGCAGGCCCCCGGCAAGGAGAGGGAGGGCGTGGCCGCCATCTACACCGTGGGCGG CAGCATCTTCTACGCCGACAGCGTGAGGGGCAGGTTCACCATCAGCCAGGACGCCACC AAGAACATGTTCTACCTGCAGATGAACACCCTGAAGCCCGAGGACACCGCCATGTACT ACTGCGCCGCCGCCAGCGGCAGGCTGAGGGGCAAGTGGTTCTGGCCCTACGAGTACAA CTACTGGGGCCAGGGCACCCAGGTGACCGTCTCGAGTGGCGGCGGATCCCAGGTGCAG CTGCAGGAGAGCGGCGGCGGCAGCGTGCAGGCCGGCGGCAGCCTGAGGCTGAGCTGC GCCGCCAGCGGCTACCCCTACAGCAACGGCTACATGGGCTGGTTCAGGCAGGCCCCCG GCAAGGAGAGGGAGGGCGTGGCCACCATCTACACCGGCGACGGCAGGACCTACTACGC CGACAGCGTGAAGGGCAGGTTCACCATCAGCAGGGACAACGCCAAGAACACCTTGGA CCTGCAGATGAGCAGCCTGAAGCCCGAGGACACCGCCATGTACTACTGCGCCGCCAGG GCCGCCCCCTGTACAGCAGCGGCAGCCCCTGACCAGGGCCAGGTACAACGTGTGGG GCCAGGGCACCCAGGTGACCGTGAGCGCTAGCCACCACCACCACCACCACCACCAC |
| 172 | CAGGTGCAGCTGCAGGAGAGCGGCGGCGGCAGCGTGCAGAGCGGCGGCAGCCTGAGG CTGAGCTGCGCCGCCAGCGGCTTCACCTACAGCACCAGCAACAGCTGGATGGCCTGGTT CAGGCAGGCCCCCGGCAAGGAGAGGGAGGGCGTGGCCGCCATCTACACCGTGGGCGG CAGCATCTTCTACGCCGACAGCGTGAGGGGCAGGTTCACCATCAGCCAGGACGCCACC AAGAACATGTTCTACCTGCAGATGAACACCCTGAAGCCCGAGGACACCGCCATGTACT ACTGCGCCGCCGCCAGCGGCAGGCTGAGGGGCAAGTGGTTCTGGCCCTACGAGTACAA CTACTGGGGCCAGGGCACCCAGGTGACCGTCTCGAGTGGCGGCGGATCCCAGGTGCAG CTGCAGGAGAGCGGCGGCGGCAGCGTGCAGGCCGGCGGCAGCCTGAGGCTGAGCTGC GTGGCCAGCGCCAGCACCTACTGCACCTACGACATGCACTGGTACAGGCAGGCCCCCG GCAAGGGCAGGGAGTTCGTGAGCGCCATCGACAGCGACGGCACCACCAGGTACGCCGA CAGCGTGAAGGGCAGGTTCACCATCAGCAGGGCACCGCCAAGAACACCGTGTACCTG CAGATGAACAGCCTGCAGCCCGAGGACACCGCCATGTACTACTGCAAGACCGTGTGCG TGGTGGGCAGCAGGTGGAGCGACTACTGGGGCCAGGGCACCCAGGTGACCGTGAGCGC TAGCCACCACCACCACCACCACCAC |
| 173 | CAGGTGCAGCTGCAGGAGAGCGGCGGCGGCAGCGTGCAGAGCGGCGGCAGCCTGAGG CTGAGCTGCGCCGCCAGCGGCTTCACCTACAGCACCAGCAACAGCTGGATGGCCTGGTT CAGGCAGGCCCCCGGCAAGGAGAGGGAGGGCGTGGCCGCCATCTACACCGTGGGCGG CAGCATCTTCTACGCCGACAGCGTGAGGGGCAGGTTCACCATCAGCCAGGACGCCACC AAGAACATGTTCTACCTGCAGATGAACACCCTGAAGCCCGAGGACACCGCCATGTACT ACTGCGCCGCCGCCAGCGGCAGGCTGAGGGGCAAGTGGTTCTGGCCCTACGAGTACAA CTACTGGGGCCAGGGCACCCAGGTGACCGTCTCGAGTGGCGGCGGATCCCAGGTGCAG CTGCAGGAGAGCGGCGGCGGCAGCGTGCAGGCCGGCGGCAGCCTGACCCTGAGCTGCG CCGCCAGCGAGTACGCCTACAGCACCTGCAACATGGGCTGGTACAGGCAGGCCCCCGG CAAGGAGAGGGAGCTGGTGAGCGCCTTCATCAGCACGGCAGCACCTACTACGCCGAC AGCGTGAAGGGCAGGTTCACCATCACCAGGGACAACGCCAAGAACACCGTGTACCTGC AGATGAACAGCCTGAAGCCCGAGGACACCGCCATCTACTACTGCAGCGCCAACTGCTA CAGGAGGCTGAGGAACTACTGGGGCCAGGGCACCCAGGTGACCGTGAGCGCTAGCCAC CACCACCACCACCACCACCAC |
| 174 | CAGGTGCAGCTGCAGGAGAGCGGCGGCGGCAGCGTGCAGAGCGGCGGCAGCCTGAGG CTGAGCTGCGCCGCCAGCGGCTTCACCTACAGCACCAGCAACAGCTGGATGGCCTGGTT CAGGCAGGCCCCCGGCAAGGAGAGGGAGGGCGTGGCCGCCATCTACACCGTGGGCGG CAGCATCTTCTACGCCGACAGCGTGAGGGGCAGGTTCACCATCAGCCAGGACGCCACC AAGAACATGTTCTACCTGCAGATGAACACCCTGAAGCCCGAGGACACCGCCATGTACT ACTGCGCCGCCGCCAGCGGCAGGCTGAGGGGCAAGTGGTTCTGGCCCTACGAGTACAA CTACTGGGGCCAGGGCACCCAGGTGACCGTCTCGAGTGGCGGCGGATCCCAGGTGCAG CTGCAGGAGAGCGGCGGCGGCCTGGTGCAGCCCGGCGGCAGCCTGAGGCTGAGCTGCA CCGCCAGCGGCCTGACCTTCGACGACAGCGTGATGGGCTGGTTCAGGCAGGCCCCCGG CAAGGGCAGGGAGGCCGTGAGCTGCATCAGCAGCAGCGGCGCCAACGCCTTCTACGCC GACAGCGTGAAGGGCAGGTTCACCATCAGCAGGGACAACGCCAAGAACACCCTGTACC TGCAGATGAACAGCCTGAAGCCCGAGGACACCGCCACCTACTACTGCAAGAGGGGCCA |

TABLE 3C-continued

| SEQ ID NO | Sequence |
|---|---|
| | CGCCTGCGCCGGCTACTACCCCATCCCCTACGACGACTACTGGGGCCAGGGCACCCAG<br>GTGACCGTGAGCGCTAGCCACCACCACCACCACCACCAC |
| 175 | CAGGTGCAGCTGCAGGAGAGCGGCGGCGGCAGCGTGCAGGCCGGCGGCAGCCTGAGG<br>CTGAGCTGCGTGGCCAGCGGCTACGTGAGCTGCGACTACTTCCTGCCCAGCTGGTACAG<br>GCAGGCCCCCGGCAAGGAGGGAGTTCGTGAGCATCATCGACGGCACCGGCAGCACC<br>AGCTACGCCGCCAGCGTGAAGGGCAGGTTCACCGCCAGCCAGGACAAGGGCAAGAAC<br>ATCGCCTACCTGCAGATGAACACCCTGAAGCCCGAGGACACCGCCATGTACTACTGCA<br>AGGCCAGCTGCGTGAGGGGCAGGGCCATCAGCGAGTACTGGGGCCAGGGCACCCAGGT<br>GACCGTCTCGAGTGGCGGCGGATCCCAGGTGCAGCTGCAGGAGAGCGGCGGCGGCAGC<br>GTGCAGGCCGGCGGCAGCCTGAGGCTGAGCTGCACCGCCAGCGGCGCCATCGCCAGCG<br>GCTACATCGACAGCAGGTGGTGCATGGCCTGGTTCAGGCAGGCCCCCGGCAAGGAGAG<br>GGAGGGCGTGGCCGCCATCTGGCCCGGCGGCGGCCTGACCGTGTACGCCGACAGCGTG<br>AAGGGCAGGTTCACCATCAGCAGGGACCACGCCAAGAACACCCTGTACCTGCAGATGA<br>ACAACCTGAAGCCCGAGGACACCGCCATGTACTACTGCGCCGCCGGCAGCCCCAGGAT<br>GTGCCCCAGCCTGGAGTTCGGCTTCGACTACTGGGGCCAGGGCACCCAGGTGACCGTG<br>AGCGCTAGCCACCACCACCACCACCACCAC |
| 176 | CAGGTGCAGCTGCAGGAGAGCGGCGGCGGCAGCGTGCAGGCCGGCGGCAGCCTGAGG<br>CTGAGCTGCGTGGCCAGCGGCTACGTGAGCTGCGACTACTTCCTGCCCAGCTGGTACAG<br>GCAGGCCCCCGGCAAGGAGAGGGAGTTCGTGAGCATCATCGACGGCACCGGCAGCACC<br>AGCTACGCCGCCAGCGTGAAGGGCAGGTTCACCGCCAGCCAGGACAAGGGCAAGAAC<br>ATCGCCTACCTGCAGATGAACACCCTGAAGCCCGAGGACACCGCCATGTACTACTGCA<br>AGGCCAGCTGCGTGAGGGGCAGGGCCATCAGCGAGTACTGGGGCCAGGGCACCCAGGT<br>GACCGTCTCGAGTGGCGGCGGATCCCAGGTGCAGCTGCAGGAGAGCGGCGGCGGCAGC<br>GTGCAGGCCGGCGGCAGCCTGAGGCTGAGCTGCACCGCCCCCGGCTTCACCAGCAACA<br>GCTGCGGCATGGACTGGTACAGGCAGGCCCCCGGCAAGGAGAGGGAGTTCGTGAGCAG<br>CATCAGCACCGACGGCACCACCGGCTACGCCGACAGCGTGAAGGGCAGGTTCACCATC<br>AGCAAGGACAAGGCCAAGGACACCGTGTACCTGCAGATGAACAGCCTGAAGCCCGAG<br>GACACCGGCATGTACAGCTGCAAGACCAAGGACGGCACCATCGCCACCATGGAGCTGT<br>GCGACTTCGGCTACTGGGGCCAGGGCACCCAGGTGACCGTGAGCGCTAGCCACCACCA<br>CCACCACCACCACCAC |
| 177 | CAGGTGCAGCTGCAGGAGAGCGGCGGCGGCAGCGTGCAGGCCGGCGGCAGCCTGAGG<br>CTGAGCTGCGTGGCCAGCGGCTACGTGAGCTGCGACTACTTCCTGCCCAGCTGGTACAG<br>GCAGGCCCCCGGCAAGGAGAGGGAGTTCGTGAGCATCATCGACGGCACCGGCAGCACC<br>AGCTACGCCGCCAGCGTGAAGGGCAGGTTCACCGCCAGCCAGGACAAGGGCAAGAAC<br>ATCGCCTACCTGCAGATGAACACCCTGAAGCCCGAGGACACCGCCATGTACTACTGCA<br>AGGCCAGCTGCGTGAGGGGCAGGGCCATCAGCGAGTACTGGGGCCAGGGCACCCAGGT<br>GACCGTCTCGAGTGGCGGCGGATCCCAGGTGCAGCTGCAGGAGAGCGGCGGCGGCAGC<br>GTGCAGGCCGGCGGCAGCCTGAGGCTGAGCTGCGCCGCCAGCGGCTACCCCTACAGCA<br>ACGGCTACATGGGCTGGTTCAGGCAGGCCCCCGGCAAGGAGAGGGCGTGGCCAC<br>CATCTACACCGGCGACGGCAGGACCTACTACGCCGACAGCGTGAAGGGCAGGTTCACC<br>ATCAGCAGGGACAACGCCAAGAACACCGTGGACCTGCAGATGAGCAGCCTGAAGCCCG<br>AGGACACCGCCATGTACTACTGCGCCGCCAGGGCCGCCCCCCTGTACAGCAGCGGCAG<br>CCCCCCTGACCAGGGCCAGGTACAACGTGTGGGGCCAGGGCACCCAGGTGACCGTGAGC<br>GCTAGCCACCACCACCACCACCACCAC |
| 178 | CAGGTGCAGCTGCAGGAGAGCGGCGGCGGCAGCGTGCAGGCCGGCGGCAGCCTGAGG<br>CTGAGCTGCGTGGCCAGCGGCTACGTGAGCTGCGACTACTTCCTGCCCAGCTGGTACAG<br>GCAGGCCCCCGGCAAGGAGAGGGAGTTCGTGAGCATCATCGACGGCACCGGCAGCACC<br>AGCTACGCCGCCAGCGTGAAGGGCAGGTTCACCGCCAGCCAGGACAAGGGCAAGAAC<br>ATCGCCTACCTGCAGATGAACACCCTGAAGCCCGAGGACACCGCCATGTACTACTGCA<br>AGGCCAGCTGCGTGAGGGGCAGGGCCATCAGCGAGTACTGGGGCCAGGGCACCCAGGT<br>GACCGTCTCGAGTGGCGGCGGATCCCAGGTGCAGCTGCAGGAGAGCGGCGGCGGCAGC<br>GTGCAGGCCGGCGGCAGCCTGAGGCTGAGCTGCGTGGCCAGCGCCAGCACCTACTGCA<br>CCTACGACATGCACTGGTACAGGCAGGCCCCCGGCAAGGGCAGGGAGTTCGTGAGCGC<br>CATCGACAGCGACGGCACCACCAGGTACGCCGACAGCGTGAAGGGCAGGTTCACCATC<br>AGCCAGGGCACCGCCAAGAACACCGTGTACCTGCAGATGAACAGCCTGCAGCCCGAG<br>ACACCGCCATGTACTACTGCAAGACCGTGTGCGTGGTGGGCAGCAGGTGGAGCGACTA<br>CTGGGGCCAGGGCACCCAGGTGACCGTGAGCGCTAGCCACCACCACCACCACCACCAC<br>CAC |
| 179 | CAGGTGCAGCTGCAGGAGAGCGGCGGCGGCAGCGTGCAGGCCGGCGGCAGCCTGAGG<br>CTGAGCTGCGTGGCCAGCGGCTACGTGAGCTGCGACTACTTCCTGCCCAGCTGGTACAG<br>GCAGGCCCCCGGCAAGGAGAGGGAGTTCGTGAGCATCATCGACGGCACCGGCAGCACC<br>AGCTACGCCGCCAGCGTGAAGGGCAGGTTCACCGCCAGCCAGGACAAGGGCAAGAAC<br>ATCGCCTACCTGCAGATGAACACCCTGAAGCCCGAGGACACCGCCATGTACTACTGCA<br>AGGCCAGCTGCGTGAGGGGCAGGGCCATCAGCGAGTACTGGGGCCAGGGCACCCAGGT<br>GACCGTCTCGAGTGGCGGCGGATCCCAGGTGCAGCTGCAGGAGAGCGGCGGCGGCAGC<br>GTGCAGGCCGGCGGCAGCCTGACCCTGAGCTGCGCCGCCAGCGGCTACGCCTACAGCA<br>CCTGCAACATGGGCTGGTACAGGCAGGCCCCCGGCAAGGAGAGGGAGCTGGTGAGCGC<br>CTTCATCAGCGACGGCAGCACCTACTACGCCGACAGCGTGAAGGGCAGGTTCACCATC<br>ACCAGGGACAACGCCAAGAACACCGTGTACCTGCAGATGAACAGCCTGAAGCCCGAGG<br>ACACCGCCATCTACTACTGCAGCGCCAACTGCTACAGGAGGCTGAGGAACTACTGGGG<br>CCAGGGCACCCAGGTGACCGTGAGCGCTAGCCACCACCACCACCACCACCACCAC |

TABLE 3C-continued

| SEQ ID NO | Sequence |
|---|---|
| 180 | CAGGTGCAGCTGCAGGAGAGCGGCGGCGGCAGCGTGCAGGCCGGCGGCAGCCTGAGG<br>CTGAGCTGCGTGGCCAGCGGCTACGTGAGCTGCGACTACTTCCTGCCCAGCTGGTACAG<br>GCAGGCCCCCGGCAAGGAGAGGGAGTTCGTGAGCATCATCGACGGCACCGGCAGCACC<br>AGCTACGCCGCCAGCGTGAAGGGCAGGTTCACCGCCAGCCAGGACAAGGGCAAGAAC<br>ATCGCCTACCTGCAGATGAACACCCTGAAGCCCGAGGACACCGCCATGTACTACTGCA<br>AGGCCAGCTGCGTGAGGGCAGGGCCATCAGCGAGTACTGGGGCCAGGGCACCCAGGT<br>GACCGTCTCGAGTGGCGGCGGATCCCAGGTGCAGCTGCAGGAGAGCGGCGGCGGCCTG<br>GTGCAGCCCGGCGGCAGCCTGAGGCTGAGCTGCACCGCCAGCGGCCTGACCTTCGACG<br>ACAGCGTGATGGGCTGGTTCAGGCAGGCCCCCGGCAAGGGCAGGGAGGCCGTGAGCTG<br>CATCAGCAGCAGCGGCGCCAACGCCTTCTACGCCGACAGCGTGAAGGGCAGGTTCACC<br>ATCAGCAGGGACAACGCCAAGAACACCCTGTACCTGCAGATGAACAGCCTGAAGCCCG<br>AGGACACCGCCACCTACTACTGCAAGAGGGGCCACGCCTGCGCCGGCTACTACCCCAT<br>CCCCTACGACGACTACTGGGGCCAGGGCACCCAGGTGACCGTGAGCGCTAGCCACCAC<br>CACCACCACCACCACCAC |
| 181 | CAGGTGCAGCTGCAGGAGAGCGGCGGCGGCAGCGTGCAGGCCGGCGGCAGCCTGAGG<br>CTGAGCTGCAGGGCCAGCGGCAGCACCTACAGCAACTACTGCCTGGGCTGGTTCAGGC<br>AGATCACCGGCAAGGAGAGGGAGGGCGTGGCCGTGATCAACTGGGTGGGCGGCATGCT<br>GTACTTCGCCGACAGCGTGAAGGGCAGGTTCACCGTGAGCCAGGACCAGGCCAAGAAC<br>ACCGTGTACCTGCAGATGAACAGCCTGAAGCCCGAGGACACCGCCATGTACTACTGCG<br>CCGCCGAGAGCGTGAGCAGCTTCAGCTGCGGCGGCTGGCTGACCAGGCCCGACAGGGT<br>GCCCTACTGGGGCCAGGGCACCCAGGTGACCGTCTCGAGTGGCGGCGGATCCCAGGTG<br>CAGCTGCAGGAGAGCGGCGGCGGCAGCGTGCAGGCCGGCGGCAGCCTGAGGCTGAGC<br>TGCACCGCCAGCGGCGCCATCGCCAGCGGCTACATCGACAGCAGGTGGTGCATGGCCT<br>GGTTCAGGCAGGCCCCCGGCAAGGAGAGGGAGGGCGTGGCCGCCATCTGGCCCGGCGG<br>CGGCCTGACCGTGTACGCCGACAGCGTGAAGGGCAGGTTCACCATCAGCAGGGACCAC<br>GCCAAGAACACCCTGTACCTGCAGATGAACAACCTGAAGCCCGAGGACACCGCCATGT<br>ACTACTGCGCCGCCGGCAGCCCCAGGATGTGCCCCAGCCTGGAGTTCGGCTTCGACTAC<br>TGGGGCCAGGGCACCCAGGTGACCGTGAGCGCTAGCCACCACCACCACCACCACCACC<br>AC |
| 182 | CAGGTGCAGCTGCAGGAGAGCGGCGGCGGCAGCGTGCAGGCCGGCGGCAGCCTGAGG<br>CTGAGCTGCAGGGCCAGCGGCAGCACCTACAGCAACTACTGCCTGGGCTGGTTCAGGC<br>AGATCACCGGCAAGGAGAGGGAGGGCGTGGCCGTGATCAACTGGGTGGGCGGCATGCT<br>GTACTTCGCCGACAGCGTGAAGGGCAGGTTCACCGTGAGCCAGGACCAGGCCAAGAAC<br>ACCGTGTACCTGCAGATGAACAGCCTGAAGCCCGAGGACACCGCCATGTACTACTGCG<br>CCGCCGAGAGCGTGAGCAGCTTCAGCTGCGGCGGCTGGCTGACCAGGCCCGACAGGGT<br>GCCCTACTGGGGCCAGGGCACCCAGGTGACCGTCTCGAGTGGCGGCGGATCCCAGGTG<br>CAGCTGCAGGAGAGCGGCGGCGGCAGCGTGCAGGCCGGCGGCAGCCTGAGGCTGAGC<br>TGCACCGCCCCCGGCTTCACCAGCAACAGCTGCGGCATGGACTGGTACAGGCAGGCCC<br>CCGGCAAGGAGAGGGAGTTCGTGAGCAGCATCAGCACCGACGGCACCACCGGCTACGC<br>CGACAGCGTGAAGGGCAGGTTCACCATCAGCAAGGACAAGGCCAAGGACACCGTGTAC<br>CTGCAGATGAACAGCCTGAAGCCCGAGGACACCGGCATGTACAGCTGCAAGACCAAGG<br>ACGGCACCATCGCCACCATGGAGCTGTGCGACTTCGGCTACTGGGGCCAGGGCACCCA<br>GGTGACCGTGAGCGCTAGCCACCACCACCACCACCACCAC |
| 183 | CAGGTGCAGCTGCAGGAGAGCGGCGGCGGCAGCGTGCAGGCCGGCGGCAGCCTGAGG<br>CTGAGCTGCAGGGCCAGCGGCAGCACCTACAGCAACTACTGCCTGGGCTGGTTCAGGC<br>AGATCACCGGCAAGGAGAGGGAGGGCGTGGCCGTGATCAACTGGGTGGGCGGCATGCT<br>GTACTTCGCCGACAGCGTGAAGGGCAGGTTCACCGTGAGCCAGGACCAGGCCAAGAAC<br>ACCGTGTACCTGCAGATGAACAGCCTGAAGCCCGAGGACACCGCCATGTACTACTGCG<br>CCGCCGAGAGCGTGAGCAGCTTCAGCTGCGGCGGCTGGCTGACCAGGCCCGACAGGGT<br>GCCCTACTGGGGCCAGGGCACCCAGGTGACCGTCTCGAGTGGCGGCGGATCCCAGGTG<br>CAGCTGCAGGAGAGCGGCGGCGGCAGCGTGCAGGCCGGCGGCAGCCTGAGGCTGAGC<br>TGCGCCGCCAGCGGCTACCCCTACAGCAACGGCTACATGGGCTGGTTCAGGCAGGCCC<br>CCGGCAAGGAGAGGGAGGGCGTGGCCACCATCTACACCGGCGACGGCAGGACCTACTA<br>CGCCGACAGCGTGAAGGGCAGGTTCACCATCAGCAGGGACAACGCCAAGAACACCGTG<br>GACCTGCAGATGAGCAGCCTGAAGCCCGAGGACACCGCCATGTACTACTGCGCCGCCA<br>GGGCCGCCCCCCTGTACAGCAGCGGCAGCCCCCTGACCAGGGCCAGGTACAACGTGTG<br>GGGCCAGGGCACCCAGGTGACCGTGAGCGCTAGCCACCACCACCACCACCACCACCAC |
| 184 | CAGGTGCAGCTGCAGGAGAGCGGCGGCGGCAGCGTGCAGGCCGGCGGCAGCCTGAGG<br>CTGAGCTGCAGGGCCAGCGGCAGCACCTACAGCAACTACTGCCTGGGCTGGTTCAGGC<br>AGATCACCGGCAAGGAGAGGGAGGGCGTGGCCGTGATCAACTGGGTGGGCGGCATGCT<br>GTACTTCGCCGACAGCGTGAAGGGCAGGTTCACCGTGAGCCAGGACCAGGCCAAGAAC<br>ACCGTGTACCTGCAGATGAACAGCCTGAAGCCCGAGGACACCGCCATGTACTACTGCG<br>CCGCCGAGAGCGTGAGCAGCTTCAGCTGCGGCGGCTGGCTGACCAGGCCCGACAGGGT<br>GCCCTACTGGGGCCAGGGCACCCAGGTGACCGTCTCGAGTGGCGGCGGATCCCAGGTG<br>CAGCTGCAGGAGAGCGGCGGCGGCAGCGTGCAGGCCGGCGGCAGCCTGAGGCTGAGC<br>TGCGTGGCCAGCGCCAGCACCTACTGCACCTACGACATGCACTGGTACAGGCAGGCCC<br>CCGGCAAGGGCAGGGAGTTCGTGAGCGCCATCGACAGCGACGGCACCACCAGGTACGC<br>CGACAGCGTGAAGGGCAGGTTCACCATCAGCCAGGGCACCGCCAAGAACACCGTGTAC<br>CTGCAGATGAACAGCCTGCAGCCCGAGGACACCGCCATGTACTACTGCAAGACCGTGT<br>GCGTGGTGGGCAGCAGGTGGAGCGACTACTGGGGCCAGGGCACCCAGGTGACCGTGAG<br>CGCTAGCCACCACCACCACCACCACCACCAC |

TABLE 3C-continued

| SEQ ID NO | Sequence |
|---|---|
| 185 | CAGGTGCAGCTGCAGGAGAGCGGCGGCGGCAGCGTGCAGGCCGGCGGCAGCCTGAGG<br>CTGAGCTGCAGGGCCAGCGGCAGCACCTACAGCAACTACTGCCTGGGCTGGTTCAGGC<br>AGATCACCGGCAAGGAGAGGGAGGGCGTGGCCGTGATCAACTGGGTGGGCGGCATGCT<br>GTACTTCGCCGACAGCGTGAAGGGCAGGTTCACCGTGAGCCAGGACCAGGCCAAGAAC<br>ACCGTGTACCTGCAGATGAACAGCCTGAAGCCCGAGGACACCGCCATGTACTACTGCG<br>CCGCCGAGAGCGTGAGCAGCTTCAGCTGCGGCGGCTGGCTGACCAGGCCCGACAGGGT<br>GCCCTACTGGGGCCAGGGCACCCAGGTGACCGTCTCGAGTGGCGGCGGATCCCAGGTG<br>CAGCTGCAGGAGAGCGGCGGCGGCAGCGTGCAGGCCGGCGGCAGCCTGACCCTGAGCT<br>GCGCCGCCAGCGAGTACGCCTACAGCACCTGCAACATGGGCTGGTACAGGCAGGCCCC<br>CGGCAAGGAGAGGGAGCTGGTGAGCGCCTTCATCAGCGACGGCAGCACCTACTACGCC<br>GACAGCGTGAAGGGCAGGTTCACCATCACCAGGGACAACGCCAAGAACACCGTGTACC<br>TGCAGATGAACAGCCTGAAGCCCGAGGACACCGCCATCTACTACTGCAGCGCCAACTG<br>CTACAGGAGGCTGAGGAACTACTGGGGCCAGGGCACCCAGGTGACCGTGAGCGCTAGC<br>CACCACCACCACCACCACCAC |
| 186 | CAGGTGCAGCTGCAGGAGAGCGGCGGCGGCAGCGTGCAGGCCGGCGGCAGCCTGAGG<br>CTGAGCTGCAGGGCCAGCGGCAGCACCTACAGCAACTACTGCCTGGGCTGGTTCAGGC<br>AGATCACCGGCAAGGAGAGGGAGGGCGTGGCCGTGATCAACTGGGTGGGCGGCATGCT<br>GTACTTCGCCGACAGCGTGAAGGGCAGGTTCACCGTGAGCCAGGACCAGGCCAAGAAC<br>ACCGTGTACCTGCAGATGAACAGCCTGAAGCCCGAGGACACCGCCATGTACTACTGCG<br>CCGCCGAGAGCGTGAGCAGCTTCAGCTGCGGCGGCTGGCTGACCAGGCCCGACAGGGT<br>GCCCTACTGGGGCCAGGGCACCCAGGTGACCGTCTCGAGTGGCGGCGGATCCCAGGTG<br>CAGCTGCAGGAGAGCGGCGGCGGCCTGGTGCAGCCCGGCGGCAGCCTGAGGCTGAGCT<br>GCACCGCCAGCGGCCTGACCTTCGACGACAGCGTGATGGGCTGGTTCAGGCAGGCCCC<br>CGGCAAGGGCAGGGAGGCCGTGAGCTGCATCAGCAGCAGCGGCGCCAACGCCTTCTAC<br>GCCGACAGCGTGAAGGGCAGGTTCACCATCAGCAGGGACAACGCCAAGAACACCCTGT<br>ACCTGCAGATGAACAGCCTGAAGCCCGAGGACACCGCCACCTACTACTGCAAGAGGGG<br>CCACGCCTGCGCCGGCTACTACCCCATCCCCTACGACGACTACTGGGGCCAGGGCACCC<br>AGGTGACCGTGAGCGCTAGCCACCACCACCACCACCACCAC |
| 187 | CAGGTGCAGCTGCAGGAGAGCGGCGGCGGCCTGGTGCAGCCCGGCGGCAGCCTGAGGC<br>TGAGCTGCGCCGCCAGCGGCTTCACCTTCAGCCTGAGCAGCATGAGCTGGGTGAGGCA<br>GGCCCCCGGCAAGGGCCTGGAGTGGGTGAGCGCCATCAGCAGCGGCGGCGCCAGCACC<br>TACTACACCGACAGCGTGAAGGGCAGGTTCACCATCAGCAGGGACAACGCCAAGAACA<br>TGCTGTACCTGCAGCTGAACAGCCTGAAGACCGAGGACACCGCCATGTACTACTGCGC<br>CAAGGGCGGCAGCGGCTACGGCGACGCCAGCAGGATGACCAGCCCCGGCAGCCAGGG<br>CACCCAGGTGACCGTCTCGAGTGGCGGCGGATCCCAGGTGCAGCTGCAGGAGAGCGGC<br>GGCGGCAGCGTGCAGGCCGGCGGCAGCCTGAGGCTGAGCTGCACCGCCAGCGGCGCCA<br>TCGCCAGCGGCTACATCGACAGCAGGTGGTGCATGGCCTGGTTCAGGCAGGCCCCCGG<br>CAAGGAGAGGGAGGGCGTGGCCGCCATCTGGCCCGGCGGCGGCCTGACCGTGTACGCC<br>GACAGCGTGAAGGGCAGGTTCACCATCAGCAGGGACCACGCCAAGAACACCCTGTACC<br>TGCAGATGAACAACCTGAAGCCCGAGGACACCGCCATGTACTACTGCGCCGCCGGCAG<br>CCCCAGGATGTGCCCCAGCCTGGAGTTCGGCTTCGACTACTGGGGCCAGGGCACCCAG<br>GTGACCGTGAGCGCTAGCCACCACCACCACCACCACCAC |
| 188 | CAGGTGCAGCTGCAGGAGAGCGGCGGCGGCCTGGTGCAGCCCGGCGGCAGCCTGAGGC<br>TGAGCTGCGCCGCCAGCGGCTTCACCTTCAGCCTGAGCAGCATGAGCTGGGTGAGGCA<br>GGCCCCCGGCAAGGGCCTGGAGTGGGTGAGCGCCATCAGCAGCGGCGGCGCCAGCACC<br>TACTACACCGACAGCGTGAAGGGCAGGTTCACCATCAGCAGGGACAACGCCAAGAACA<br>TGCTGTACCTGCAGCTGAACAGCCTGAAGACCGAGGACACCGCCATGTACTACTGCGC<br>CAAGGGCGGCAGCGGCTACGGCGACGCCAGCAGGATGACCAGCCCCGGCAGCCAGGG<br>CACCCAGGTGACCGTCTCGAGTGGCGGCGGATCCCAGGTGCAGCTGCAGGAGAGCGGC<br>GGCGGCAGCGTGCAGGCCGGCGGCAGCCTGAGGCTGAGCTGCACCGCCCCCGGCTTCA<br>CCAGCAACAGCTGCGGCATGGACTGGTACAGGCAGGCCCCCGGCAAGGAGAGGGAGTT<br>CGTGAGCAGCATCAGCACCGACGGCACCACCGGCTACGCCGACAGCGTGAAGGGCAGG<br>TTCACCATCAGCAAGGACAAGGCCAAGGACACCGTGTACCTGCAGATGAACAGCCTGA<br>AGCCCGAGGACACCGGCATGTACAGCTGCAAGACCAAGGACGGCACCATCGCCACCAT<br>GGAGCTGTGCGACTTCGGCTACTGGGGCCAGGGCACCCAGGTGACCGTGAGCGCTAGC<br>CACCACCACCACCACCACCAC |
| 189 | CAGGTGCAGCTGCAGGAGAGCGGCGGCGGCCTGGTGCAGCCCGGCGGCAGCCTGAGGC<br>TGAGCTGCGCCGCCAGCGGCTTCACCTTCAGCCTGAGCAGCATGAGCTGGGTGAGGCA<br>GGCCCCCGGCAAGGGCCTGGAGTGGGTGAGCGCCATCAGCAGCGGCGGCGCCAGCACC<br>TACTACACCGACAGCGTGAAGGGCAGGTTCACCATCAGCAGGGACAACGCCAAGAACA<br>TGCTGTACCTGCAGCTGAACAGCCTGAAGACCGAGGACACCGCCATGTACTACTGCGC<br>CAAGGGCGGCAGCGGCTACGGCGACGCCAGCAGGATGACCAGCCCCGGCAGCCAGGG<br>CACCCAGGTGACCGTCTCGAGTGGCGGCGGATCCCAGGTGCAGCTGCAGGAGAGCGGC<br>GGCGGCAGCGTGCAGGCCGGCGGCAGCCTGAGGCTGAGCTGCGCCGCCAGCGGCTACC<br>CCTACAGCAACGGCTACATGGGCTGGTTCAGGCAGGCCCCCGGCAAGGAGAGGGAGGG<br>CGTGGCCACCATCTACACCGGCGACGGCAGGACCTACTACGCCGACAGCGTGAAGGGC<br>AGGTTCACCATCAGCAGGGACAACGCCAAGAACACCGTGGACCTGCAGATGAGCAGCC<br>TGAAGCCCGAGGACACCGCCATGTACTACTGCGCCGCCAGGGCCGCCCCCCTGTACAG<br>CAGCGGCAGCCCCCTGACCAGGGCCAGGTACAACGTGTGGGCCAGGGCACCCAGGTG<br>ACCGTGAGCGCTAGCCACCACCACCACCACCACCAC |

TABLE 3C-continued

| SEQ ID NO | Sequence |
|---|---|
| 190 | CAGGTGCAGCTGCAGGAGAGCGGCGGCGGCCTGGTGCAGCCCGGCGGCAGCCTGAGGC<br>TGAGCTGCGCCGCCAGCGGCTTCACCTTCAGCCTGAGCAGCATGAGCTGGGTGAGGCA<br>GGCCCCCGGCAAGGGCCTGGAGTGGGTGAGCGCCATCAGCAGCGGCGGCGCCAGCACC<br>TACTACACCGACAGCGTGAAGGGCAGGTTCACCATCAGCAGGGACAACGCCAAGAACA<br>TGCTGTACCTGCAGCTGAACAGCCTGAAGACCGAGGACACCGCCATGTACTACTGCGC<br>CAAGGGCGGCAGCGGCTACGGCGACGCCAGCAGGATGACCAGCCCCGGCAGCCAGGG<br>CACCCAGGTGACCGTCTCGAGTGGCGGCGGATCCCAGGTGCAGCTGCAGGAGAGCGGC<br>GGCGGCAGCGTGCAGGCCGGCGGCAGCCTGAGGCTGAGCTGCGTGGCCAGCGCCAGCA<br>CCTACTGCACCTACGACATGCACTGGTACAGGCAGGCCCCCGGCAAGGGCAGGGAGTT<br>CGTGAGCGCCATCGACAGCGACGGCACCACCAGGTACGCCGACAGCGTGAAGGGCAG<br>GTTCACCATCAGCCAGGGCACCGCCAAGAACACCGTGTACCTGCAGATGAACAGCCTG<br>CAGCCCGAGGACACCGCCATGTACTACTGCAAGACCGTGTGCGTGGTGGGCAGCAGGT<br>GGAGCGACTACTGGGGCCAGGGCACCCAGGTGACCGTGAGCGCTAGCCACCACCACCA<br>CCACCACCACCAC |
| 191 | CAGGTGCAGCTGCAGGAGAGCGGCGGCGGCCTGGTGCAGCCCGGCGGCAGCCTGAGGC<br>TGAGCTGCGCCGCCAGCGGCTTCACCTTCAGCCTGAGCAGCATGAGCTGGGTGAGGCA<br>GGCCCCCGGCAAGGGCCTGGAGTGGGTGAGCGCCATCAGCAGCGGCGGCGCCAGCACC<br>TACTACACCGACAGCGTGAAGGGCAGGTTCACCATCAGCAGGGACAACGCCAAGAACA<br>TGCTGTACCTGCAGCTGAACAGCCTGAAGACCGAGGACACCGCCATGTACTACTGCGC<br>CAAGGGCGGCAGCGGCTACGGCGACGCCAGCAGGATGACCAGCCCCGGCAGCCAGGG<br>CACCCAGGTGACCGTCTCGAGTGGCGGCGGATCCCAGGTGCAGCTGCAGGAGAGCGGC<br>GGCGGCAGCGTGCAGGCCGGCGGCAGCCTGACCCTGAGCTGCGCCGCCAGCGAGTACG<br>CCTACAGCACCTGCAACATGGGCTGGTACAGGCAGGCCCCCGGCAAGGAGAGGGAGCT<br>GGTGAGCGCCTTCATCAGCGACGGCAGCACCTACTACGCCGACAGCGTGAAGGGCAGG<br>TTCACCATCACCAGGGACAACGCCAAGAACACCGTGTACCTGCAGATGAACAGCCTGA<br>AGCCCGAGGACACCGCCATCTACTACTGCAGCGCCAACTGCTACAGGAGGCTGAGGAA<br>CTACTGGGGCCAGGGCACCCAGGTGACCGTGAGCGCTAGCCACCACCACCACCACCAC<br>CACCAC |
| 192 | CAGGTGCAGCTGCAGGAGAGCGGCGGCGGCCTGGTGCAGCCCGGCGGCAGCCTGAGGC<br>TGAGCTGCGCCGCCAGCGGCTTCACCTTCAGCCTGAGCAGCATGAGCTGGGTGAGGCA<br>GGCCCCCGGCAAGGGCCTGGAGTGGGTGAGCGCCATCAGCAGCGGCGGCGCCAGCACC<br>TACTACACCGACAGCGTGAAGGGCAGGTTCACCATCAGCAGGGACAACGCCAAGAACA<br>TGCTGTACCTGCAGCTGAACAGCCTGAAGACCGAGGACACCGCCATGTACTACTGCGC<br>CAAGGGCGGCAGCGGCTACGGCGACGCCAGCAGGATGACCAGCCCCGGCAGCCAGGG<br>CACCCAGGTGACCGTCTCGAGTGGCGGCGGATCCCAGGTGCAGCTGCAGGAGAGCGGC<br>GGCGGCCTGGTGCAGCCCGGCGGCAGCCTGAGGCTGAGCTGCACCGCCAGCGGCCTGA<br>CCTTCGACGACAGCGTGATGGGCTGGTTCAGGCAGGCCCCCGGCAAGGGCAGGGAGGC<br>CGTGAGCTGCATCAGCAGCAGCGGCGCCAACGCCTTCTACGCCGACAGCGTGAAGGGC<br>AGGTTCACCATCAGCAGGGACAACGCCAAGAACACCCTGTACCTGCAGATGAACAGCC<br>TGAAGCCCGAGGACACCGCCACCTACTACTGCAAGAGGGCCACGCCTGCGCCGGCTA<br>CTACCCCATCCCCTACGACGACTACTGGGGCCAGGGCACCCAGGTGACCGTGAGCGCT<br>AGCCACCACCACCACCACCACCAC |

Additional IL27R Binding Proteins

Further, additional IL27R binding proteins can include three CDR sequences as underlined in an anti-IL27Rα V$_H$H antibody listed in Table 4 below, and three CDR sequences as underlined in an anti-gp130 V$_H$H antibody of any one of SEQ ID NOS:232-237. Additional IL27R binding proteins can include an anti-IL27Rα V$_H$H antibody (e.g., any one of the sequences listed in Table 4 below) and an anti-gp130 V$_H$H antibody (e.g., any one of SEQ ID NOS:232-237. In some embodiments, the binding protein comprises the anti-IL27Rα V$_H$H antibody at the N-terminus and the anti-gp130 V$_H$H antibody at the C-terminus. In some embodiments, the binding protein comprises the anti-gp130 V$_H$H antibody at the N-terminus and the anti-IL27Rα V$_H$H antibody at the C-terminus. In some embodiments, the binding protein comprises a linker (e.g., any one of SEQ ID NOS:85-108 (e.g., SEQ ID NO:108)) between the anti-IL27Rα V$_H$H antibody and the anti-gp130 V$_H$H antibody. In certain embodiments, the binding protein comprises a purification tag, such as a six-histidine peptide (His)$_6$ (SEQ ID NO: 1531) (His-tag).

TABLE 4

| SEQ ID NO | Sequence |
|---|---|
| 258 | QVQLQESGGGSVQVGGSLRLSCAAS<u>GFTFSSYPMS</u>WVRQAPGKGLEWIS<u>TISAGGDTTLYA</u><br>DSVKGRFTSSRDNAKNTLYLQLNSLKTEDTAIYYCAK<u>RIDCNSGYCYRRNY</u>WGQGTQVTV<br>SS |
| 259 | QVQLQESGGGSVQAGGSLRLSCRASG<u>STYSNYCLG</u>WFRQITGKEREGVA<u>VINWVGGMLYF</u><br>ADSVKGRFTVSQDQAKNTLYLQMNSLKPEDTAMYYCAA<u>ESVSSFSCGGWLTRPDRVPYW</u><br>GQGTQVTVSS |

TABLE 4-continued

| SEQ ID NO | Sequence |
|---|---|
| 260 | QVQLQESGGGSVQAGGSLRLSCVASGYVSCDYFLPSWYRQAPGKEREFVSIIDGTGSTSYA<br>ASVKGRFTASQDKGKNIAYLQMNSLKPEDTAMYYCKASCVRGRGISEYWGQGTQVTVSS |
| 261 | QVQLQESGGGLVQPGGSLRLSCAASGFTFSHSGMSWVRQAPGKGLEWVSTINSGGASTYY<br>TDSVKGRFTISRDNAKNMLYLQLNSLKTEDTAMYYCAKGGSGYGDASRMTSPGSQGTQV<br>TVSS |
| 262 | QVQLQESGGGLVQPGGSLRLSCAASGFTFSLSGMSWVRQAPGKGLEWVSAISSGGASTYY<br>TDSVKGRFTISRDNAKNILYLQLNSLKTEDTAMYYCAKGGSGYGDASRMTSPGSQGTQVT<br>VSS |
| 263 | QVQLQESGGGSVQAGGSLRLSCVASGYVSCDYFLPSWYRQAPGKEREFVSIIDGTGSTSYA<br>ASVKGRFTASEDKGKNIAYLQMNSLKPEDTAMYYCKASCVRGRAVSEYWGQGTQVTVSS |
| 264 | QVQLQESGGGSVQAGGSLRLSCTASGYVSCDYFLPSWYRQAPGKEREFVSIDGTGSTSYA<br>ASVKGRFTASQDKGKNIAYLQMNSLKPEDTAMYYCKASCVRGRAISEYWGQGTQVTVSS |
| 265 | QVQLQESGGGLVQPGGSLRLSCAASGFTFSSYPMSWVRQAPGKGLEWISTISAGGDTTLYA<br>DSVKGRFTSSRDNAKNTLYLQLNSLKTEDTAIYYCAKRIDCNSGYCYRRNYWGQGTQVTV<br>SS |
| 266 | QVQLQESGGGSVQAGGSLRLSCRASGSTYSNYCLGWFRQSTGKEREGVAVINWVGGMLY<br>FADSVKGRFTVSQDHAKNTVTLQMNSLKPEDTAMYYCAAESVSSFSCGGWLTRPGRVPY<br>WGQGTQVTVSS |
| 267 | QVQLQESGGGSVQAGESLRLSCRASGSTYSNYCLGWFRQITGKEREGVAVINWVGGMLYF<br>ADSVKGRFTVSQDQAKNTVYLEMNSLKPEDTAMYYCATESVSSFSCGGWLTRPDRVPYW<br>GQGTQVTVSS |
| 268 | QVQLQESGGGSVQAGGSLRLSCVASGYVSCDYFLPSWYRQAPGKEREFVSIIDGTGSTSYA<br>ASVKGRFTASQDRGKNIAYLQMNSLKPEDTAMYYCKASCVRGRTISEYWGQGTQVTVSS |
| 269 | QVQLQESGGGSVQAGGSLRLSCVASGYVSCDYFLPSWYRQAPGKEREFVSIIDGTGSTSYA<br>ASVKGRFTASQDKGKNIAYLQMNSLKPEDTAMYYCKASCVRGRAISEYWGQGTQVTVSS |
| 270 | QVQLQESGGGSVQAGGSLRLSCRASGSTYSNYCLGWFRQITGKEREGVAVINWVGGMLYF<br>ADSVKGRFTVSQDQAKNTVYLQMNSLKPEDTAMYYCAAESASSFSCGGWLTRPDRVPYW<br>GQGTQVTVSS |
| 271 | QVQLQESGGGLVQPGGSLRLSCAASGFTFSLSGMSWVRQAPGKGLEWVSAISSGGASTYY<br>TDSVKGRFTISRDNAKNMLYLQLNSLKTEDTAMYYCAKGGSGYGDASRMTSPGSQGTQV<br>TVSS |
| 272 | QVQLQESGGGLVQPGGSLRLSCAASGFTFSSYPMSWVRQAPGKGLEWVSTISSGGDTTLYA<br>DSVKGRFTSSRDNAKNTLYLQLNSLKTEDTAMYYCAKRIDCNSGYCYKRSYWGQGTQVT<br>VSS |
| 273 | QVQLQESGGGSVQAGGSLRLSCRASGSTYSNYCLGWFRQTTGKEREGVAVINWVGGMLY<br>FADSVKGRFTVSQDQAKNTVYLQMNSLKPEDTAMYYCAAESVSSFSCGGWLTRPDRVPY<br>WGQGTQVTVSS |
| 274 | QVQLQESGGGSVQAGGSLRLSCRASRSPYGNYCLGWFRQSTGKEREGVAVINWVGGMLY<br>FADSVKGRFTVSQDHAKNTVTLQMNSLKPEDTAMYYCAAESVSSFSCGGWLTRPDRVPY<br>WGQGTQVTVSS |

An IL27R binding protein can comprise three CDR sequences as underlined in an anti-IL27Rα $V_HH$ antibody and three CDR sequences as underlined in an anti-gp130 $V_HH$ antibody as described in each row of Table 5 below. In some embodiments, an IL27R binding protein comprises an anti-IL27Rα $V_HH$ antibody and an anti-gp130 $V_HH$ antibody as described in each row of Table 5 below. In some embodiments, the binding protein comprises the anti-L27Rα $V_HH$ antibody at the N-terminus and the anti-gp130 $V_HH$ antibody at the C-terminus. In some embodiments, the binding protein comprises the anti-gp130 $V_HH$ antibody at the N-terminus and the anti-IL27Rα $V_HH$ antibody at the C-terminus. In some embodiments, the binding protein comprises a linker (e.g., any one of SEQ ID NOS:85-108 (e.g., SEQ ID NO: 108)) between the anti-IL27Rα $V_HH$ antibody and the anti-gp130 $V_HH$ antibody. In certain embodiments, the binding protein comprises a purification tag, such as a six-histidine peptide $(His)_6$ (SEQ ID NO: 1531) (His-tag).

TABLE 5

| SEQ ID NO of Anti-IL27Rα $V_HH$ antibody | SEQ ID NO of Anti-gp130 $V_HH$ antibody |
|---|---|
| 258 | 232 |
| 259 | 232 |
| 260 | 232 |
| 261 | 232 |
| 262 | 232 |

TABLE 5-continued

| SEQ ID NO of Anti-IL27Rα V$_H$H antibody | SEQ ID NO of Anti-gp130 V$_H$H antibody |
|---|---|
| 263 | 232 |
| 264 | 232 |
| 265 | 232 |
| 266 | 232 |
| 267 | 232 |
| 268 | 232 |
| 269 | 232 |
| 270 | 232 |
| 271 | 232 |
| 272 | 232 |
| 273 | 232 |
| 274 | 232 |
| 258 | 233 |
| 259 | 233 |
| 260 | 233 |
| 261 | 233 |
| 262 | 233 |
| 263 | 233 |
| 264 | 233 |
| 265 | 233 |
| 266 | 233 |

TABLE 5

| SEQ ID NO of Anti-IL27Rα V$_H$H antibody | SEQ ID NO of Anti-gp130 V$_H$H antibody |
|---|---|
| 267 | 233 |
| 268 | 233 |
| 269 | 233 |
| 270 | 233 |
| 271 | 233 |
| 272 | 233 |
| 273 | 233 |
| 274 | 233 |
| 258 | 234 |
| 259 | 234 |
| 260 | 234 |
| 261 | 234 |
| 262 | 234 |
| 263 | 234 |
| 264 | 234 |
| 265 | 234 |
| 266 | 234 |
| 267 | 234 |
| 268 | 234 |
| 269 | 234 |
| 270 | 234 |
| 271 | 234 |
| 272 | 234 |
| 273 | 234 |
| 274 | 234 |
| 258 | 235 |
| 259 | 235 |
| 260 | 235 |
| 261 | 235 |
| 262 | 235 |
| 263 | 235 |
| 264 | 235 |
| 265 | 235 |
| 266 | 235 |
| 267 | 235 |
| 268 | 235 |
| 269 | 235 |
| 270 | 235 |
| 271 | 235 |
| 272 | 235 |
| 273 | 235 |
| 274 | 235 |
| 258 | 236 |
| 259 | 236 |
| 260 | 236 |
| 261 | 236 |
| 262 | 236 |
| 263 | 236 |
| 264 | 236 |
| 265 | 236 |
| 266 | 236 |
| 267 | 236 |
| 268 | 236 |

TABLE 5-continued

| SEQ ID NO of Anti-IL27Rα V_HH antibody | SEQ ID NO of Anti-gp130 V_HH antibody |
|---|---|
| 269 | 236 |
| 270 | 236 |
| 271 | 236 |
| 272 | 236 |
| 273 | 236 |
| 274 | 236 |
| 258 | 237 |
| 259 | 237 |
| 260 | 237 |
| 261 | 237 |
| 262 | 237 |
| 263 | 237 |
| 264 | 237 |
| 265 | 237 |
| 266 | 237 |
| 267 | 237 |
| 268 | 237 |
| 269 | 237 |
| 270 | 237 |
| 271 | 237 |
| 272 | 237 |
| 273 | 237 |
| 274 | 237 |

Further, an IL27R binding protein can comprise a mouse Anti IL27Rα V_HH antibody and a mouse Anti gp130 V_HH antibody. In some instances, due to sequence or structural similarities between the extracellular domains of receptors from various mammalian species, immunization with an antigen derived from a IL27Rα or gp130 of a first mammalian species may provide antibodies which specifically bind to receptors of one or more additional mammalian species. Such antibodies are termed "cross reactive." For example, immunization of a camelid with a human derived antigen (e.g., the hIL27Rα-ECD) may generate antibodies that are cross-reactive the murine and human receptors. Evaluation of cross-reactivity of antibody with respect to the receptors derived from other mammalian species may be readily determined by the skilled artisan, for example using the methods relating to evaluation of binding affinity and/or specific binding described elsewhere herein such as flow cytometry or SPR. Consequently, the use of the term "human IL27Rα VHH" or "hIL27Rα VHH" merely denotes that the species of the IL27Rα antigen used for immunization of the camelid from which the VHH was derived was the human IL27Rα but should not be understood as limiting with respect to the specific binding affinity of the VHH for IL27Rα molecules of other mammalian species. Similarly, the use of the term "mouse IL27Rα VHH" or "mIL27Rα VHH" merely denotes that the species of the IL27Rα antigen used for immunization of the camelid from which the VHH was derived was the murine IL27Rα but should not be understood as limiting with respect to the specific binding affinity of the VHH for IL27Rα molecules of other mammalian species. In some embodiments, an IL27R binding protein can comprise three CDR sequences as underlined in a mouse anti-IL27Rα V_HH antibody sequence listed below and three CDR sequences as underlined in a mouse anti-gp130 V_HH antibody sequence listed below. In some embodiments, an IL27R binding protein comprises a mouse anti-IL27Rα V_HH antibody listed below and a mouse anti-gp130 V_HH antibody listed below. In some embodiments, the binding protein comprises the mouse anti-IL27Rα V_HH antibody at the N-terminus and the mouse anti-gp130 V_HH antibody at the C-terminus. In some embodiments, the binding protein comprises the mouse anti-gp130 V_HH antibody at the N-terminus and the mouse anti-IL27Rα V_HH antibody at the C-terminus. In some embodiments, the binding protein comprises a linker (e.g., any one of SEQ ID NOS:85-108 (e.g., SEQ ID NO:108)) between the mouse anti-IL27Rα V_HH antibody and the mouse anti-gp130 V_HH antibody. In certain embodiments, the binding protein comprises a purification tag, such as a six-histidine peptide (His)$_6$ (SEQ ID NO: 1531) (His-tag).

Examples of mouse anti-IL27Rα V_HH antibody sequences:

Mouse Anti-IL27Rα V_HH Antibody SEQ ID NO:275

QVQLQESGGGSVQAGGSLRLSCAASKNSNFMGWFRQAPGKEREGVAAMM
TKNNNTYYADSVKGRFTISHDNAKNTVYLQMDSLKPEDTAVYYCAAVYR
TRRLRVLEAANFDYWGQGTQVTVSS

Mouse Anti-IL27Rα V_HH Antibody SEQ ID NO:276

QVQLQESGGGSVQAGGSLRLSCTASGYTSSRYCMGWFRQTPGKKREGVA
AIYTGGGTTFYHGSVKGRFTISQDNTTNTVYLQMHNLKPEDTAMYYCAA
GPVTRACDEYNYWGQGTQVTVSS

Mouse Anti-IL27Rα V_HH Antibody SEQ ID NO:277

QVQLQESGGGSVQAGGSLRLSCAGSGYSLSNYCMGWFRQAPGQGREGVA
SLRFVSGATFYADSVKGRFTIAQDNAKNTLYLQMNSLKPEDTAMYYCGI
KSRGICGGRLVDVDFGNWGQGTQVTVSS

Mouse Anti-IL27Rα V_HH Antibody SEQ ID NO:278

QVQLQESGGGSVQAGGSLRLSCAASGYSINRMGWFRQAPGKEREGVAAI
SIGGGQTYYADSVKGRFTISQDNAKNTVDLQMNSLKPEDTAMYYCAAGL
VYGEAWLDSRHYNKWGQGTQVTVSS

Mouse Anti-IL27Rα V_HH Antibody SEQ ID NO:279

QVQLQESGGGSVQAGGSLRLSCAVSGDSTYSMGWFRQPPGKEREGVAAI
AKDGITIHADSVKGRFTISKDNAKNTLYLQMNSLKPEDTAMYYCAAHRP
YGPPLNPRWYTYWGQGTQVTVSS

Mouse Anti-IL27Rα V_HH Antibody SEQ ID NO:280

QVQLQESGGGSVQAGGSLRLSCAASGYTYSSYCMAWFRQAPGKEREGVA
AIDSDGSTSYADSVKGRFTISKDNAKNTLYLQMNSLKPEDTAMYYCAAA
SGRCLGPGIRSLIWGQGTQVTVSS

Mouse Anti-IL27Rα V$_H$H Antibody SEQ ID NO:281

QVQLQESGGGSVQAGGSLRLSCAVSG<u>DSTYSMG</u>WFRQPPGKEREGVAA<u>I
TKDITIHADSVKGRF</u>TISKDNAKNTLYLQMNSLKPEDTAMYYCAA<u>HRPY
GPPLNPRWYTY</u>WGQGTQVTVSS

Mouse Anti-IL27Rα V$_H$H Antibody SEQ ID NO:282

QVQLQESGGGSVQAGGSLRLSCAVSG<u>DSTYSMG</u>WFRQPPGKEREGVAA<u>I
PTDGITIHADSVKGRF</u>TISKDNAKNTLYLQMNSLKPEDTAMYYCAA<u>HRP
YGPPLNPRWYTY</u>WGQGTQVTVSS

Mouse Anti-IL27Rα V$_H$H Antibody SEQ ID NO:283

QVQLQESGGGSVQAGGSLRLSCAVSG<u>DSTYSMG</u>WFRQPPGKEREGVAA<u>I
AKDGITIHADSVKGRF</u>TISKDNAKNTLYLQMSSLKPEDTAMYYCAA<u>HRP
YGPPLNPRWYTY</u>WGQGTQVTVSS

Mouse Anti-IL27Rα V$_H$H Antibody SEQ ID NO:284

QVQLQESGGGSVQAGGSLRLSCAVSG<u>DSTYSMG</u>WFRQPPGKEREGVAA<u>I
GKDGITIHADSVKGRF</u>TISKDNAKNTLYLQMNSLKPEDTAMYYCAA<u>HRP
YGPPLNPRWYTY</u>WGQGTQVTVSS

Mouse Anti-IL27Rα V$_H$H Antibody SEQ ID NO:285

QVQLQESGGGSVQAGGSLRLSCAVSG<u>DSTYSMG</u>WFRQPPGKEREGVAA<u>I
TKDITIHADSVKGRF</u>TISKDNAKNTLYLQMNSLRPEDTAMYYCAA<u>HRPY
GPPLNPRWYTY</u>WGQGTQVTVSS

Mouse Anti-IL27Rα V$_H$H Antibody SEQ ID NO:286

QVQLQESGGGSVQTGGSLRLSCAASG<u>YSINRMA</u>WFRQAPGKEREGVAA<u>I
SIGGDRTYYADSVKGRF</u>TISQDNAKHTVDLQMNSLKPEDTAMYYCAA<u>GL
VYGEAWLDSRHYNK</u>WGQGTQVTVSS

Mouse Anti-IL27Rα V$_H$H Antibody SEQ ID NO:287

QVQLQESGGGSVQAGGSLRLSCAASG<u>YSINRMG</u>WFRQAPGKEREGVAA<u>I
SIGGGRTYYADSVKGRF</u>TISQDNAKNTVDLQMNSLKPEDTAMYYCAA<u>GL
VYGEAWLDSRHYNK</u>WGQGTQVTVSS

Mouse Anti-IL27Rα V$_H$H Antibody SEQ ID NO:288

QVQLQESGGGSVQAGGSLRLSCAVSG<u>DSTYSMG</u>WFRQPPGKEREGVAA<u>I
TKDGITIHADSVKGRF</u>TISGDNAKNTLYLQMNNLKPEDTAMYYCAA<u>HRP
YGPPLNPRWYTY</u>WGQGTQVTVSS

Examples of mouse anti-gp130 V$_H$H antibody sequences:
Mouse Anti-Gp130 V$_H$H Antibody SEQ ID NO:289

QVQLQESGGGSVQAGGSLRLSCVISG<u>FTYRQTFMG</u>WFRQVLGKEREGVA
A<u>ISTGGGSTVYADSVKGRF</u>TISQDSSKNTVYLEMNGLKLEDTGMYYCAA
<u>STVITSVSINRGLYQY</u>WGQGTQVTVSS

Mouse Anti-Gp130 V$_H$H Antibody SEQ ID NO:290

QVQLQESGGGSVQAGGSLRLSCAISG<u>FTYRQTFMG</u>WFRQVVGKEREGVA
A<u>ISTGGGSTVYADSVKGRF</u>TISQDSSKDTVYLEMNGLKLEDTGMYYCAA
<u>STVITSESINRNLYQY</u>WGQGTQVTVSS

Mouse Anti-Gp130 V$_H$H Antibody SEQ ID NO:291

QVQLQESGGGLVQPGGSLRLSCAASG<u>FTLSTYWIY</u>WVRQAPGKGPEWVS
<u>TVSRSGGTTYYADSVNGRF</u>TISRDNAKNTVYLQMNNLKPEDAAVYYCLA
<u>SVSNLGWPPVRAPSPT</u>GQGTQVTVSS

Mouse Anti-Gp130 V$_H$H Antibody SEQ ID NO:292

QVQLQESGGGLVQPGGSLRLSCAASG<u>FTFSSYAMS</u>WVRQAPGKGLEWVS
<u>AINSGGAGTYYTDSVKGRF</u>TISRDNAKNTLYLQLNSLKTEDTAMYYCAK
<u>HVTGDYDPSLRHGYNV</u>WSQGTQVTVSS

Mouse Anti-Gp130 V$_H$H Antibody SEQ ID NO:293

QVQLQESGGGSVQAGGSLRLSCVISG<u>FTYRQTFMG</u>WFRQVVGKEREGVA
A<u>ISTGGGSTIYADSVKGRF</u>TISQDSSKDTVYLEMNGLKLEDTGMYYCAA
<u>STVITSESINRNLYQY</u>WGQGTQVTVSS

Mouse Anti-Gp130 V$_H$H Antibody SEQ ID NO:294

QVQLQESGGGLVQPGGSLRLSCAASG<u>FTLSTYWMY</u>WVRQAPGKGPEWVS
<u>AVSRGGFNTYYADSVKGRF</u>TISRDNAKNTVYLQMNSLKPEDTAVYYCMS
<u>SVSFYGWPPDRVPSPT</u>GQGTQVTVSS

Mouse Anti-Gp130 V$_H$H Antibody SEQ ID NO:295

QVQLQESGGGLVQPGESLRLSCAASG<u>FTFSSYAMS</u>WVRQAPGKGLEWVS
<u>AINSGGAGTYYTDSVKGRF</u>TISRDNAKNTLYLQLNSLKTEDTAMYYCAK
<u>HVTGDYDPSLRYGYNV</u>WSQGTQVTVSS

Mouse Anti-Gp130 V$_H$H Antibody SEQ ID NO:296

QVQLQESGGGSVQAGGSLRLSCVISG<u>FTYRPTFMG</u>WFRQVLGKEREGVA
A<u>ITTGGGSTVYADSVKGRF</u>TISQDSSKNTVYLEMNGLKLEDTGMYYCAA
<u>TTVITSVSINRNLYQY</u>WGQGTQVTVSS

Mouse Anti-Gp130 V<sub>H</sub>H Antibody SEQ ID NO:297

QVQLQESGGGSVQAGGSLRLSCGISGFTYRPTFMGWFRQVLGKEREGVA
AISTGGGSSVYADSVKGRFTVSQDSSKNTVYLEMNGLKLEDTGMYYCAA
STVITSVSINRGLYQYWGQGTQVTVSS

Mouse Anti-Gp130 V<sub>H</sub>H Antibody SEQ ID NO:298

QVQLQESGGGLVQPGGSLRLSCTASGFTFRNYAMSWVRQAPGKGLEWVS
AINSGGGSTYYADSVKGRFTISRDNAKNTLYLRLHSLKTEDTAMYYCAK
HVTGDYDPSLRYEYNYWSQGTQVTVSS

Mouse Anti-Gp130 V<sub>H</sub>H Antibody SEQ ID NO:299

QVQLQESGGGLVQPGGSLRLSCAASGFTFRNYAMSWVRQAPGKGLEWVS
AINSGGGSTYYADSVKGRFTISRDNAKNTLYLQLNSLKTEDTAMYYCTK
HVTGDYDPSLRYEYNYWSQGTQVTVSS

Mouse Anti-Gp130 V<sub>H</sub>H Antibody SEQ ID NO:300

QVQLQESGGGLVQPGGSLRLSCAASGFTFSSYAMSWVRQAPGKGLEWVS
AINSGGGSTYYADSVKGRFTISRDNAKNTLYLQLNSLKTEDTAMYCCAK
HVTGDYDPSLRYGYNCWGPGTQVTVSS

Mouse Anti-Gp130 V<sub>H</sub>H Antibody SEQ ID NO:301

QVQLQESGGGSVQPGGSLRLSCAASGFTFSTYDMSWVRQAPGKGLEWVS
TINYSGSSTYYVDSVLGRFTIARDNAKNTLYLQMNNLQTEDTAVYYCAS
VKERRSNGHPIVFGDRGQGTQVTVSS

Mouse Anti-Gp130 V<sub>H</sub>H Antibody SEQ ID NO:302

QVQLQESGGGSVQAGGSLRLSCVISGFTYKQTFMGWFRQVPGKEREGVA
AISTGGGSTVYADSVKGRFTISQDSSKNTVYLEMNGLKLEDTGMYYCAA
STVITSVSINRGLYQYWGQGTQVTVSS

Mouse Anti-Gp130 V<sub>H</sub>H Antibody SEQ ID NO:303

QVQLQESGGGSVQAGGSLRLSCVISGFTYRQTFMGWFRQVVGKEREGVA
AISTGGGSTVYADSVKGRFTISQDSSKDTVYLEMNGLKLEDTGMYYCAA
STVITSESIYRNLYQYWGQGTQVTVSS

Mouse Anti-Gp130 V<sub>H</sub>H Antibody SEQ ID NO:304

QVQLQESGGGLVQPGGSLRLSCAASGFTFRNYAMSWVRQAPGKGLEWVS
AINSGGGSTYYADSVKGRFTISRDNAKNTLYLQMNSLKPEDTAMYYCAK
HVTGDYDPSLRYEYNYWSQGTQVTVSS

Mouse Anti-Gp130 V<sub>H</sub>H Antibody SEQ ID NO:305

QVQLQESGGGLVQPGGSLRLSCAASGFTFRNYAMSWVRQAPGKGLEWVS
AINSGGGSTYYADSVKGRFTISRDNAKNTLYLQLNSLKTEDTAMYYCAK
HVTGDYDPSLRYEYAYWSQGTQVTVSS

Mouse Anti-Gp130 V<sub>H</sub>H Antibody SEQ ID NO:306

QVQLQESGGGSVQAGGSLRLSCAASGFTFSSYAMSWVRQAPGKGLEWVS
AINSGGGSTYYADSVKARFTISRDNAKNTLYLQLNSLKTEDTAMYYCAK
HVTGDYDPSLRYDYNYWGQGTQVTVSS

Mouse Anti-Gp130 V<sub>H</sub>H Antibody SEQ ID NO:307

QVQLQESGGGSVQAGGSLRLSCGISGFTYRPTFMGWFRQVLGKEREGVA
AISTGGGSSVYADSVKGRFTVSQDSSKNTVYLEMNGLKLEDTGMYYCAA
STVITSVSINRALYQYWGQGTQVTVSS

Mouse Anti-Gp130 V<sub>H</sub>H Antibody SEQ ID NO:308

QVQLQESGGGLVQPGGSLRLSCAASGFTFSSYAVSWVRQAPGKGLEWVST
INSGGGSTYYADSVKGRFTISRDNAKNTLYLQLNSLKTEDTAMYYCTKHV
TGDYDPSLRYEYNVWSQGTQVTVSS

Mouse Anti-Gp130 V<sub>H</sub>H Antibody SEQ ID NO:309

QVQLQESGGGSVQAGGSLRVSCQISGFTYRQTFMGWFRQVPGKEREGVAA
ISTGGGSTVYADSVKGRFTISQDSSKNTVYLEMNGLKLEDTGMYYCAAST
VITSPSINRNLYQYWGQGTQVTVSS

Mouse Anti-Gp130 V<sub>H</sub>H Antibody SEQ ID NO:310

QVQLQESGGGLVQPGGSLRLSCAVSGFTFSNYAMKWVRQAPGKGLEWVSS
ISGGGGATYYADSVKGRFTISRDNTKNTLYLQMNSLKTEDTAVYYCAAQN
LDYRGQGTQVTVSS

Mouse Anti-Gp130 V<sub>H</sub>H Antibody SEQ ID NO:311

QVQLQESGGGLVQPGGSLRLSCTASGFTFNSAHMKWERQPPGKGLEWVSF
ITPGGASTGYADSVKGRFTISRDNAKNTLYLQMNNLKTEDTAVYYCATGG
LRGQGTQVTVSS

Mouse Anti-Gp130 V<sub>H</sub>H Antibody SEQ ID NO:312

QVQLQESGGGSVQAGGSLRLSCVISGFTYRPTFMGWFRQVLGKEREGVAA
ITTGGGSTLYADSVKGRFTISQDSSKNTVYLEMNGLKLEDTGMYYCAATT
VITSVSINRNLYQYWGQGTQVTVSS

Mouse Anti-Gp130 V$_H$H Antibody SEQ ID NO:313

QVQLQESGGGSVQAGGSLRLSCVISG<u>FTYKQTFMG</u>WFRQVPGKEREGVA<u>A</u>
<u>ISTGGGSTVY</u>ADSVKGRFTISQDSSKNTVYLEMNGLKLEDTGMYYCAA<u>ST</u>
<u>VITSVTINRGLYQY</u>WGQGTQVTVSS

Mouse Anti-Gp130 V$_H$H Antibody SEQ ID NO:314

QVQLQESGGGSVQAGGSLRLSCVISG<u>FVYKQTFMG</u>WFRQVPGKEREGVA<u>A</u>
<u>ISTGGGSTVY</u>ADSVKGRFTISQDSSKNTVYLEMNGLKLEDTGMYYCAA<u>ST</u>
<u>VITSVSINRGLYQY</u>WGQGTQVTVSS

Mouse Anti-Gp130 V$_H$H Antibody SEQ ID NO:315

QVQLQESGGGSVQAGGSLRVSCVISG<u>FTYRQTFMG</u>WFRQVPGKEREGVA<u>A</u>
<u>ISTGGGSTVY</u>ADSVKGRFTISQDSSKNTVYLEMNGLKLEDTGMYYCAA<u>ST</u>
<u>VITSVSINRGLYQY</u>WGQGTQVTVSS

Mouse Anti-Gp130 V$_H$H Antibody SEQ ID NO:316

QVQLQESGGGLVQPGGSLRLSCAASG<u>FTFSSYAMS</u>WVRQAPGKGLEWVS<u>A</u>
<u>INSGGGSTYY</u>ADSVKGRFTISRDNAKSTLYLQLNSLKTEDTAMYYCTK<u>HV</u>
<u>TGDYDPSLRYEYNY</u>WSQGTQVTVSS

Mouse Anti-Gp130 V$_H$H Antibody SEQ ID NO:317

QVQLQESGGGLVQPGGSLRLSCAASG<u>FTFSSYAMS</u>WVRQAPGKGLEWVS<u>A</u>
<u>INSGGASTYY</u>ADSVKGRFTISRDNAKNTLYLQLNSLKTEDTAMYCCAK<u>HV</u>
<u>TGDYDPSLRYEYNC</u>WGPGTQVTVSS

Mouse Anti-Gp130 V$_H$H Antibody SEQ ID NO:318

QVQLQESGGGLVQPGGSLRLSCAASG<u>FTFSSYAMS</u>WVRQAPGKGLEWVS<u>A</u>
<u>INSGGGSTYY</u>ADSVKGRFTISRDNAKNTLYLQLNSLKTEDTAMYYCAK<u>HV</u>
<u>TGDYDPSLRYEYNY</u>WSQGTQVTVSS

Mouse Anti-Gp130 V$_H$H Antibody SEQ ID NO:319

QVQLQESGGGSVQAGGSLRLSCVISG<u>FTYRQTFMG</u>WFRQVVGKEREGVA<u>A</u>
<u>ISTGGGSTVY</u>ADSVKGRFTISQDSSKDTVYLEMNGLKLEDTGMYYCAA<u>ST</u>
<u>VITSESINRNLYQY</u>WGQGTQVTVSS

Mouse Anti-Gp130 V$_H$H Antibody SEQ ID NO:320

QVQLQESGGGSVQAGGSLRVSCVVSG<u>FTYRQTFMG</u>WFRQVPGKEREGVA<u>A</u>
<u>ISTGGGSTVY</u>ADSVKGRFTISQDSSKNTVYLEMNGLKLEDTGMYYCAA<u>ST</u>
<u>VITSVSINRNLYQY</u>WGQGTQVTVSS

Mouse Anti-Gp130 V$_H$H Antibody SEQ ID NO:321

QVQLQESGGGLVQPGGSLRLSCAASG<u>FTFSSYAMS</u>WVRQAPGKGLEWVS<u>A</u>
<u>INSGGGSTYY</u>ADSVKGRFTISRDNAKNTMYLQLNSLKTEDTAMYYCAK<u>HV</u>
<u>AGDYDPSLRYEWHV</u>WGQGTQVTVSS

Mouse Anti-Gp130 V$_H$H Antibody SEQ ID NO:322

QVQLQESGGGLVQPGGSLRLSCAASG<u>FTFRSYAMS</u>WVRQAPGKGLEWVS<u>A</u>
<u>INSGGGSTYY</u>ADSVKARFTISRDNAKNTLYLQLNSLKTEDTAMYYCAK<u>HV</u>
<u>TGDYDPSLRYEYNY</u>WGQGTQVTVSS

Mouse Anti-Gp130 V$_H$H Antibody SEQ ID NO:323

QVQLQESGGGLVQPGGSLRLSCAASG<u>FTFSSYAMS</u>WVRQAPGKGLEWVS<u>A</u>
<u>INSGGGSTYY</u>ADSVKGRFTISRDNAKNTLYLQLNSLKTEDTAMYYCAK<u>HI</u>
<u>TGDYDPSLRYEYNY</u>WGQGTQVTVSS

Mouse Anti-Gp130 V$_H$H Antibody SEQ ID NO:324

QVQLQESGGGSVQAGGSLRLSCVISG<u>FTYRQTFMG</u>WFRQVVGKEREGVA<u>A</u>
<u>ISTGGGSMVY</u>ADSVKGRFTISQDSSKDTVYLEMNGLKLEDTGMYYCAA<u>ST</u>
<u>VITSESINRNLYQY</u>WGQGTQVTVSS

Mouse Anti-Gp130 V$_H$H Antibody SEQ ID NO:325

QVQLQESGGGPVQAGGSLRLSCVISG<u>FTYRQTFMG</u>WFRQVPGKEREGVA<u>A</u>
<u>ISTGGGSTVY</u>ADSVKGRFTISQDSSKNTVYLEMNGLKLEDTGMYYCAA<u>ST</u>
<u>VITSESINRGLYQY</u>WGQGTQVTVSS

Mouse Anti-Gp130 V$_H$H Antibody SEQ ID NO:326

QVQLQESGGGSVQAGGFLRLSCAFSG<u>YTGCMG</u>WFRQGPGQEREGVAS<u>IND</u>
<u>GGSLTY</u>ADSVKGRFTISKDNAKKTLDLQMNTLKPEDTAMYYCAA<u>SLSYCL</u>
<u>NPTLRVDGYNY</u>WGQGTQVTVSS

Mouse Anti-Gp130 V$_H$H Antibody SEQ ID NO:327

QVQLQESGGGSVQAGGSLRLSCVISG<u>LTYKQTFMG</u>WFRQVPGKEREGVA<u>A</u>
<u>ISTGGGSTVY</u>ADSVKGRFTISQDNSKNTVYLEMNGLKLEDTGMYYCAA<u>ST</u>
<u>VITSVSINRYLYQW</u>WGQGTQVTVSS

Mouse Anti-Gp130 V$_H$H Antibody SEQ ID NO:328

QVQLQESGGGLVQPGGSLRLSCAASG<u>FTFSNYAMS</u>WVRQAPGKGVEWVS<u>A</u>
<u>INSGGSVFY</u>ADSVKGRFTISRDNAKNTLYLQLSSLKTEDTAMYYCAK<u>HVT</u>
<u>GDYDPSLRYGYNV</u>WSQGTQVTVSS

Mouse Anti-Gp130 V$_H$H Antibody SEQ ID NO:329

QVQLQESGGGSVQAGGSLRLSCGISG<u>FTYRPTFMGW</u>FRQVLGKEREGVAA
ISTGGGSTVYADSVKGRFTISQDSSKDTVYLEMNGLKLEDTGMYYCAA<u>ST
VITSESINRNLY</u>QYWGQGTQVTVSS

Mouse Anti-Gp130 V$_H$H Antibody SEQ ID NO:330

QVQLQESGGGLVQPGGSLRLSCAASG<u>FTFSSYAMSW</u>VRQAPGKGLEWVS<u>A
INSGGGSTYYADSVKG</u>RFTISRDNAKNTLYLQLNSLKTEDTAMYYCAK<u>HV
TGDYDPSLRYGYNV</u>WSQGTQVTVSS

Mouse Anti-Gp130 V$_H$H Antibody SEQ ID NO:331

QVQLQESGGGLVQPGGSLRLSCAASG<u>FTFSSYAMSW</u>VRQAPGKGLEWVS<u>A
INLGGDTTYYTDSVKG</u>RFTISRDNAKNTLYLQLNSLKTEDTAMYYCAK<u>HV
TGDYDPSLRYEYGYW</u>SQGTQVTVSS

Mouse Anti-Gp130 V$_H$H Antibody SEQ ID NO:332

QVQLQESGGGLVQPGGSLRLSCTASG<u>FTFNSAHLKW</u>ERQPPGKGLEWVS<u>F
ITNGGASTGYADSVKG</u>RFTISRDDAKNTLYLQMNNLKTEDTAVYYCATGG
LRGQGTQVTVSS

Mouse Anti-Gp130 V$_H$H Antibody SE ID NO:333

QVQLQESGGGSVQAGGSLRVSCVISG<u>FTYRQTFMGW</u>FRQVPGKEREGVAA
ISTGGGSTIYANSVKGRFTISQDSSKNTVYLEMNGLKLEDTGMYYCAA<u>ST
VITSVSINRGLY</u>QYWGQGTQVTVSS

Mouse Anti-Gp130 V$_H$H Antibody SEQ ID NO:334

QVQLQESGGGLVQPGGSLRLSCAASG<u>FTFSSYAMSW</u>VRQAPGKGLEWVS<u>A
INSGGGSTYYADSVKG</u>RFTISRDNAKNTLYLQLNSLKTEDTAMYCCAK<u>HI
TGDYDPSLRYEYNC</u>WGQGTQVTVSS

Mouse Anti-Gp130 V$_H$H Antibody SEQ ID NO:335

QVQLQESGGGSVQAGGSLRLSCVISG<u>FTYKQTFMGW</u>FRQVPGKEREGVAA
ISTGGGNTVYADSVKGRFTISQDSSKNTVYLEMNGLKLEDTGMYYCAA<u>ST
VITSVTVNRGLY</u>QYWGQGTQVTVSS

Mouse Anti-Gp130 V$_H$H Antibody SEQ ID NO:336

QVQLQESGGALVQPGGSLRLSCAASG<u>FTFSYYAMKW</u>VRQAPGKGLEWVS<u>S
ISGGGGATYYADSVKG</u>RFTISRDNTNDTLYLQMNSLKTEDTAVYYCAA<u>QN
LDYR</u>GQGTQVTVSS

Mouse Anti-Gp130 V$_H$H Antibody SEQ ID NO:337

QVQLQESGGGSVQAGGSLRLSCVISG<u>FTYKQTFMGW</u>FRQVPGKEREGVAA
ISTGGGSTVYADSVKGRFTISQESSKNTVYLEMNGLKLEDTGMYYCAA<u>ST
VITSVTINRGLY</u>QYWGQGTQVTVSS

In some embodiments, a V$_H$H described herein can be humanized to contain human framework regions. Examples of human germlines that could be used to create humanized VHHs include, but are not limited to, VH3-23 (e.g., UniProt ID: P01764), VH3-74 (e.g., UniProtID: A0A0B4J1X5), VH3-66 (e.g., UniProtID: A0A0C4DH42), VH3-30 (e.g., UniProt ID: P01768), VH3-11 (e.g., UniProt ID: P01762), and VH3-9 (e.g., UniProt ID: P01782).

In some embodiments, the IL27R binding protein has a reduced $E_{max}$ compared to the $E_{max}$ caused by IL27. $E_{max}$ reflects the maximum response level in a cell type that can be obtained by a ligand (e.g., a binding protein described herein or the native cytokine (e.g., IL27)). In some embodiments, the IL27R binding protein described herein has at least 1% (e.g., between 1% and 100%, between 10% and 100%, between 20% and 100%, between 30% and 100%, between 40% and 100%, between 50% and 100%, between 60% and 100%, between 70% and 100%, between 80% and 100%, between 90% and 100%, between 1% and 90%, between 1% and 80%, between 1% and 70%, between 1% and 60%, between 1% and 50%, between 10% and 40%, between 10% and 30%, between 10% and 20%, or between 10% and 10%) of the $E_{max}$ caused by IL27. In other embodiments, the $E_{max}$ of the IL27R binding protein described herein is greater (e.g., at least 1%, 5%, 10, 15%, 20%, 25%, 30%, 35%, 40%, 45%, or 50% greater) than the $E_{max}$ of the natural ligand, IL27. In some embodiments, by varying the linker length of the IL27R binding protein, the $E_{max}$ of the IL27R binding protein can be changed. The IL27R binding protein can cause $E_{max}$ in the most desired cell types, and a reduced $E_{max}$ in other cell types.

IV. Linkers

As previously described, the binding domains of the binding proteins of the present disclosure may be joined contiguously (e.g., the C-terminal amino acid of the first V$_H$H in the binding protein to the N-terminal amino acid of the second V$_H$H in the binding protein) or the binding domains of the binding protein may optionally be joined via a linker. A linker is a linkage between two elements, e.g., protein domains. In a bispecific V$_H$H$^2$ binding protein described herein, a linker is a linkage between the two VHHs in the binding protein. A linker can be a covalent bond or a peptide linker. In some embodiments, the two VHHs in a binding protein are joined directly (i.e., via a covalent bond). The length of the linker between two V$_H$Hs in a binding protein can be used to modulate the proximity of the two V$_H$Hs of the binding protein. By varying the length of the linker, the overall size and length of the binding protein can be tailored to bind to specific cell receptors or domains or subunits thereof. For example, if the binding protein is designed to bind to two receptors or domains or subunits thereof that are located close to each other on the same cell, then a short linker can be used. In another example, if the binding protein is designed to bind to two receptors or domains or subunits thereof that are located on two different cells, then a long linker can be used.

In some embodiments, the linker is a peptide linker. A peptide linker can include between 1 and 50 amino acids (e.g., between 2 and 50, between 5 and 50, between 10 and 50, between 15 and 50, between 20 and 50, between 25 and 50, between 30 and 50, between 35 and 50, between 40 and 50, between 45 and 50, between 2 and 45, between 2 and 40, between 2 and 35, between 2 and 30, between 2 and 25, between 2 and 20, between 2 and 15, between 2 and 10, between 2 and 5 amino acids). A linker can also be a chemical linker, such as a synthetic polymer, e.g., a polyethylene glycol (PEG) polymer.

In some embodiments, a linker joins the C-terminus of the first $V_HH$ in the binding protein to the N-terminus of the second $V_HH$ in the binding protein. In other embodiments, a linker joins the C-terminus of the second $V_HH$ in the binding protein to the N-terminus of the first $V_HH$ in the binding protein.

Suitable peptide linkers are known in the art, and include, for example, peptide linkers containing flexible amino acid residues such as glycine and serine. In certain embodiments, a peptide linker can contain motifs, e.g., multiple or repeating motifs, of GS, GGS, GGGGS (SEQ ID NO:85), GGGGGS (SEQ ID NO:86), GGSG (SEQ ID NO:87), or SGGG (SEQ ID NO:88). In certain embodiments, a peptide linker can contain 2 to 12 amino acids including motifs of GS, e.g., GS, GSGS (SEQ ID NO:89), GSGSGS (SEQ ID NO:90), GSGSGSGS (SEQ ID NO:91), GSGSGSGSGS (SEQ ID NO:92), or GSGSGSGSGSGS (SEQ ID NO:93). In certain other embodiments, a peptide linker can contain 3 to 12 amino acids including motifs of GGS, e.g., GGS, GGSGGS (SEQ ID NO:94), GGSGGSGGS (SEQ ID NO:95), and GGSGGSGGSGGS (SEQ ID NO:96). In yet other embodiments, a peptide linker can contain 4 to 20 amino acids including motifs of GGSG (SEQ ID NO:87), e.g., GGSGGGSG (SEQ ID NO:97), GGSGGGSGGGSG (SEQ ID NO:98), GGSGGGSGGGSGGGSG (SEQ ID NO:99), or GGSGGGSGGGSGGGSGGGSG (SEQ ID NO:100). In other embodiments, a peptide linker can contain motifs of GGGGS (SEQ ID NO:85), e.g., GGGGSGGGGS (SEQ ID NO:101) or GGGGSGGGGSGGGGS (SEQ ID NO:102).

Examples of flexible linkers include glycine polymers (G)n, glycine-alanine polymers, alanine-serine polymers, glycine-serine polymers (for example, (GmSo)n (SEQ ID NO: 1535), (GSGGS)n (SEQ ID NO: 1536), (GmSoGm)n (SEQ ID NO: 1537), (GmSoGmSoGm)n (SEQ ID NO: 1538), (GSGGSm)n (SEQ ID NO: 1539), (GSGSmG)n (SEQ ID NO: 1540), (GGS)nG (SEQ ID NO: 1541) and (GGGSm)n (SEQ ID NO: 1542), and combinations thereof, where m, n, and o are each independently selected from an integer of at least 1 to 20, e.g., 1-18, 216, 3-14, 4-12, 5-10, 1, 2, 3, 4, 5, 6, 7, 8, 9, or 10), and other flexible linkers. Glycine and glycine-serine polymers are relatively unstructured, and therefore may serve as a neutral tether between components. Examples of flexible linkers include, but are not limited to GGSG (SEQ ID NO:87), GGSGG (SEQ ID NO:103), GSGSG (SEQ ID NO:104), GSGGG (SEQ ID NO: 105), GGGSG (SEQ ID NO: 106), and GSSSG (SEQ ID NO: 107).

Additional examples of flexible linkers include glycine polymers (G)n or glycine-serine polymers (e.g., (GS)n (SEQ ID NO: 1543), (GSGGS)n (SEQ ID NO: 1544), (GGGS)n (SEQ ID NO: 1545) and (GGGGS)n (SEQ ID NO: 1546), where n=1 to 50, for example, 1, 2, 3, 4, 5, 6, 7, 8, 9, 10, 10-20, 20-30, 30-50). Exemplary flexible linkers include, but are not limited to GGGS (SEQ ID NO:108), GGGGS (SEQ ID NO:85), GGSG (SEQ ID NO:87), GGSGG (SEQ ID NO:103), GSGSG (SEQ ID NO:104), GSGGG (SEQ ID NO:105), GGGSG (SEQ ID NO:106), and GSSSG (SEQ ID NO:107).

V. Modifications to Extend Duration of Action In Vivo

The binding proteins described herein can be modified to provide for an extended lifetime in vivo and/or extended duration of action in a subject. In some embodiments, the binding protein can be conjugated to carrier molecules to provide desired pharmacological properties such as an extended half-life. In some embodiments, the binding protein can be covalently linked to the Fc domain of IgG, albumin, or other molecules to extend its half-life, e.g., by pegylation, glycosylation, and the like as known in the art.

In some embodiments, the binding protein is conjugated to a functional domain of an Fc-fusion chimeric polypeptide molecule. Fc fusion conjugates have been shown to increase the systemic half-life of biopharmaceuticals, and thus the biopharmaceutical product can require less frequent administration. Fc binds to the neonatal Fc receptor (FcRn) in endothelial cells that line the blood vessels, and, upon binding, the Fc fusion molecule is protected from degradation and re-released into the circulation, keeping the molecule in circulation longer. This Fc binding is believed to be the mechanism by which endogenous IgG retains its long plasma half-life. More recent Fc-fusion technology links a single copy of a biopharmaceutical to the Fc region of an antibody to optimize the pharmacokinetic and pharmacodynamic properties of the biopharmaceutical as compared to traditional Fc-fusion conjugates. The "Fc region" useful in the preparation of Fc fusions can be a naturally occurring or synthetic polypeptide that is homologous to an IgG C-terminal domain produced by digestion of IgG with papain. IgG Fc has a molecular weight of approximately 50 kDa. The binding protein described herein can be conjugated to the entire Fc region, or a smaller portion that retains the ability to extend the circulating half-life of a chimeric polypeptide of which it is a part. In addition, full-length or fragmented Fc regions can be variants of the wild-type molecule. In a typical presentation, each monomer of the dimeric Fc can carry a heterologous polypeptide, the heterologous polypeptides being the same or different.

In some embodiments, when the binding protein described herein is to be administered in the format of an Fc fusion, particularly in those situations when the polypeptide chains conjugated to each subunit of the Fc dimer are different, the Fc fusion may be engineered to possess a "knob-into-hole modification." The knob-into-hole modification is more fully described in Ridgway, et al. (1996) Protein Engineering 9(7):617-621 and U.S. Pat. No. 5,731,168, issued Mar. 24, 1998. The knob-into-hole modification refers to a modification at the interface between two immunoglobulin heavy chains in the CH3 domain, wherein: i) in a CH3 domain of a first heavy chain, an amino acid residue is replaced with an amino acid residue having a larger side chain (e.g., tyrosine or tryptophan) creating a projection from the surface ("knob"), and ii) in the CH3 domain of a second heavy chain, an amino acid residue is replaced with an amino acid residue having a smaller side chain (e.g., alanine or threonine), thereby generating a cavity ("hole") at interface in the second CH3 domain within which the protruding side chain of the first CH3 domain ("knob") is received by the cavity in the second CH3 domain. In one embodiment, the "knob-into-hole modification" comprises the amino acid substitution T366W and optionally the amino acid substitution S354C in one of the antibody heavy chains, and the amino acid substitutions T366S, L368A, Y407V and optionally Y349C in the other one of the antibody heavy chains. Furthermore, the Fe domains may be modified by the introduction of cysteine residues at positions S354 and Y349 which results in a stabilizing disulfide bridge between the two antibody heavy chains in the Fc region (Carter, et al. (2001) Immunol Methods 248, 7-15). The knob-into-hole format is used to facilitate the expression of a first polypeptide on a first Fc monomer with a "knob" modification and a second polypeptide on the second Fc monomer possessing a "hole" modification to facilitate the expression of heterodimeric polypeptide conjugates.

In some embodiments, the binding protein can be conjugated to one or more water-soluble polymers. Examples of water soluble polymers useful in the practice of the present disclosure include polyethylene glycol (PEG), poly-propylene glycol (PPG), polysaccharides (polyvinylpyrrolidone, copolymers of ethylene glycol and propylene glycol, poly (oxyethylated polyol), polyolefinic alcohol), polysaccharides), poly-alpha-hydroxy acid), polyvinyl alcohol (PVA), polyphosphazene, polyoxazolines (POZ), poly(N-acryloylmorpholine), or a combination thereof.

In some embodiments, binding protein can be conjugated to one or more polyethylene glycol molecules or "PEGylated." Although the method or site of PEG attachment to the binding protein may vary, in certain embodiments the PEGylation does not alter, or only minimally alters, the activity of the binding protein.

In some instances, when employing the $V_HH$ sequences describe herein in the preparation of the IL27 binding molecules of the present disclosure, the $V_HH$ possesses an N-terminal glutamine ("1Q") residue. N-terminal glutamine residues have been observed to spontaneously cyclyize to form pyroglutamate (pE) at or near physiological conditions. (See e.g., Liu, et al (2011) J. Biol. Chem. 286(13): 11211-11217). In some embodiments, the formation of pyroglutamate complicates N-terminal PEG conjugation particularly when aldehyde chemistry is used for N-terminal PEGylation. Consequently, when PEGylating the IL27R binding molecules of the present disclosure, particularly when aldehyde chemistry is to be employed, the IL27Rα binding molecules possessing an amino acid at position 1 (e.g., 1Q) are substituted at position 1 with an alternative amino acid or are deleted at position 1 (e.g., des-1Q). In some embodiments, the IL27R binding molecules of the present disclosure comprise an amino acid substitution selected from the group Q1E and Q1D.

In some embodiments, selective PEGylation of the binding protein, for example, by the incorporation of non-natural amino acids having side chains to facilitate selective PEG conjugation, may be employed. Specific PEGylation sites can be chosen such that PEGylation of the binding protein does not affect its binding to the target receptors.

In certain embodiments, the increase in half-life is greater than any decrease in biological activity. PEGs suitable for conjugation to a polypeptide sequence are generally soluble in water at room temperature, and have the general formula $R(O—CH_2—CH_2)_nO—R$, where R is hydrogen or a protective group such as an alkyl or an alkanol group, and where n is an integer from 1 to 1000. When R is a protective group, it generally has from 1 to 8 carbons. The PEG conjugated to the polypeptide sequence can be linear or branched. Branched PEG derivatives, "star-PEGs" and multi-armed PEGs are contemplated by the present disclosure.

A molecular weight of the PEG used in the present disclosure is not restricted to any particular range. The PEG component of the binding protein can have a molecular mass greater than about 5 kDa, greater than about 10 kDa, greater than about 15 kDa, greater than about 20 kDa, greater than about 30 kDa, greater than about 40 kDa, or greater than about 50 kDa. In some embodiments, the molecular mass is from about 5 kDa to about 10 kDa, from about 5 kDa to about 15 kDa, from about 5 kDa to about 20 kDa, from about 10 kDa to about 15 kDa, from about 10 kDa to about 20 kDa, from about 10 kDa to about 25 kDa, or from about 10 kDa to about 30 kDa. Linear or branched PEG molecules having molecular weights from about 2,000 to about 80,000 daltons, alternatively about 2,000 to about 70,000 daltons, alternatively about 5,000 to about 50,000 daltons, alternatively about 10,000 to about 50,000 daltons, alternatively about 20,000 to about 50,000 daltons, alternatively about 30,000 to about 50,000 daltons, alternatively about 20,000 to about 40,000 daltons, or alternatively about 30,000 to about 40,000 daltons. In one embodiment of the disclosure, the PEG is a 40 kD branched PEG comprising two 20 kD arms.

The present disclosure also contemplates compositions of conjugates wherein the PEGs have different n values, and thus the various different PEGs are present in specific ratios. For example, some compositions comprise a mixture of conjugates where n=1, 2, 3 and 4. In some compositions, the percentage of conjugates where n=1 is 18-25%, the percentage of conjugates where n=2 is 50-66%, the percentage of conjugates where n=3 is 12-16%, and the percentage of conjugates where n=4 is up to 5%. Such compositions can be produced by reaction conditions and purification methods known in the art. Chromatography may be used to resolve conjugate fractions, and a fraction is then identified which contains the conjugate having, for example, the desired number of PEGs attached, purified free from unmodified protein sequences and from conjugates having other numbers of PEGs attached.

PEGs suitable for conjugation to a polypeptide sequence are generally soluble in water at room temperature, and have the general formula $R(O—CH_2—CH_2)_nO—R$, where R is hydrogen or a protective group such as an alkyl or an alkanol group, and where n is an integer from 1 to 1000. When R is a protective group, it generally has from 1 to 8 carbons.

Two widely used first generation activated monomethoxy PEGs (mPEGs) are succinimdyl carbonate PEG (SC-PEG; see, e.g., Zalipsky, et al. (1992) Biotehnol. Appl. Biochem 15:100-114) and benzotriazole carbonate PEG (BTC-PEG; see, e.g., Dolence, et al. U.S. Pat. No. 5,650,234), which react preferentially with lysine residues to form a carbamate linkage but are also known to react with histidine and tyrosine residues. Use of a PEG-aldehyde linker targets a single site on the N-terminus of a polypeptide through reductive amination.

Pegylation most frequently occurs at the α-amino group at the N-terminus of the polypeptide, the epsilon amino group on the side chain of lysine residues, and the imidazole group on the side chain of histidine residues. Since most recombinant polypeptides possess a single alpha and a number of epsilon amino and imidazole groups, numerous positional isomers can be generated depending on the linker chemistry. General PEGylation strategies known in the art can be applied herein.

The PEG can be bound to a binding protein of the present disclosure via a terminal reactive group (a "spacer") which mediates a bond between the free amino or carboxyl groups of one or more of the polypeptide sequences and polyethylene glycol. The PEG having the spacer which can be bound to the free amino group includes N-hydroxysuccinylimide polyethylene glycol, which can be prepared by activating succinic acid ester of polyethylene glycol with N-hydroxysuccinylimide.

In some embodiments, the PEGylation of the binding proteins is facilitated by the incorporation of non-natural amino acids bearing unique side chains to facilitate site specific PEGylation. The incorporation of non-natural amino acids into polypeptides to provide functional moieties to achieve site specific PEGylation of such polypeptides is known in the art. See e.g., Ptacin et al., PCT International Application No. PCT/US2018/045257 filed Aug. 3, 2018 and published Feb. 7, 2019 as International Publication Number WO 2019/028419A1.

The PEG conjugated to the polypeptide sequence can be linear or branched. Branched PEG derivatives, "star-PEGs" and multi-armed PEGs are contemplated by the present disclosure. Specific embodiments PEGs useful in the practice of the present disclosure include a 10 kDa linear PEG-aldehyde (e.g., Sunbright® ME-100AL, NOF America Corporation, One North Broadway, White Plains, NY 10601 USA), 10 kDa linear PEG-NHS ester (e.g., Sunbright® ME-100CS, Sunbright® ME-100AS, Sunbright® ME-100GS, Sunbright® ME-100HS, NOF), a 20 kDa linear PEG-aldehyde (e.g., Sunbright® ME-200AL, NOF), a 20 kDa linear PEG-NHS ester (e.g., Sunbright® ME-200CS, Sunbright® ME-200AS, Sunbright® ME-200GS, Sunbright® ME-200HS, NOF), a 20 kDa 2-arm branched PEG-aldehyde the 20 kDA PEG-aldehyde comprising two 10 kDA linear PEG molecules (e.g., Sunbright® GL2-200AL3, NOF), a 20 kDa 2-arm branched PEG-NHS ester the 20 kDA PEG-NHS ester comprising two 10 kDA linear PEG molecules (e.g., Sunbright® GL2-200TS, Sunbright® GL200GS2, NOF), a 40 kDa 2-arm branched PEG-aldehyde the 40 kDA PEG-aldehyde comprising two 20 kDA linear PEG molecules (e.g., Sunbright® GL2-400AL3), a 40 kDa 2-arm branched PEG-NHS ester the 40 kDA PEG-NHS ester comprising two 20 kDA linear PEG molecules (e.g., Sunbright® GL2-400AL3, Sunbright® GL2-400GS2, NOF), a linear 30 kDa PEG-aldehyde (e.g., Sunbright® ME-300AL) and a linear 30 kDa PEG-NHS ester.

In some embodiments, a linker can used to join the binding protein and the PEG molecule. Suitable linkers include "flexible linkers" which are generally of sufficient length to permit some movement between the modified polypeptide sequences and the linked components and molecules. The linker molecules are generally about 6-50 atoms long. The linker molecules may also be, for example, aryl acetylene, ethylene glycol oligomers containing 2-10 monomer units, diamines, diacids, amino acids, or combinations thereof. Suitable linkers can be readily selected and can be of any suitable length, such as 1 amino acid (e.g., Gly), 2, 3, 4, 5, 6, 7, 8, 9, 10, 10-20, 20-30, 30-50 or more than 50 amino acids. Examples of flexible linkers are described in Section IV. Further, a multimer (e.g., 1, 2, 3, 4, 5, 6, 7, 8, 9, 10, 10-20, 20-30, or 30-50) of these linker sequences may be linked together to provide flexible linkers that may be used to conjugate two molecules. Alternative to a polypeptide linker, the linker can be a chemical linker, e.g., a PEG-aldehyde linker. In some embodiments, the binding protein is acetylated at the N-terminus by enzymatic reaction with N-terminal acetyltransferase and, for example, acetyl CoA. Alternatively, or in addition to N-terminal acetylation, the binding protein can be acetylated at one or more lysine residues, e.g., by enzymatic reaction with a lysine acetyltransferase. See, for example Choudhary et al. (2009) Science 325 (5942):834-840.

In other embodiments, the binding protein can be modified to include an additional polypeptide sequence that functions as an antigenic tag, such as a FLAG sequence. FLAG sequences are recognized by biotinylated, highly specific, anti-FLAG antibodies, as described herein (see e.g., Blanar et al. (1992) Science 256:1014 and LeClair, et al. (1992) PNAS-USA 89:8145). In some embodiments, the binding protein further comprises a C-terminal c-myc epitope tag.

In some embodiments, the binding protein is expressed as a fusion protein with an albumin molecule (e.g., human serum albumin) which is known in the art to facilitate extended exposure in vivo.

In some embodiment, the binding proteins (including fusion proteins of the binding proteins) of the present disclosure are expressed as a fusion protein with one or more transition metal chelating polypeptide sequences. The incorporation of such a transition metal chelating domain facilitates purification immobilized metal affinity chromatography (IMAC) as described in Smith, et al. U.S. Pat. No. 4,569,794 issued Feb. 11, 1986. Examples of transition metal chelating polypeptides useful in the practice of the present disclosure are described in Smith, et al. supra and Dobeli, et al. U.S. Pat. No. 5,320,663 issued May 10, 1995, the entire teachings of which are hereby incorporated by reference. Particular transition metal chelating polypeptides useful in the practice of the present disclosure are peptides comprising 3-6 contiguous histidine residues (SEQ ID NO: 1547) such as a six-histidine peptide $(His)_6$ (SEQ ID NO: 1531) and are frequently referred to in the art as "His-tags."

The foregoing fusion proteins may be readily produced by recombinant DNA methodology by techniques known in the art by constructing a recombinant vector comprising a nucleic acid sequence comprising a nucleic acid sequence encoding the binding protein in frame with a nucleic acid sequence encoding the fusion partner either at the N-terminus or C-terminus of the binding protein, the sequence optionally further comprising a nucleic acid sequence in frame encoding a linker or spacer polypeptide.

VI. Pharmaceutical Composition

The binding proteins of the present disclosure may be administered to a subject in a pharmaceutically acceptable dosage form. The preferred formulation depends on the intended mode of administration and therapeutic application. Pharmaceutical dosage forms of the binding proteins described herein comprise physiologically acceptable carriers that are inherently non-toxic and non-therapeutic. Examples of such carriers include ion exchangers, alumina, aluminum stearate, lecithin, serum proteins, such as human serum albumin, buffer substances such as phosphates, glycine, sorbic acid, potassium sorbate, partial glyceride mixtures of saturated vegetable fatty acids, water, salts, or electrolytes such as protamine sulfate, disodium hydrogen phosphate, potassium hydrogen phosphate, sodium chloride, zinc salts, colloidal silica, magnesium trisilicate, polyvinyl pyrrolidone, cellulose-based substances, and PEG. Carriers for topical or gel-based forms of polypeptides include polysaccharides such as sodium carboxymethylcellulose or methylcellulose, polyvinylpyrrolidone, polyacrylates, polyoxyethylene-polyoxypropylene-block polymers, PEG, polymeric amino acids, amino acid copolymers, and lipid aggregates (such as oil droplets or liposomes).

The pharmaceutical compositions may also comprise pharmaceutically-acceptable, non-toxic carriers, excipients, stabilizers, or diluents, which are defined as vehicles commonly used to formulate pharmaceutical compositions for animal or human administration. The diluent is selected so as not to affect the biological activity of the combination. Acceptable carriers, excipients, or stabilizers are non-toxic to recipients at the dosages and concentrations employed, and include buffers such as phosphate, citrate, and other organic acids; antioxidants including ascorbic acid and methionine; preservatives (such as octadecyidimethylbenzyl ammonium chloride; hexamethonium chloride; benzalkonium chloride, benzethonium chloride; phenol, butyl or benzyl alcohol; alkyl parabens such as methyl or propyl paraben; catechol; resorcinol; cyclohexanol; 3-pentanol; and m-cresol); low molecular weight (less than about 10 residues) polypeptides; proteins, such as serum albumin, gelatin, or immunoglobulins; hydrophilic polymers such as polyvinylpyrrolidone; amino acids such as glycine, glutamine, asparagine, histidine, arginine, or lysine; monosaccharides, disaccharides, and other carbohydrates including glucose, mannose, or dextrins; chelating agents such as EDTA; sugars such as sucrose, mannitol, trehalose or sorbitol; salt-forming counter-ions such as sodium; metal complexes (e.g., Zn-protein complexes); and/or non-ionic surfactants such as TWEEN™, PLURONICS™ or polyethylene glycol (PEG).

Formulations to be used for in vivo administration are typically sterile. Sterilization of the compositions of the present disclosure may readily accomplished by filtration through sterile filtration membranes.

Typically, compositions are prepared as injectables, either as liquid solutions or suspensions; solid forms suitable for solution in, or suspension in, liquid vehicles prior to injection can also be prepared. The preparation also can be emulsified or encapsulated in liposomes or micro particles such as polylactide, polyglycolide, or copolymer for enhanced adjuvant effect, as discussed above (Langer, Science 249: 1527, 1990 and Hanes, Advanced Drug Delivery Reviews 28: 97-119, 1997). The agents of this disclosure can be administered in the form of a depot injection or implant preparation which can be formulated in such a manner as to permit a sustained or pulsatile release of the active ingredient. The pharmaceutical compositions are generally formulated as sterile, substantially isotonic and in full compliance with all Good Manufacturing Practice (GMP) regulations of the U.S. Food and Drug Administration.

Administration of a binding protein described herein may be achieved through any of a variety of art recognized methods including but not limited to the topical, intravascular injection (including intravenous or intraarterial infusion), intradermal injection, subcutaneous injection, intramuscular injection, intraperitoneal injection, intracranial injection, intratumoral injection, intranodal injection, transdermal, transmucosal, iontophoretic delivery, intralymphatic injection (Senti and Kundig (2009) Current Opinions in Allergy and Clinical Immunology 9(6):537-543), intragastric infusion, intraprostatic injection, intravesical infusion (e.g., bladder), respiratory inhalers including nebulizers, intraocular injection, intraabdominal injection, intralesional injection, intraovarian injection, intracerebral infusion or injection, intracerebroventricular injection (ICVI), and the like. In some embodiments, administration includes the administration of the binding protein itself (e.g., parenteral), as well as the administration of a recombinant vector (e.g., viral or non-viral vector) to cause the in situ expression of the binding protein in the subject. Alternatively, a cell, such as a cell isolated from the subject, could also be recombinantly modified to express the binding protein of the present disclosure.

The dosage of the pharmaceutical compositions depends on factors including the route of administration, the disease to be treated, and physical characteristics, e.g., age, weight, general health, of the subject. Typically, the amount of a binding protein contained within a single dose may be an amount that effectively prevents, delays, or treats the disease without inducing significant toxicity. A pharmaceutical composition of the disclosure may include a dosage of a binding protein described herein ranging from 0.01 to 500 mg/kg (e.g., from 0.01 to 450 mg, from 0.01 to 400 mg, from 0.01 to 350 mg, from 0.01 to 300 mg, from 0.01 to 250 mg, from 0.01 to 200 mg, from 0.01 to 150 mg, from 0.01 to 100 mg, from 0.01 to 50 mg, from 0.01 to 10 mg, from 0.01 to 1 mg, from 0.1 to 500 mg/kg, from 1 to 500 mg/kg, from 5 to 500 mg/kg, from 10 to 500 mg/kg, from 50 to 500 mg/kg, from 100 to 500 mg/kg, from 150 to 500 mg/kg, from 200 to 500 mg/kg, from 250 to 500 mg/kg, from 300 to 500 mg/kg, from 350 to 500 mg/kg, from 400 to 500 mg/kg, or from 450 to 500 mg/kg) and, in a more specific embodiment, about 1 to about 100 mg/kg (e.g., about 1 to about 90 mg/kg, about 1 to about 80 mg/kg, about 1 to about 70 mg/kg, about 1 to about 60 mg/kg, about 1 to about 50 mg/kg, about 1 to about 40 mg/kg, about 1 to about 30 mg/kg, about 1 to about 20 mg/kg, about 1 to about 10 mg/kg, about 10 to about 100 mg/kg, about 20 to about 100 mg/kg, about 30 to about 100 mg/kg, about 40 to about 100 mg/kg, about 50 to about 100 mg/kg, about 60 to about 100 mg/kg, about 70 to about 100 mg/kg, about 80 to about 100 mg/kg, or about 90 to about 100 mg/kg). In some embodiments, a pharmaceutical composition of the disclosure may include a dosage of a binding protein described herein ranging from 0.01 to 20 mg/kg (e.g., from 0.01 to 15 mg/kg, from 0.01 to 10 mg/kg, from 0.01 to 8 mg/kg, from 0.01 to 6 mg/kg, from 0.01 to 4 mg/kg, from 0.01 to 2 mg/kg, from 0.01 to 1 mg/kg, from 0.01 to 0.1 mg/kg, from 0.01 to 0.05 mg/kg, from 0.05 to 20 mg/kg, from 0.1 to 20 mg/kg, from 1 to 20 mg/kg, from 2 to 20 mg/kg, from 4 to 20 mg/kg, from 6 to 20 mg/kg, from 8 to 20 mg/kg, from 10 to 20 mg/kg, from 15 to 20 mg/kg). The dosage may be adapted by the physician in accordance with conventional factors such as the extent of the disease and different parameters of the subject.

A pharmaceutical composition containing a binding protein described herein can be administered to a subject in need thereof, for example, one or more times (e.g., 1-10 times or more) daily, weekly, monthly, biannually, annually, or as medically necessary. Dosages may be provided in either a single or multiple dosage regimens. The timing between administrations may decrease as the medical condition improves or increase as the health of the patient declines. A course of therapy may be a single dose or in multiple doses over a period of time. In some embodiments, a single dose is used. In some embodiments, two or more split doses administered over a period of 1, 2, 3, 4, 5, 6, 7, 8, 9, 10, 11, 12, 13, 14, 21, 28, 30, 60, 90, 120 or 180 days are used. Each dose administered in such split dosing protocols may be the same in each administration or may be different. Multi-day dosing protocols over time periods may be provided by the skilled artisan (e.g., physician) monitoring the administration, taking into account the response of the subject to the treatment including adverse effects of the treatment and their modulation as discussed above.

VII. Indications

Immune Diseases

The present disclosure further provides methods of treating a subject suffering from a disease disorder or condition by the administration of a therapeutically effective amount of an IL27R binding protein (or nucleic acid encoding an IL27R binding protein including recombinant viruses encoding the IL27R binding protein) of the present disclosure. Disorders amenable to treatment with IL27R binding proteins (including pharmaceutically acceptable formulations comprising IL27R binding proteins and/or the nucleic acid molecules that encode them including recombinant viruses encoding such IL27R binding proteins) of the present disclosure include inflammatory or autoimmune diseases including but not limited to, viral infections (e.g., AIDS, influenza, chronic HCV, chronic viral hepatitis B, C or D), *Heliobacter pylori* infection, HTLV, organ rejection, graft versus host disease, autoimmune thyroid disease, multiple sclerosis, allergy, asthma, neurodegenerative diseases including Alzheimer's disease, systemic lupus erythramatosis (SLE), autoinflammatory diseases, inflammatory bowel disease (IBD), Crohn's disease, diabetes including Type 1 or type 2 diabetes, inflammation, autoimmune disease, atopic diseases, paraneoplastic autoimmune diseases, cartilage inflammation, arthritis, rheumatoid arthritis, juvenile arthritis, juvenile rheumatoid arthritis, juvenile rheumatoid arthritis, polyarticular juvenile rheumatoid arthritis, systemic onset juvenile rheumatoid arthritis, juvenile ankylosing spondylitis, juvenile enteropathic arthritis, juvenile reactive arthritis, juvenile Reiter's Syndrome, SEA Syndrome (Seronegativity Enthesopathy Arthropathy Syndrome), juvenile dermatomyositis, juvenile psoriatic arthritis, juvenile scleroderma, juvenile systemic lupus erythematosus, juvenile vasculitis, pauciarticular rheumatoidarthritis, polyarticular rheumatoidarthritis, systemic onset rheumatoidarthritis, ankylosing spondylitis, enteropathic arthritis, reactive arthritis, Reiter's syndrome, SEA Syndrome (Seronegativity, Enthesopathy, Arthropathy Syndrome).

Other examples of proliferative and/or differentiative disorders amenable to treatment with IL27R binding proteins (including pharmaceutically acceptable formulations comprising IL27R binding proteins and/or the nucleic acid molecules that encode them including recombinant viruses encoding such IL27R binding proteins) of the present disclosure include, but are not limited to, skin disorders. The skin disorder may involve the aberrant activity of a cell or a group of cells or layers in the dermal, epidermal, or hypodermal layer, or an abnormality in the dermal-epidermal junction. For example, the skin disorder may involve aberrant activity of keratinocytes (e.g., hyperproliferative basal and immediately suprabasal keratinocytes), melanocytes, Langerhans cells, Merkel cells, immune cell, and other cells found in one or more of the epidermal layers, e.g., the stratum basale (stratum germinativum), stratum spinosum, stratum granulosum, stratum lucidum or stratum corneum. In other embodiments, the disorder may involve aberrant activity of a dermal cell, for example, a dermal endothelial, fibroblast, immune cell (e.g., mast cell or macrophage) found in a dermal layer, for example, the papillary layer or the reticular layer.

Examples of skin disorders include psoriasis, psoriatic arthritis, dermatitis (eczema), for example, exfoliative dermatitis or atopic dermatitis, *Pityriasis rubra pilaris, Pityriasis rosacea*, parapsoriasis, *Pityriasis lichenoiders, Lichen planus, Lichen nitidus*, ichthyosiform dermatosis, keratodermas, dermatosis, alopecia areata, pyoderma gangrenosum, vitiligo, pemphigoid (e.g., ocular cicatricial pemphigoid or bullous pemphigoid), urticaria, prokeratosis, rheumatoid arthritis that involves hyperproliferation and inflammation of epithelial-related cells lining the joint capsule; dermatitises such as seborrheic dermatitis and solar dermatitis; keratoses such as seborrheic keratosis, senile keratosis, actinic keratosis, photo-induced keratosis, and keratosis follicularis; acne vulgaris; keloids and prophylaxis against keloid formation; nevi; warts including verruca, condyloma or condyloma acuminatum, and human papilloma viral (HPV) infections such as venereal warts; leukoplakia; *Lichen planus*; and keratitis. The skin disorder can be dermatitis, e.g., atopic dermatitis or allergic dermatitis, or psoriasis.

The compositions of the present disclosure (including pharmaceutically acceptable formulations comprising IL27R binding proteins and/or the nucleic acid molecules that encode them including recombinant viruses encoding such IL27R binding proteins) can also be administered to a patient who is suffering from (or may suffer from) psoriasis or psoriatic disorders. The term "psoriasis" is intended to have its medical meaning, namely, a disease which afflicts primarily the skin and produces raised, thickened, scaling, nonscarring lesions. The lesions are usually sharply demarcated erythematous papules covered with overlapping shiny scales. The scales are typically silvery or slightly opalescent. Involvement of the nails frequently occurs resulting in pitting, separation of the nail, thickening and discoloration. Psoriasis is sometimes associated with arthritis, and it may be crippling. Hyperproliferation of keratinocytes is a key feature of psoriatic epidermal hyperplasia along with epidermal inflammation and reduced differentiation of keratinocytes. Multiple mechanisms have been invoked to explain the keratinocyte hyperproliferation that characterizes psoriasis. Disordered cellular immunity has also been implicated in the pathogenesis of psoriasis. Examples of psoriatic disorders include chronic stationary psoriasis, plaque psoriasis, moderate to severe plaque psoriasis, psoriasis vulgaris, eruptive psoriasis, psoriatic erythroderma, generalized pustular psoriasis, annular pustular psoriasis, or localized pustular psoriasis.

Combination of IL27R Binding Proteins with Additional Therapeutic Agents for Autoimmune Disease:

The present disclosure provides for the use of the IL27R binding proteins of the present disclosure in combination with one or more additional active agents ("supplementary agents") in the treatment of autoimmune disease. As used herein, the term "supplementary agents" includes agents that can be administered or introduced separately, for example, formulated separately for separate administration (e.g., as may be provided in a kit) and/or therapies that can be administered or introduced in combination with the IL27R binding proteins.

As used herein, the term "in combination with" when used in reference to the administration of multiple agents to a subject refers to the administration of a first agent at least one additional (i.e., second, third, fourth, fifth, etc.) agent to a subject. For purposes of the present invention, one agent (e.g., IL27R binding protein) is considered to be administered in combination with a second agent (e.g. a therapeutic autoimmune antibody such as Humira®) if the biological effect resulting from the administration of the first agent persists in the subject at the time of administration of the second agent such that the therapeutic effects of the first agent and second agent overlap. For example, the therapeutic antibodies are sometimes administered by IV infusion every two weeks (e.g. adalimumab in the treatment of Crohn's disease) while the IL27R binding proteins of the present disclosure may be administered more frequently, e.g. daily, BID, or weekly. However, the administration of the first agent (e.g. entaercept) provides a therapeutic effect over an extended time and the administration of the second agent (e.g. an IL27R binding protein) provides its therapeutic effect while the therapeutic effect of the first agent remains ongoing such that the second agent is considered to be administered in combination with the first agent, even though the first agent may have been administered at a point in time significantly distant (e.g. days or weeks) from the time of administration of the second agent. In one embodiment, one agent is considered to be administered in combination with a second agent if the first and second agents are administered simultaneously (within 30 minutes of each other), contemporaneously or sequentially. In some embodiments, a first agent is deemed to be administered "contemporaneously" with a second agent if first and second agents are administered within about 24 hours of each another, preferably within about 12 hours of each other, preferably within about 6 hours of each other, preferably within about 2 hours of each other, or preferably within about 30 minutes of each other. The term "in combination with" shall also understood to apply to the situation where a first agent and a second agent are co-formulated in single pharmaceutically acceptable formulation and the co-formulation is administered to a subject. In certain embodiments, the IL27R binding protein and the supplementary agent(s) are administered or applied sequentially, e.g., where one agent is administered prior to one or more other agents. In other embodiments, the IL27R binding protein and the supplementary agent(s) are administered simultaneously, e.g., where two or more agents are administered at or about the same time; the two or more agents may be present in two or more separate formulations or combined into a single formulation (i.e., a co-formulation). Regardless of whether the agents are administered sequentially or simultaneously, they are considered to be administered in combination for purposes of the present disclosure.

In some embodiments, the supplementary agent is one or more agents selected from the group consisting of corticosteroids (including but not limited to prednisone, budesonide, prednilisone), Janus kinase inhibitors (including but not limited to tofacitinib (Xeljanz®), calcineurin inhibitors (including but not limited to cyclosporine and tacrolimus), mTor inhibitors (including but not limited to sirolimus and everolimus), IMDH inhibitors (including but not limited to azathioprine, leflunomide and mycophenolate), biologics such as abatcept (Orencia®) or etanercept (Enbrel®), and therapeutic antibodies. Examples of therapeutic antibodies that may be administered as supplementary agents in combination with the IL27R binding proteins of the present disclosure in the treatment of autoimmune disease include but are not limited to anti-CD25 antibodies (e.g. daclizumab and basiliximab), anti-VLA-4 antibodies (e.g. natalizumab), anti-CD52 antibodies (e.g. alemtuzumab), anti-CD20 antibodies (e.g. rituximab, ocrelizumab), anti-TNF antibodies (e.g. infliximab, and adalimumab), anti-IL6R antibodies (e.g. tocilizumab), anti-TNFα antibodies (e.g. adalimumab (Humira®), golimumab, and infliximab), anti-integrin-α4β7 antibodies (e.g. vedolizumab), anti-IL17a antibodies (e.g. brodalumab or secukinumab), anti-IL4Rα antibodies (e.g. dupilumab), anti-RANKL antibodies, IL6R antibodies, anti-IL1β antibodies (e.g. canakinumab), anti-CD11a antibodies (e.g. efalizumab), anti-CD3 antibodies (e.g. muramonab), anti-IL5 antibodies (e.g. mepolizumab, reslizumab), anti-BLyS antibodies (e.g. belimumab); and anti-IL12/IL23 antibodies (e.g ustekinumab).

Many therapeutic antibodies have been approved for clinical use against autoimmune disease. Examples of antibodies approved by the United States Food and Drug Administration (FDA) for use in the treatment of autoimmune diseases in a subject suffering therefrom that may be administered as supplementary agents in combination with the IL27R binding proteins of the present disclosure (and optionally additional supplementary agents) for the treatment of the indicated autoimmune disease are provided in Table 4.

TABLE 4

| Name | Target | Indication |
|---|---|---|
| belimumab | BLyS | Systemic lupus erythematosus |
| efalizumab | CD11a | Psoriasis |
| ocrelizumab | CD20 | Multiple sclerosis |
| rituximab | CD20 | Multiple sclerosis |
| basiliximab | CD25 | Transplantation rejection |
| daclizumab | CD25 | Transplantation rejection |
| muromonab | CD3 | Transplantation rejection |
| alemtuzumab | CD52 | Multiple sclerosis |
| omalizumab | IgE | Asthma |
| ustekinumab | IL12/IL23 | Plaque psoriasis |
| brodalumab | IL17a | Psoriasis, psoriatic arthritis, ankylosing spondylitis |
| secukinumab | IL17a | Psoriasis, psoriatic arthritis, ankylosing spondylitis |
| ixekizumab | IL17a | Psoriasis, psoriatic arthritis, ankylosing spondylitis |
| canakinumab | IL1β | Cryopyrin-associated periodic syndrome, tumor necrosis factor receptor associated periodic syndrome, hyperimmunoglobulin D syndrome, mevalonate kinase deficiency, familial Mediterranean fever, rheumatoid arthritis |
| dupilumab | IL4Rα | Asthma, dermatitis |
| mepolizumab | IL5 | Asthma |
| reslizumab | IL5 | Asthma |
| tocilizumab | IL6R | Rheumatoid arthritis |
| vedolizumab | Integrin-α4β7 | Ulcerative colitis, Crohn's disease |
| denosumab | RANKL | Osteoporosis |
| certolizumab | TNFa | Chron's disease, rheumatoid arthritis |
| golimumab | TNFa | Rheumatoid arthritis, psoriatic arthritis, ankylosing spondylitis |
| adalimumab | TNFα | Rheumatoid arthritis, juvenile idiopathic arthritis, psoriatic arthritis, ankylosing spondylitis, Crohn's disease, plaque psoriasis |
| infliximab | TNFα | Crohn's disease, ulcerative colitis, rheumatoid arthritis, ankylosing spondylitis, psoriatic arthritis, plaque psoriasis |
| ranibizumab | VEGF-A | Neovascular age-related macular degeneration, macular edema |
| natalizumab | VLA-4 | Multiple sclerosis, relapsing multiple sclerosis, Crohn's disease |

Treatment of Neoplastic Disease

The present disclosure provides methods of use of IL-27R binding molecules in the treatment of subjects suffering from a neoplastic disease disorder or condition by the administration of a therapeutically effective amount of a IL-27R binding molecule (or nucleic acid encoding a IL-27R binding molecule including recombinant vectors encoding IL-27R binding molecules, and eucaryotic and procaryotic cells modified to express a IL-27R binding molecule) as described herein.

Neoplasms Amenable to Treatment:

The compositions and methods of the present disclosure are useful in the treatment of subject suffering from a neoplastic disease characterized by the presence neoplasms, including benign and malignant neoplasms, and neoplastic disease.

Examples of benign neoplasms amenable to treatment using the compositions and methods of the present disclosure include but are not limited to adenomas, fibromas, hemangiomas, and lipomas. Examples of pre-malignant neoplasms amenable to treatment using the compositions and methods of the present disclosure include but are not limited to hyperplasia, atypia, metaplasia, and dysplasia. Examples of malignant neoplasms amenable to treatment using the compositions and methods of the present disclosure include but are not limited to carcinomas (cancers arising from epithelial tissues such as the skin or tissues that line internal organs), leukemias, lymphomas, and sarcomas typically derived from bone fat, muscle, blood vessels or connective tissues). Also included in the term neoplasms are viral induced neoplasms such as warts and EBV induced disease (i.e., infectious mononucleosis), scar formation, hyperproliferative vascular disease including intimal smooth muscle cell hyperplasia, restenosis, and vascular occlusion and the like.

The term "neoplastic disease" includes cancers characterized by solid tumors and non-solid tumors including but not limited to breast cancers; sarcomas (including but not limited to osteosarcomas and angiosarcomas and fibrosarcomas), leukemias, lymphomas, genitourinary cancers (including but not limited to ovarian, urethral, bladder, and prostate cancers); gastrointestinal cancers (including but not limited to colon esophageal and stomach cancers); lung cancers; myelomas; pancreatic cancers; liver cancers; kidney cancers; endocrine cancers; skin cancers; and brain or central and peripheral nervous (CNS) system tumors, malignant or benign, including gliomas and neuroblastomas, astrocytomas, myelodysplastic disorders; cervical carcinoma-in-situ; intestinal polyposes; oral leukoplakias; histiocytoses, hyperprofroliferative scars including keloid scars, hemangiomas; hyperproliferative arterial stenosis, psoriasis, inflammatory arthritis; hyperkeratoses and papulosquamous eruptions including arthritis.

The term neoplastic disease includes carcinomas. The term "carcinoma" refers to malignancies of epithelial or endocrine tissues including respiratory system carcinomas, gastrointestinal system carcinomas, genitourinary system carcinomas, testicular carcinomas, breast carcinomas, prostatic carcinomas, endocrine system carcinomas, and melanomas. The term neoplastic disease includes adenocarcinomas. An "adenocarcinoma" refers to a carcinoma derived from glandular tissue or in which the tumor cells form recognizable glandular structures.

As used herein, the term "hematopoietic neoplastic disorders" refers to neoplastic diseases involving hyperplastic/neoplastic cells of hematopoietic origin, e.g., arising from myeloid, lymphoid or erythroid lineages, or precursor cells thereof.

Myeloid neoplasms include, but are not limited to, myeloproliferative neoplasms, myeloid and lymphoid disorders with eosinophilia, myeloproliferative/myelodysplastic neoplasms, myelodysplastic syndromes, acute myeloid leukemia and related precursor neoplasms, and acute leukemia of ambiguous lineage. Exemplary myeloid disorders amenable to treatment in accordance with the present disclosure include, but are not limited to, acute promyeloid leukemia (APML), acute myelogenous leukemia (AML) and chronic myelogenous leukemia (CML).

Lymphoid neoplasms include, but are not limited to, precursor lymphoid neoplasms, mature B-cell neoplasms, mature T-cell neoplasms, Hodgkin's Lymphoma, and immunodeficiency-associated lymphoproliferative disorders. Exemplary lymphic disorders amenable to treatment in accordance with the present disclosure include, but are not limited to, acute lymphoblastic leukemia (ALL) which includes B-lineage ALL and T-lineage ALL, chronic lymphocytic leukemia (CLL), prolymphocytic leukemia (PLL), hairy cell leukemia (HLL) and Waldenstrom's macroglobulinemia (WM).

In some instances, the hematopoietic neoplastic disorder arises from poorly differentiated acute leukemias (e.g., erythroblastic leukemia and acute megakaryoblastic leukemia). As used herein, the term "hematopoietic neoplastic disorders" refers malignant lymphomas including, but are not limited to, non-Hodgkins lymphoma and variants thereof, peripheral T cell lymphomas, adult T-cell leukemia/lymphoma (ATL), cutaneous T cell lymphoma (CTCL), large granular lymphocytic leukemia (LGF), Hodgkin's disease and Reed-Stemberg disease.

The determination of whether a subject is "suffering from a neoplastic disease" refers to a determination made by a physician with respect to a subject based on the available information accepted in the field for the identification of a disease, disorder or condition including but not limited to X-ray, CT-scans, conventional laboratory diagnostic tests (e.g. blood count, etc.), genomic data, protein expression data, immunohistochemistry, that the subject requires or will benefit from treatment.

Assessing Anti-Neoplastic Efficacy:

The determination of efficacy of the methods of the present disclosure in the treatment of cancer is generally associated with the achievement of one or more art recognized parameters such as reduction in lesions particularly reduction of metastatic lesion, reduction in metastasis, reduction in tumor volume, improvement in ECOG score, and the like. Determining response to treatment can be assessed through the measurement of biomarker that can provide reproducible information useful in any aspect of IL-27R binding molecule therapy, including the existence and extent of a subject's response to such therapy and the existence and extent of untoward effects caused by such therapy. By way of example, but not limitation, biomarkers include enhancement of IFNγ, and upregulation of granzyme A, granzyme B, and perforin; increase in $CD8^+$ T-cell number and function; enhancement of IFNγ, an increase in ICOS expression on $CD8^+$ T-cells, enhancement of IL-10 expressing $T_{Reg}$ cells. The response to treatment may be characterized by improvements in conventional measures of clinical efficacy may be employed such as Complete Response (CR), Partial Response (PR), Stable Disease (SD) and with respect to target lesions, Complete Response (CR)," Incomplete Response/Stable Disease (SD) as defined by RECIST as well as immune-related Complete Response (irCR), immune-related Partial Response (irPR), and immune-related Stable Disease (irSD) as defined Immune-Related Response Criteria (irRC) are considered by those of skill in the art as evidencing efficacy in the treatment of neoplastic disease in mammalian (e.g. human) subjects.

Maintenance of Serum Concentration:

In some embodiments of the invention the present disclosure provides methods and compositions for the treatment and/or prevention of neoplastic diseases, disorders or conditions by the administration of a therapeutically effective amount of an IL-27R binding molecules the serum concentration of the IL-27R binding molecule is maintained for a majority (i.e., greater than about 50% of the period of time, alternatively greater than about 60%, alternatively greater than about 70%, alternatively greater than about 80%, alternatively greater than about 90%) of a period of time (e.g. at least 24 hours, alternatively at least 48 hours, alternatively at least 72 hours, alternatively at least 96 hours, alternatively at least 120 hours, alternatively at least 144 hours, alternatively at least 7 days, alternatively at least 10 days, alternatively at least 12 days, alternatively at least 14 days, alternatively at least 28 days, alternatively at least 45 days, alternatively at least 60 days, or longer) at a serum concentration at or above the therapeutically effective concentration with respect to such IL-27R binding molecule.

Combination of IL-27R Binding Molecules with Supplementary Therapeutic Agents:

The present disclosure provides for the use of the IL-27R binding molecules of the present disclosure in combination with one or more additional active agents ("supplementary agents"). Such further combinations are referred to interchangeably as "supplementary combinations" or "supplementary combination therapy" and those therapeutic agents that are used in combination with IL-27R binding molecules of the present disclosure are referred to as "supplementary agents." As used herein, the term "supplementary agents" includes agents that can be administered or introduced separately, for example, formulated separately for separate administration (e.g., as may be provided in a kit) and/or therapies that can be administered or introduced in combination with the IL-27R binding molecules.

Chemotherapeutic Agents:

In some embodiments, the supplementary agent is a chemotherapeutic agent. In some embodiments the supplementary agent is a "cocktail" of multiple chemotherapeutic agents. IN some embodiments the chemotherapeutic agent or cocktail is administered in combination with one or more physical methods (e.g. radiation therapy). The term "chemotherapeutic agents" includes but is not limited to alkylating agents such as thiotepa and cyclosphosphamide; alkyl sulfonates such as busulfan, improsulfan and piposulfan; aziridines such as benzodopa, carboquone, meturedopa, and uredopa; ethylenimines and methylamelamines including altretamine, triethylenemelamine, trietylenephosphoramide, triethylenethiophosphaoramide and trimethyl olomelamime; nitrogen mustards such as chiorambucil, chlomaphazine, cholophosphamide, estramustine, ifosfamide, mechlorethamine, mechlorethamine oxide hydrochloride, melphalan, novembichin, phenesterine, prednimustine, trofosfamide, uracil mustard; nitrosureas such as carmustine, chlorozotocin, fotemustine, lomustine, nimustine, ranimustine; antibiotics such as aclacinomysins, actinomycin, authramycin, azaserine, bleomycins such as bleomycin $A_2$, cactinomycin, calicheamicin, carabicin, caminomycin, carzinophilin, chromomycins, dactinomycin, daunorubicin and derivaties such as demethoxy-daunomycin, 11-deoxydaunorubicin, 13-deoxydaunorubicin, detorubicin, 6-diazo-5-oxo-L-norleucine, doxorubicin, epirubicin, esorubicin, idarubicin, marcellomycin, mitomycins such as mitomycin C, N-methyl mitomycin C; mycophenolic acid, nogalamycin, olivomycins, peplomycin, potfiromycin, puromycin, quelamycin, rodorubicin, streptonigrin, streptozocin, tubercidin, ubenimex, zinostatin, zorubicin; anti-metabolites such as methotrexate and 5-fluorouracil (5-FU); folic acid analogues such as denopterin, methotrexate, pteropterin, trimetrexate, dideaza-tetrahydrofolic acid, and folinic acid; purine analogs such as fludarabine, 6-mercaptopurine, thiamiprine, thioguanine; pyrimidine analogs such as ancitabine, azacitidine, 6-azauridine, carmofur, cytarabine, dideoxyuridine, doxifluridine, enocitabine, floxuridine, 5-FU; androgens such as calusterone, dromostanolone propionate, epitiostanol, mepitiostane, testolactone; anti-adrenals such as aminoglutethimide, mitotane, trilostane; folic acid replenisher such as frolinic acid; aceglatone; aldophosphamide glycoside; aminolevulinic acid; amsacrine; best rabucil; bisantrene; edatraxate; defofamine; demecolcine; diaziquone; elformithine; ellipitinium acetate; etoglucid; gallium nitrate; hydroxyurea; lentinan; lonidamine; mitoguazone; mitoxantrone; mopidamol; nitracrine; pentostatin; phenamet; pirarubicin; podophyllinic acid; 2-ethylhydrazide; procarbazine; razoxane; sizofiran; spirogermanium; tenuazonic acid; triaziquone; 2,2',2"-trichlorotriethylamine; urethan; vindesine; dacarbazine; mannomustine; mitobronitol; mitolactol; pipobroman; gacytosine; arabinoside (Ara-C); cyclophosphamide; thiotepa; taxoids, e.g., paclitaxel, nab-paclitaxel and doxetaxel; chlorambucil; gemcitabine; 6-thioguanine; mercaptopurine; methotrexate; platinum and platinum coordination complexes such as cisplatin, oxaplatin and carboplatin; vinblastine; etoposide (VP-16); ifosfamide; mitomycin C; mitoxantrone; vincristine; vinorelbine; navelbine; novantrone; teniposide; daunomycin; aminopterin; xeloda; ibandronate; CPT11; topoisomerase inhibitors; difluoromethylornithine (DMFO); retinoic acid; esperamicins; capecitabine; taxanes such as paclitaxel, docetaxel, cabazitaxel; carminomycin, adriamycins such as 4'-epiadriamycin, 4-adriamycin-14-benzoate, adriamycin-14-octanoate, adriamycin-14-naphthaleneacetate; cholchicine and pharmaceutically acceptable salts, acids or derivatives of any of the above.

The term "chemotherapeutic agents" also includes antihormonal agents that act to regulate or inhibit hormone action on tumors such as anti-estrogens, including for example tamoxifen, raloxifene, aromatase inhibiting 4(5)-imidazoles, 4-hydroxytamoxifen, trioxifene, keoxifene, onapristone, and toremifene; and antiandrogens such as flutamide, nilutamide, bicalutamide, leuprolide, and goserelin; and pharmaceutically acceptable salts, acids or derivatives of any of the above.

In some embodiments, a supplementary agent isone or more chemical or biological agents identified in the art as useful in the treatment of neoplastic disease, including, but not limited to, a cytokines or cytokine antagonists such as IL-12, INFα, or anti-epidermal growth factor receptor, irinotecan; tetrahydrofolate antimetabolites such as pemetrexed; antibodies against tumor antigens, a complex of a monoclonal antibody and toxin, a T-cell adjuvant, bone marrow transplant, or antigen presenting cells (e.g., dendritic cell therapy), anti-tumor vaccines, replication competent viruses, signal transduction inhibitors (e.g., Gleevec® or Herceptin®) or an immunomodulator to achieve additive or synergistic suppression of tumor growth, non-steroidal anti-inflammatory drugs (NSAIDs), cyclooxygenase-2 (COX-2) inhibitors, steroids, TNF antagonists (e.g., Remicade® and Enbrel®), interferon-β1a (Avonex®), and interferon-β1b (Betaseron®) as well as combinations of one or more of the foregoing as practiced in known chemotherapeutic treatment regimens including but not limited to TAC, FOLFOX, TPC, FEC, ADE, FOLFOX-6, EPOCH, CHOP, CMF, CVP, BEP, OFF, FLOX, CVD, TC, FOLFIRI, PCV, FOLFOXIRI, ICE-V, XELOX, and others that are readily appreciated by the skilled clinician in the art.

In some embodiments, the IL-27R binding molecule is administered in combination with BRAF/MEK inhibitors, kinase inhibitors such as sunitinib, PARP inhibitors such as olaparib, EGFR inhibitors such as osimertinib (Ahn, et al. (2016) J Thorac Oncol 11 S115), IDO inhibitors such as epacadostat, and oncolytic viruses such as talimogene laherparepvec (T-VEC).

Anti-Tumor Antigen Antibody Therapeutics as Supplementary Agents

In some embodiments, a "supplementary agent" is a therapeutic antibody (including bi-specific and tri-specific antibodies which bind to one or more tumor associated antigens including but not limited to bispecific T cell engagers (BITEs), dual affinity retargeting (DART) constructs, and trispecific killer engager (TriKE) constructs).

In some embodiments, the therapeutic antibody is an antibody that binds to at least one tumor antigen selected from the group consisting of HER2 (e.g. trastuzumab, pertuzumab, ado-trastuzumab emtansine), nectin-4 (e.g. enfortumab), CD79 (e.g. polatuzumab vedotin), CTLA4 (e.g. ipilumumab), CD22 (e.g. moxetumomab pasudotox), CCR4 (e.g. magamuizumab), IL23p19 (e.g. tildrakizumab), PDL1 (e.g. durvalumab, avelumab, atezolizumab), IL17a (e.g.

ixekizumab), CD38 (e.g. daratumumab), SLAMF7 (e.g. elotuzumab), CD20 (e.g. rituximab, tositumomab, ibritumomab and ofatumumab), CD30 (e.g. brentuximab vedotin), CD33 (e.g. gemtuzumab ozogamicin), CD52 (e.g. alemtuzumab), EpCam, CEA, fpA33, TAG-72, CAIX, PSMA, PSA, folate binding protein, GD2 (e.g. dinuntuximab), GD3, IL6 (e.g. silutxumab) GM2, Ley, VEGF (e.g. bevacizumab), VEGFR, VEGFR2 (e.g. ramucirumab), PDGFRα (e.g. olartumumab), EGFR (e.g. cetuximab, panitumumab and necitumumab), ERBB2 (e.g. trastuzumab), ERBB3, MET, IGF1R, EPHA3, TRAIL R1, TRAIL R2, RANKL RAP, tenascin, integrin αVβ3, and integrin α4β1.

Examples of antibody therapeutics which are FDA approved and may be used as supplementary agents for use in the treatment of neoplastic disease include those provided in the Table below.

Physical Methods

In some embodiments, a supplementary agent is one or more non-pharmacological modalities (e.g., localized radiation therapy or total body radiation therapy or surgery). By way of example, the present disclosure contemplates treatment regimens wherein a radiation phase is preceded or followed by treatment with a treatment regimen comprising a IL-27R binding molecule and one or more supplementary agents. In some embodiments, the present disclosure further contemplates the use of a IL-27R binding molecule in combination with surgery (e.g. tumor resection). In some embodiments, the present disclosure further contemplates the use of a IL-27R binding molecule in combination with bone marrow transplantation, peripheral blood stem cell transplantation or other types of transplantation therapy.

TABLE

Approved Antineoplastic Disease Antibodies and Indications

| Name | Tradename(s) | Target; format | Indication |
| --- | --- | --- | --- |
| [fam]-trastuzumab deruxtecan | Enhertu ™ | HER2; Humanized IgG1 ADC | HER2+ breast cancer |
| Enfortumab vedotin | Padcev ™ | Nectin-4; Human IgG1 ADC | Urothelial cancer |
| Polatuzumab vedotin | Polivy ™ | CD79b; Humanized IgG1 ADC | Diffuse large B-cell lymphoma |
| Cemiplimab | Libtayo ™ | PD-1; Human mAb | Cutaneous squamous cell carcinoma |
| Moxetumomab pasudotox | Lumoxiti ™ | CD22; Murine IgG1 dsFv immunotoxin | Hairy cell leukemia |
| Mogamuizumab | Poteligeo ™ | CCR4; Humanized IgG1 | Cutaneous T cell lymphoma |
| Tildrakizumab | Ilumya ™ | IL23p19; Humanized IgG1 | Plaque psoriasis |
| Ibalizumab | Trogarzo ™ | CD4; Humanized IgG4 | HIV infection |
| Durvalumab | IMFINZI ™ | PD-L1; Human IgG1 | Bladder cancer |
| Inotuzumab ozogamicin | BESPONSA ™ | CD22; Humanized IgG4, ADC | Hematological malignancy |
| Avelumab | Bavencio ™ | PD-L1; Human IgG1 | Merkel cell carcinoma |
| Atezolizumab | Tecentriq ™ | PD-L1; Humanized IgG1 | Bladder cancer |
| Olaratumab | Lartruvo ™ | PDGFRα; Human IgG1 | Soft tissue sarcoma |
| Ixekizumab | Taltz ™ | IL-17a; Humanized IgG4 | Psoriasis |
| Daratumumab | Darzalex ™ | CD38; Human IgG1 | Multiple myeloma |
| Elotuzumab | Empliciti ™ | SLAMF7; Humanized IgG1 | Multiple myeloma |
| Necitumumab | Portrazza ™ | EGFR; Human IgG1 | Non-small cell lung cancer |
| Dinutuximab | Unituxin ™ | GD2; Chimeric IgG1 | Neuroblastoma |
| Nivolumab | Opdivo ™ | PD1; Human IgG4 | Melanoma, non-small cell lung cancer |
| Blinatumomab | Blincyto ™ | CD19, CD3; Murine bispecific tandem scFv | Acute lymphoblastic leukemia |
| Pembrolizumab | Keytruda ™ | PD1; Humanized IgG4 | Melanoma |
| Ramucirumab | Cyramza ™ | VEGFR2; Human IgG1 | Gastric cancer |
| Siltuximab | Sylvant ™ | IL-6; Chimeric IgG1 | Castleman disease |
| Obinutuzumab | Gazyva ™ | CD20; Humanized IgG1; Glycoengineered | Chronic lymphocytic leukemia |
| Ado-trastuzumab emtansine | Kadcyla ™ | HER2; Humanized IgG1, ADC | Breast cancer |
| Pertuzumab | Perjeta ™ | HER2; Humanized IgG1 | Breast Cancer |
| Brentuximab vedotin | Adcetris ™ | CD30; Chimeric IgG1, ADC | Hodgkin lymphoma, systemic anaplastic large cell lymphoma |
| Ipilimumab | Yervoy ™ | CTLA-4; Human IgG1 | Metastatic melanoma |
| Ofatumumab | Arzerra ™ | CD20; Human IgG1 | Chronic lymphocytic leukemia |
| Certolizumab pegol | Cimzia ™ | TNF; Humanized Fab, pegylated | Crohn disease |
| Catumaxomab | Removab ™ | EPCAM/CD3;Rat/mouse bispecific mAb | Malignant ascites |
| Panitumumab | Vectibix ™ | EGFR; Human IgG2 | Colorectal cancer |
| Bevacizumab | Avastin ™ | VEGF; Humanized IgG1 | Colorectal cancer |
| Cetuximab | Erbitux ™ | EGFR; Chimeric IgG1 | Colorectal cancer |
| Tositumomab-I131 | Bexxar ™ | CD20; Murine IgG2a | Non-Hodgkin lymphoma |
| Ibritumomab tiuxetan | Zevalin ™ | CD20; Murine IgG1 | Non-Hodgkin lymphoma |
| Gemtuzumab ozogamicin | Mylotarg ™ | CD33; Humanized IgG4, ADC | Acute myeloid leukemia |
| Trastuzumab | Herceptin ™ | HER2; Humanized IgG1 | Breast cancer |
| Infliximab | Remicade ™ | TNF; Chimeric IgG1 | Crohn disease |
| Rituximab | Mab Thera ™, Rituxan ™ | CD20; Chimeric IgG1 | Non-Hodgkin lymphoma |
| Edrecolomab | Panorex ™ | EpCAM; Murine IgG2a | Colorectal cancer |

Combination with Immune Checkpoint Modulators:

In some embodiments, a "supplementary agent" is an immune checkpoint modulator for the treatment and/or prevention neoplastic disease in a subject as well as diseases, disorders or conditions associated with neoplastic disease. The term "immune checkpoint pathway" refers to biological response that is triggered by the binding of a first molecule (e.g. a protein such as PD1) that is expressed on an antigen presenting cell (APC) to a second molecule (e.g. a protein such as PDL1) that is expressed on an immune cell (e.g. a T-cell) which modulates the immune response, either through stimulation (e.g. upregulation of T-cell activity) or inhibition (e.g. downregulation of T-cell activity) of the immune response. The molecules that are involved in the formation of the binding pair that modulate the immune response are commonly referred to as "immune checkpoints." The biological responses modulated by such immune checkpoint pathways are mediated by intracellular signaling pathways that lead to downstream immune effector pathways, such as cell activation, cytokine production, cell migration, cytotoxic factor secretion, and antibody production. Immune checkpoint pathways are commonly triggered by the binding of a first cell surface expressed molecule to a second cell surface molecule associated with the immune checkpoint pathway (e.g. binding of PD1 to PDL1, CTLA4 to CD28, etc.). The activation of immune checkpoint pathways can lead to stimulation or inhibition of the immune response.

As used herein, the term "immune checkpoint pathway modulator" refers to a molecule that inhibits or stimulates the activity of an immune checkpoint pathway in a biological system including an immunocompetent mammal. An immune checkpoint pathway modulator may exert its effect by binding to an immune checkpoint protein (such as those immune checkpoint proteins expressed on the surface of an antigen presenting cell (APC) such as a cancer cell and/or immune T effector cell) or may exert its effect on upstream and/or downstream reactions in the immune checkpoint pathway. For example, an immune checkpoint pathway modulator may modulate the activity of SHP2, a tyrosine phosphatase that is involved in PD-1 and CTLA-4 signaling. The term "immune checkpoint pathway modulators" encompasses both immune checkpoint pathway modulator(s) capable of down-regulating at least partially the function of an inhibitory immune checkpoint (referred to herein as an "immune checkpoint pathway inhibitor" or "immune checkpoint pathway antagonist") and immune checkpoint pathway modulator(s) capable of up-regulating at least partially the function of a stimulatory immune checkpoint (referred to herein as an "immune checkpoint pathway effector" or "immune checkpoint pathway agonist.").

Immune checkpoint modulators include but are not limited to immune checkpoint antagonists (e.g. antagonist antibodies) that bind T-cell inhibitory receptors including but not limited to PD1 (also referred to as CD279), TIM3 (T-cell membrane protein 3; also known as HAVcr2), BTLA (B and T lymphocyte attenuator; also known as CD272), the VISTA (B7-H5) receptor, LAG3 (lymphocyte activation gene 3; also known as CD233) and CTLA4 (cytotoxic T-lymphocyte associated antigen 4; also known as CD152). In some embodiments, immune checkpoint modulators are agonists that trigger the checkpoint pathway resulting stimulation of the immune response. Examples of such agonist immune checkpoint modulators include, but is not limited to, agonist that modulate the binding of ICOSL to ICOS(CD278), B7-H6 to NKp30, CD155 to CD96, OX40L to OX40, CD70 to CD27, CD40 to CD40L, and GITRL to GITR. Examples of such positive immune checkpoint agonists include but are not limited to agonist antibodies that bind T-cell activating receptors such as ICOS (such as JTX-2011, Jounce Therapeutics), OX40 (such as MEDI6383, Medimmune), CD27 (such as varlilumab, Celldex Therapeutics), CD40 (such as dacetuzmumab CP-870,893, Roche, Chi Lob 7/4), HVEM, CD28, CD137 4-1BB, CD226, and GITR (such as MEDI1873, Medimmune; INCAGN1876, Agenus).

Exemplary negative immune checkpoint pathway inhibitors include but are not limited to programmed death-1 (PD1) pathway inhibitors, programed death ligand-1 (PDL1) pathway inhibitors, TIM3 pathway inhibitors and anti-cytotoxic T-lymphocyte antigen 4 (CTLA4) pathway inhibitors.

In one embodiment, the immune checkpoint pathway modulator is an antagonist of a negative immune checkpoint pathway that inhibits the binding of PD1 to PDL1 and/or PDL2 ("PD1 pathway inhibitor). The term PD1 pathway inhibitors includes monoclonal antibodies that interfere with the binding of PD1 to PDL1 and/or PDL2. Examples of commercially available PD1 pathway inhibitors useful as supplementary agents in the treatment of neoplastic disease include antibodies that interfere with the binding of PD1 to PDL1 and/or PDL2 including but not limited to nivolumab (Opdivo®, BMS-936558, MDX1106, commercially available from BristolMyers Squibb, Princeton NJ), pembrolizumab (Keytruda®MK-3475, lambrolizumab, commercially available from Merck and Company, Kenilworth NJ), and atezolizumab (Tecentriq®, Genentech/Roche, South San Francisco CA). Additional PD1 pathway inhibitors antibodies are in clinical development including but not limited to durvalumab (MEDI4736, Medimmune/AstraZeneca), pidilizumab (CT-011, CureTech), PDR001 (Novartis), BMS-936559 (MDX1105, BristolMyers Squibb), and avelumab (MSB0010718C, Merck Serono/Pfizer) and SHR-1210 (Incyte). Additional antibody PD1 pathway inhibitors are described in U.S. Pat. No. 8,217,149 (Genentech, Inc) issued Jul. 10, 2012; U.S. Pat. No. 8,168,757 (Merck Sharp and Dohme Corp.) issued May 1, 2012, U.S. Pat. No. 8,008,449 (Medarex) issued Aug. 30, 2011, U.S. Pat. No. 7,943,743 (Medarex, Inc) issued May 17, 2011.

The term PD1 pathway inhibitors are not limited to antagonist antibodies. Non-antibody biologic PD1 pathway inhibitors are also under clinical development including AMP-224, a PD-L2 IgG2a fusion protein, and AMP-514, a PDL2 fusion protein, are under clinical development by Amplimmune and Glaxo SmithKline), aptamers (Wang, et al. (2018) 145:125-130), peptide PD1 pathway inhibitors (Sasikumar, et al., U.S. Pat. No. 9,422,339 issued Aug. 23, 2016, and Sasilkumar, et al., U.S. Pat. No. 8,907,053 issued Dec. 9, 2014), small molecules (CA-170, AUPM-170, Aurigene/Curis; Sasikumar, et al., 1,2,4-oxadiazole and thiadiazole compounds as immunomodulators (PCT/IB2016/051266 filed Mar. 7, 2016, published as WO2016142833A1 Sep. 15, 2016) and Sasikumar, et al PCT/IB2016/051343 filed Mar. 9, 2016 and published as WO2016142886A2), BMS-1166 and Chupak LS and Zheng X. (2015) WO 2015/034820 A1, EP3041822 B1 granted Aug. 9, 2017; WO2015034820 A1; and Chupak, et al. 2015) WO 2015/160641 A2. WO 2015/160641 A2, Chupak, et al. Sharpe, et al. WO 2011082400 A2 published Jul. 7, 2011; U.S. Pat. No. 7,488,802 issued Feb. 10, 2009;

In some embodiments, the IL-27R binding molecule is administered in combination with an antagonist of a negative immune checkpoint pathway that inhibits the binding of CTLA4 to CD28 ("CTLA4 pathway inhibitor"). Examples of CTLA4 pathway inhibitors are well known in the art (See, e.g., U.S. Pat. No. 6,682,736 (Abgenix) issued Jan. 27, 2004;

U.S. Pat. No. 6,984,720 (Medarex, Inc.) issued May 29, 2007; U.S. Pat. No. 7,605,238 (Medarex, Inc.) issued Oct. 20, 2009)

In some embodiments, the IL-27R binding molecule is administered in combination with an antagonist of a negative immune checkpoint pathway that inhibits the ability TIM3 to binding to TIM3-activating ligands ("TIM3 pathway inhibitor"). Examples of TIM3 pathway inhibitors are known in the art and with representative non-limiting examples described in PCT International Patent Publication No. WO 2016/144803 published Sep. 15, 2016; Lifke, et al. United States Patent Publication No. US 20160257749 A1 published Sep. 8, 2016 (F. Hoffman-LaRoche); Karunsky, U.S. Pat. No. 9,631,026 issued Apr. 27, 2017; Karunsky, Sabatos-Peyton, et al. U.S. Pat. No. 8,841,418 issued Sep. 23, 2014; U.S. Pat. No. 9,605,070; Takayanagi, et al., U.S. Pat. No. 8,552,156 issued Oct. 8, 2013.

In some embodiments, the IL-27R binding molecule is administered in combination with an inhibitor of both LAG3 and PD1 as the blockade of LAG3 and PD1 has been suggested to synergistically reverse anergy among tumor-specific CD8+ T-cells and virus-specific CD8+ T-cells in the setting of chronic infection. IMP321 (ImmuFact) is being evaluated in melanoma, breast cancer, and renal cell carcinoma. See generally Woo et al., (2012) Cancer Res 72:917-27; Goldberg et al., (2011) Curr. Top. Microbiol. Immunol. 344:269-78; Pardoll (2012) Nature Rev. Cancer 12:252-64; Grosso et al., (2007) J. Clin. Invest. 117:3383-392.

In some embodiments, the IL-27R binding molecule is administered in combination with an A2aR inhibitor. A2aR inhibits T-cell responses by stimulating CD4$^+$ T-cells towards developing into $T_{Reg}$ cells. A2aR is particularly important in tumor immunity because the rate of cell death in tumors from cell turnover is high, and dying cells release adenosine, which is the ligand for A2aR. In addition, deletion of A2aR has been associated with enhanced and sometimes pathological inflammatory responses to infection. Inhibition of A2aR can be effected by the administration of molecules such as antibodies that block adenosine binding or by adenosine analogs. Such agents may be used in combination with the IL-27R binding molecules for use in the treatment disorders such as cancer and Parkinson's disease.

In some embodiments, the IL-27R binding molecule is administered in combination with an inhibitor of IDO (Indoleamine 2,3-dioxygenase). IDO down-regulates the immune response mediated through oxidation of tryptophan resulting in in inhibition of T-cell activation and induction of T-cell apoptosis, creating an environment in which tumor-specific cytotoxic T lymphocytes are rendered functionally inactive or are no longer able to attack a subject's cancer cells. Indoximod (NewLink Genetics) is an IDO inhibitor being evaluated in metastatic breast cancer.

As previously described, the present invention provides for a method of treatment of neoplastic disease (e.g. cancer) in a mammalian subject by the administration of a IL-27R binding molecule in combination with an agent(s) that modulate at least one immune checkpoint pathway including immune checkpoint pathway modulators that modulate two, three or more immune checkpoint pathways.

In some embodiments the IL-27R binding molecule is administered in combination with an immune checkpoint modulator that modulates multiple immune checkpoint pathways. Multiple immune checkpoint pathways may be modulated by the administration of multi-functional molecules which act as modulators of multiple immune checkpoint pathways. Examples of such multiple immune checkpoint pathway modulators include but are not limited to bi-specific or poly-specific antibodies. Examples of poly-specific antibodies capable of acting as modulators or multiple immune checkpoint pathways are known in the art. For example, United States Patent Publication No. 2013/0156774 describes bispecific and multispecific agents (e.g., antibodies), and methods of their use, for targeting cells that co-express PD1 and TIM3. Moreover, dual blockade of BTLA and PD1 has been shown to enhance antitumor immunity (Pardoll, (April 2012) Nature Rev. Cancer 12:252-64). The present disclosure contemplates the use of IL-27R binding molecules in combination with immune checkpoint pathway modulators that target multiple immune checkpoint pathways, including but limited to bi-specific antibodies which bind to both PD1 and LAG3. Thus, antitumor immunity can be enhanced at multiple levels, and combinatorial strategies can be generated in view of various mechanistic considerations.

In some embodiments, the IL-27R binding molecule may be administered in combination with two, three, four or more checkpoint pathway modulators. Such combinations may be advantageous in that immune checkpoint pathways may have distinct mechanisms of action, which provides the opportunity to attack the underlying disease, disorder or conditions from multiple distinct therapeutic angles.

It should be noted that therapeutic responses to immune checkpoint pathway inhibitors often manifest themselves much later than responses to traditional chemotherapies such as tyrosine kinase inhibitors. In some instance, it can take six months or more after treatment initiation with immune checkpoint pathway inhibitors before objective indicia of a therapeutic response are observed. Therefore, a determination as to whether treatment with an immune checkpoint pathway inhibitors(s) in combination with a IL-27R binding molecule of the present disclosure must be made over a time-to-progression that is frequently longer than with conventional chemotherapies. The desired response can be any result deemed favorable under the circumstances. In some embodiments, the desired response is prevention of the progression of the disease, disorder or condition, while in other embodiments the desired response is a regression or stabilization of one or more characteristics of the disease, disorder or conditions (e.g., reduction in tumor size). In still other embodiments, the desired response is reduction or elimination of one or more adverse effects associated with one or more agents of the combination.

Cell Therapy Agents and Methods as Supplementary Agents:

In some embodiments, the methods of the disclosure may include the combination of the administration of a IL-27R binding molecules with supplementary agents in the form of cell therapies for the treatment of neoplastic, autoimmune or inflammatory diseases. Examples of cell therapies that are amenable to use in combination with the methods of the present disclosure include but are not limited to engineered T cell products comprising one or more activated CAR-T cells, engineered TCR cells, tumor infiltrating lymphocytes (TILs), engineered Treg cells. As engineered T-cell products are commonly activated ex vivo prior to their administration to the subject and therefore provide upregulated levels of CD25, cell products comprising such activated engineered T cells types are amenable to further support via the administration of an CD25 biased IL-27R binding molecule as described herein.

In some embodiments of the methods of the present disclosure, the supplementary agent is a "chimeric antigen receptor T-cell" and "CAR-T cell" are used interchangeably to refer to a T-cell that has been recombinantly modified to express a chimeric antigen receptor. As used herein, the terms As used herein, the terms "chimeric antigen receptor" and "CAR" are used interchangeably to refer to a chimeric polypeptide comprising multiple functional domains arranged from amino to carboxy terminus in the sequence: (a) an antigen binding domain (ABD), (b) a transmembrane domain (TD); and (c) one or more cytoplasmic signaling domains (CSDs) wherein the foregoing domains may optionally be linked by one or more spacer domains. The CAR may also further comprise a signal peptide sequence which is conventionally removed during post-translational processing and presentation of the CAR on the cell surface of a cell transformed with an expression vector comprising a nucleic acid sequence encoding the CAR. CARs useful in the practice of the present invention are prepared in accordance with principles well known in the art. See e.g., Eshhaar et al. U.S. Pat. No. 7,741,465 B1 issued Jun. 22, 2010; Sadelain, et al (2013) Cancer Discovery 3(4):388-398; Jensen and Riddell (2015) Current Opinions in Immunology 33:9-15; Gross, et al. (1989) PNAS (USA) 86(24):10024-10028; Curran, et al. (2012) J Gene Med 14(6):405-15. Examples of commercially available CAR-T cell products that may be modified to incorporate an orthogonal receptor of the present invention include axicabtagene ciloleucel (marketed as Yescarta® commercially available from Gilead Pharmaceuticals) and tisagenlecleucel (marketed as Kymriah® commercially available from Novartis). In some embodiments, the CAR-T possesses a CAR specifically binds to a cell surface molecule associated with a tumor cell is selected from the group consisting of GD2, BCMA, CD19, CD33, CD38, CD70, GD2, IL3Rα2, CD19, mesothelin, Her2, EpCam, Mucd, ROR1, CD133, CEA, EGR-FRVIII, PSCA, GPC3, Pan-ErbB and FAP Physical Methods:

In some embodiments, the supplementary agent is a anti-neoplastic physical methods including but not limited to radiotherapy, cryotherapy, hyperthermic therapy, surgery, laser ablation, and proton therapy.

Kits: The present disclosure also contemplates kits comprising pharmaceutical compositions IL-27R binding molecules and a pharmaceutical composition thereof. The kits are generally in the form of a physical structure housing various components, as described below, and can be utilized, for example, in practicing the methods described above. A kit may comprise a IL-27R binding molecule in the form of a pharmaceutical composition suitable for administration to a subject that is ready for use or in a form or requiring preparation for example, thawing, reconstitution or dilution prior to administration. When the IL-27R binding molecule is in a form that needs to be reconstituted by a user, the kit may also comprise a sterile container providing a reconstitution medium comprising buffers, pharmaceutically acceptable excipients, and the like. A kit of the present disclosure can be designed for conditions necessary to properly maintain the components housed therein (e.g., refrigeration or freezing). A kit may further contain a label or packaging insert including identifying information for the components therein and instructions for their use. Each component of the kit can be enclosed within an individual container, and all of the various containers can be within a single package. Labels or inserts can include manufacturer information such as lot numbers and expiration dates. The label or packaging insert can be, e.g., integrated into the physical structure housing the components, contained separately within the physical structure, or affixed to a component of the kit (e.g., an ampule, syringe or vial). Labels or inserts may be provided in a physical form or a computer readable medium. In some embodiments, the actual instructions are not present in the kit, but rather the kit provides a means for obtaining the instructions from a remote source, e.g., via an internet site, including by secure access by providing a password (or scannable code such as a barcode or QR code on the container of the IL-27R binding molecule or kit comprising) in compliance with governmental regulations (e.g., HIPAA) are provided.

It is intended that every maximum numerical limitation given throughout this specification includes every lower numerical limitation, as if such lower numerical limitations were expressly written herein. Every minimum numerical limitation given throughout this specification will include every higher numerical limitation, as if such higher numerical limitations were expressly written herein. Every numerical range given throughout this specification will include every narrower numerical range that falls within such broader numerical range, as if such narrower numerical ranges were all expressly written herein.

No admission is made that any reference cited herein constitutes prior art. The discussion of the references states what their authors assert, and the inventors reserve the right to challenge the accuracy and pertinence of the cited documents. It will be clearly understood that, although a number of information sources, including scientific journal articles, patent documents, and textbooks, are referred to herein; this reference does not constitute an admission that any of these documents forms part of the common general knowledge in the art.

The foregoing antibodies useful as supplementary agents in the practice of the methods of the present disclosure may be administered alone or in the form of any antibody drug conjugate (ADC) comprising the antibody, linker, and one or more drugs (e.g. 1, 2, 3, 4, 5, 6, 7, or 8 drugs) or in modified form (e.g. PEGylated).

In some embodiments the supplementary agent is a vaccine. The IL27R binding proteins of the present invention may be administered to a subject in combination with vaccines as an adjuvant to enhance the immune response to the vaccine in accordance with the teaching of Doyle, et al U.S. Pat. No. 5,800,819 issued Sep. 1, 1998. Examples of vaccines that may be combined with the IL27R binding proteins of the present invention include are HSV vaccines, *Bordetella pertussis, Escherichia coli* vaccines, pneumococcal vaccines including multivalent pneumococcal vaccines such as Prevnar® 13, diptheria, tetanus and pertussis vaccines (including combination vaccines such as Pediatrix®) and Pentacel®), varicella vaccines, *Haemophilus influenzae* type B vaccines, human papilloma virus vaccines such as Garasil®, polio vaccines, Leptospirosis vaccines, combination respiratory vaccine, *Moraxella* vaccines, and attenuated live or killed virus vaccine products such as bovine respiratory disease vaccine (RSV), multivalent human influenza vaccines such as Fluzone® and Quadravlent Fluzone®), feline leukemia vaccine, transmissible gastroenteritis vaccine, COVID-19 vaccine, and rabies vaccine.

For prophylactic applications, pharmaceutical compositions or medicaments are administered to a patient susceptible to, or otherwise at risk of disease in an amount sufficient to eliminate or reduce the risk, lessen the severity, or delay the outset of the disease, including biochemical, histologic and/or behavioral symptoms of the disease, its complications and intermediate pathological phenotypes presenting during development of the disease.

EXAMPLES

Example 1

Camels were acclimated at research facility for at least 7 days before immunization. Antigen was diluted with 1×PBS (antigen total about 1 mg). The quality of the antigen was assessed by SDS-PAGE to ensure purity (e.g., >80%). For the first time, 10 mL CFA (then followed 6 times using IFA) was added into mortar, then 10 mL antigen in 1×PBS was slowly added into the mortar with the pestle grinding. The antigen and CFA/IFA were ground until the component showed milky white color and appeared hard to disperse. Camels were injected with antigen emulsified in CFA subcutaneously at at least six sites on the body, injecting about 2 mL at each site (total of 10 mL per camel). A stronger immune response was generated by injecting more sites and in larger volumes. The immunization was conducted every week (7 days), for 7 times. The needle was inserted into the subcutaneous space for 10 to 15 seconds after each injection to avoid leakage of the emulsion. Alternatively, a light pull on the syringe plunger also prevented leakage. The blood sample was collected three days later after $7^{th}$ immunization.

100 mL of blood was collected from the camel three days following the last injection in the immunization protocol. RNA was extracted from blood and transcribed to cDNA. The approximately 900 bp reverse transcribed sequences encoding the VH-CH1-hinge-CH2-CH3 constructs were isolated from the approximately desired 700 bp fragments encoding the VHH-hinge-CH2-CH3 species. The purified approximately 700 bp fragments were amplified by nested PCR. The amplified sequences were digested using Pst1 and Not1. The approximately 400 bp PST1/Not1 digested fragments were inserted into a Pst1/Not1 digested pMECS phagemid vector such that the sequence encoding the $V_HH$ was in frame with a DNA sequence encoding a HA/His sequence. The PCR generated sequences and the vector of pMECS phagemid were digested with Pst I and Not I, subsequently, ligated to pMECS/Nb recombinant. After ligation, the products were transformed into *Escherichia coli* (*E. coli*) TG1 cells by electroporation. The transformants were enriched in growth medium, followed by transfer to 2YT+ 2% glucose agar plates.

Bio-panning of the phage library was conducted to identify VHHs that bind IL27Rα. A 96-well plate was coated with IL27Rα and the phage library was incubated in each well to allow phage-expressing IL27Rα reactive $V_HH$ to bind to the IL27Rα on the plate. Non-specifically bound phage were washed off and the specifically bound phage isolated. After the selection, the enriched phage library expressing IL27Rα reactive $V_HH$ were amplified in TG1 cells. The aforementioned bio-panning process was repeated for 2-3 rounds to enrich the library for $V_HH$ selective for IL27Rα. Once biopanning was complete, three 96-well plates of individual phage clones were isolated in order to perform periplasmic extract ELISA PE-ELISA) on antigen coated plates to identify positive $V_HH$ binders. Briefly, A 96-well plate was coated with antigen and PBS under the same conditions. Next, wells were blocked at 37° C. for 1 h. Then, 100 μl of extracted antibodies was added to each well and incubated for 1 h. Subsequently, 100 μl of anti-tag polyclonal antibody conjugated to HRP was added to each well and incubated at 37° C. for 1 h. Plates were developed with TMB substrate. The reaction was stopped by the addition of H2SO4. Absorbance at 450 nm was read on a microtiter plate reader and antibodies with absorbance of the antigen-coated well at least threefold greater than PBS-coated control were specific binding molecules and subjected to sequence analysis.

Example 2—Recombinant Production and Purification

Codon optimized DNA inserts were cloned into modified pcDNA3.4 (Genewiz) for small scale expression in HEK293 cells in 24 well plates. The binding proteins were purified in substantial accordance with the following procedure. Using a Hamilton Star automated system, 96×4 mL of supernatants in 4×24-well blocks were re-arrayed into 4×96-well, 1 mL blocks. PhyNexus™ micropipette tips (Biotage, San Jose CA) holding 80 μL of Ni-Excel IMAC resin (Cytiva) are equilibrated wash buffer: PBS pH 7.4, 30 mM imidazole. PhyNexus™ tips were dipped and cycled through 14 cycles of 1 mL pipetting across all 4×96-well blocks. PhyNexus™ tips were washed in 2×1 mL blocks holding wash buffer. PhyNexus™ tips were eluted in 3×0.36 mL blocks holding elution buffer: PBS pH 7.4, 400 mM imidazole. PhyNexus™ tips were regenerated in 3×1 mL blocks of 0.5 M sodium hydroxide.

The purified protein eluates were quantified using a Biacore® T200 as in substantial accordance with the following procedure. 10 uL of the first 96×0.36 mL eluates were transferred to a Biacore® 96-well microplate and diluted to 60 uL in HBS-EP+ buffer (10 mM Hepes pH 7.4, 150 mM NaCl, 1 mM EDTA, 0.05% Tween™ 20). Each of the 96 samples was injected on a CM5 series S chip previously functionalized with anti-histidine capture antibody (Cytiva): injection is performed for 18 seconds at 5 μL/min. Capture levels were recorded 60 seconds after buffer wash. A standard curve of known $V_HH$ concentrations (270, 90, 30, 10, 3.3, 1.1 μg/mL) was acquired in each of the 4 Biacore® chip flow cells to eliminate cell-to-cell surface variability. The 96 captures were interpolated against the standard curve using a non-linear model including specific and unspecific, one-site binding. Concentrations in the first elution block varied from 12 to 452 μg/mL corresponding to a 4-149 μg. SDS-PAGE analysis of 5 randomly picked samples was performed to ensure molecular weight of eluates corresponded to expected values (~30 kDa).

The concentration of the proteins was normalized using the Hamilton Star automated system in substantial accordance with the following procedure. Concentration values are imported in an Excel spreadsheet where pipetting volumes were calculated to perform dilution to 50 μg/mL in 0.22 mL. The spreadsheet was imported in a Hamilton Star method dedicated to performing dilution pipetting using the first elution block and elution buffer as diluent. The final, normalized plate was sterile filtered using 0.22 μm filter plates (Corning).

Example 3

All experiments were conducted in 10 mM Hepes, 150 mMv NaCl, 0.05% (v/v) Polysorbate 20 (PS20) and 3 mMv EDTA (HBS-EP+ buffer) on a Biacore® T200 instrument equipped with a Protein A chip (Cytiva). Mono-Fc VHH ligands were flowed at 5 μl/min for variable time ranging from 18 to 300 seconds, reaching the capture loads listed in the tables below.

Following ligand capture, injections of a 2-fold dilution series of his-tagged cytokine receptors typically comprising at least five concentrations between 1 μM and 1 nM were performed in either high performance or single cycle kinetics mode. Surface regeneration was achieved by flowing 10 mMv glycine-HCl, pH 1.5 (60 seconds, 50 µL/min). Buffer-subtracted sensograms were processed with Biacore® T200 Evaluation Software and globally fit with a 1:1 Langmuir binding model (bulk shift set to zero) to extract kinetics and affinity constants (ka, kd, KD). RMAX<100 RU indicates surface density compatible with kinetics analysis. Calculated Rmax were generated using the equation Rmax=Load (RU)×valency of ligand×(Molecular weight of analyte/Molecular weight of ligand. Surface activity was defined as the ratio experimental/calculated Rmax. See tables below for sample information and experimental results.

Anti-hGP130 Mono-Fc VHHs (ligand) binding to hGP130-his (Sino Biological, Catalog# 10974)

| Ligand | $k_{ON}$ (1/Ms) | $k_{OFF}$ (1/s) | Affinity (nM) | Rmax (RU) | Load (RU) | Calc. Rmax (RU) | Surface Activity |
|---|---|---|---|---|---|---|---|
| 14 - DR591 (SEQ ID NO. 232) | 5.9E+04 | 1.9E-03 | 33 | 52 | 84.6 | 252 | 21% |
| 15 - DR592 (SEQ ID NO. 233) | 1.6E+05 | 5.9E-03 | 38 | 142.3 | 147 | 437 | 33% |
| 16 - DR593 (SEQ ID NO. 234) | 2.5E+05 | 2.1E-02 | 82 | 64.2 | 110 | 326 | 20% |
| 17 - DR594 (SEQ ID NO. 235) | 1.6E+05 | 9.5E-03 | 58 | 96.9 | 153 | 455 | 21% |
| 18 - DR595 (SEQ ID NO. 236) | 1.8E+05 | 7.3E-03 | 41 | 127 | 128 | 379 | 33% |
| 19 - DR596 (SEQ ID NO. 237) | 1.9E+05 | 8.2E-03 | 44 | 68.8 | 83.6 | 249 | 28% |

Anti-hIL27Ra Mono-Fc VHHs (ligand) binding to hIL27Ra-his (Origene, Catalog# TP307012)

| Ligand | $k_{ON}$ (1/Ms) | $k_{OFF}$ (1/s) | Affinity (nM) | Rmax (RU) | Load (RU) | Calc. Rmax (RU) | Surface Activity |
|---|---|---|---|---|---|---|---|
| 20 - DR597 (SEQ ID NO. 245) | 3.0E+04 | 5.7E-04 | 19.0 | 142* | 1319 | 3564 | 4% |
| 24 - DR601 (SEQ ID NO. 249) | 9.1E+04 | 4.1E-04 | 4.5 | 102 | 305 | 824 | 12% |
| 23 - DR600 (SEQ ID NO. 248) | 5.9E+04 | 1.0E-03 | 17 | 79 | 232 | 627 | 13% |
| 25 - DR602 (SEQ ID NO. 250) | 1.5E+05 | 7.6E-04 | 5.2 | 115* | 210 | 568 | 20% |
| 26 - DR603 (SEQ ID NO. 251) | 1.3E+05 | 7.7E-04 | 6.1 | 149* | 305 | 823 | 18% |

*Both association and dissociation kinetics constants might be suppressed at Rmax > 100. If existing, this effect is likely cancelled in the kinetics ratio, i.e. affinity constant.

Example 4

Binding for all VHH was confirmed by ELISA. One representative VHH from each clonotype was selected for further analysis by surface plasmon resonance using Biacore® T200. See below.

| Dimer | hIL27Ra arm | hgp130 arm | kON (1/Ms) hIL27Ra | kOFF (1/s) hIL27Ra | Affinity (nM) hIL27Ra | kON (1/Ms) hgp130 | kOFF (1/s) hgp130 | Affinity (nM) hgp130 |
|---|---|---|---|---|---|---|---|---|
| hIL27Ra_VHH1-DR591 | VHH1 | DR591 | 3.00E+04 | 5.70E-04 | 19 | 5.90E+04 | 1.90E-03 | 33 |
| hIL27Ra_VHH4-DR591 | VHH4 | DR591 | — | — | — | 5.90E+04 | 1.90E-03 | 33 |
| hIL27Ra_VHH6-DR591 | VHH6 | DR591 | — | — | — | 5.90E+04 | 1.90E-03 | 33 |
| hIL27Ra_VHH9-DR591 | VHH9 | DR591 | 9.10E+04 | 4.10E-04 | 4.5 | 5.90E+04 | 1.90E-03 | 33 |
| hIL27Ra_VHH15-DR591 | VHH15 | DR591 | 5.90E+04 | 1.00E-03 | 17 | 5.90E+04 | 1.90E-03 | 33 |
| hIL27Ra_VHH19-DR591 | VHH19 | DR591 | 1.50E+05 | 7.60E-04 | 5.2 | 5.90E+04 | 1.90E-03 | 33 |
| hIL27Ra_VHH21-DR591 | VHH21 | DR591 | 1.30E+05 | 7.70E-04 | 6.1 | 5.90E+04 | 1.90E-03 | 33 |
| hIL27Ra_VHH1-DR592 | VHH1 | DR592 | 3.00E+04 | 5.70E-04 | 19 | 1.60E+05 | 5.90E-03 | 38 |
| hIL27Ra_VHH4-DR592 | VHH4 | DR592 | — | — | — | 1.60E+05 | 5.90E-03 | 38 |
| hIL27Ra_VHH6-DR592 | VHH6 | DR592 | — | — | — | 1.60E+05 | 5.90E-03 | 38 |
| hIL27Ra_VHH9-DR592 | VHH9 | DR592 | 9.10E+04 | 4.10E-04 | 4.5 | 1.60E+05 | 5.90E-03 | 38 |
| hIL27Ra_VHH15-DR592 | VHH15 | DR592 | 5.90E+04 | 1.00E-03 | 17 | 1.60E+05 | 5.90E-03 | 38 |
| hIL27Ra_VHH19-DR592 | VHH19 | DR592 | 1.50E+05 | 7.60E-04 | 5.2 | 1.60E+05 | 5.90E-03 | 38 |
| hIL27Ra_VHH21-DR592 | VHH21 | DR592 | 1.30E+05 | 7.70E-04 | 6.1 | 1.60E+05 | 5.90E-03 | 38 |
| hIL27Ra_VHH1-DR593 | VHH1 | DR593 | 3.00E+04 | 5.70E-04 | 19 | 2.50E+05 | 2.10E-02 | 82 |

-continued

| Dimer | hIL27Ra arm | hgp130 arm | kON (1/Ms) hIL27Ra | kOFF (1/s) hIL27Ra | Affinity (nM) hIL27Ra | kON (1/Ms) hgp130 | kOFF (1/s) hgp130 | Affinity (nM) hgp130 |
|---|---|---|---|---|---|---|---|---|
| hIL27Ra_VHH4-DR593 | VHH4 | DR593 | — | — | — | 2.50E+05 | 2.10E−02 | 82 |
| hIL27Ra_VHH6-DR593 | VHH6 | DR593 | — | — | — | 2.50E+05 | 2.10E−02 | 82 |
| hIL27Ra_VHH9-DR593 | VHH9 | DR593 | 9.10E+04 | 4.10E−04 | 4.5 | 2.50E+05 | 2.10E−02 | 82 |
| hIL27Ra_VHH15-DR593 | VHH15 | DR593 | 5.90E+04 | 1.00E−03 | 17 | 2.50E+05 | 2.10E−02 | 82 |
| hIL27Ra_VHH19-DR593 | VHH19 | DR593 | 1.50E+05 | 7.60E−04 | 5.2 | 2.50E+05 | 2.10E−02 | 82 |
| hIL27Ra_VHH21-DR593 | VHH21 | DR593 | 1.30E+05 | 7.70E−04 | 6.1 | 2.50E+05 | 2.10E−02 | 82 |
| hIL27Ra_VHH1-DR594 | VHH1 | DR594 | 3.00E+04 | 5.70E−04 | 19 | 1.60E+05 | 9.50E−03 | 58 |
| hIL27Ra_VHH4-DR594 | VHH4 | DR594 | — | — | — | 1.60E+05 | 9.50E−03 | 58 |
| hIL27Ra_VHH6-DR594 | VHH6 | DR594 | — | — | — | 1.60E+05 | 9.50E−03 | 58 |
| hIL27Ra_VHH9-DR594 | VHH9 | DR594 | 9.10E+04 | 4.10E−04 | 4.5 | 1.60E+05 | 9.50E−03 | 58 |
| hIL27Ra_VHH15-DR594 | VHH15 | DR594 | 5.90E+04 | 1.00E−03 | 17 | 1.60E+05 | 9.50E−03 | 58 |
| hIL27Ra_VHH19-DR594 | VHH19 | DR594 | 1.50E+05 | 7.60E−04 | 5.2 | 1.60E+05 | 9.50E−03 | 58 |
| hIL27Ra_VHH21-DR594 | VHH21 | DR594 | 1.30E+05 | 7.70E−04 | 6.1 | 1.60E+05 | 9.50E−03 | 58 |
| hIL27Ra_VHH1-DR595 | VHH1 | DR595 | 3.00E+04 | 5.70E−04 | 19 | 1.80E+05 | 7.30E−03 | 41 |
| hIL27Ra_VHH4-DR595 | VHH4 | DR595 | — | — | — | 1.80E+05 | 7.30E−03 | 41 |
| hIL27Ra_VHH6-DR595 | VHH6 | DR595 | — | — | — | 1.80E+05 | 7.30E−03 | 41 |
| hIL27Ra_VHH9-DR595 | VHH9 | DR595 | 9.10E+04 | 4.10E−04 | 4.5 | 1.80E+05 | 7.30E−03 | 41 |
| hIL27Ra_VHH15-DR595 | VHH15 | DR595 | 5.90E+04 | 1.00E−03 | 17 | 1.80E+05 | 7.30E−03 | 41 |
| hIL27Ra_VHH19-DR595 | VHH19 | DR595 | 1.50E+05 | 7.60E−04 | 5.2 | 1.80E+05 | 7.30E−03 | 41 |
| hIL27Ra_VHH21-DR595 | VHH21 | DR595 | 1.30E+05 | 7.70E−04 | 6.1 | 1.80E+05 | 7.30E−03 | 41 |
| hIL27Ra_VHH1-DR596 | VHH1 | DR596 | 3.00E+04 | 5.70E−04 | 19 | 1.90E+05 | 8.20E−03 | 44 |
| hIL27Ra_VHH4-DR596 | VHH4 | DR596 | — | — | — | 1.90E+05 | 8.20E−03 | 44 |
| hIL27Ra_VHH6-DR596 | VHH6 | DR596 | — | — | — | 1.90E+05 | 8.20E−03 | 44 |
| hIL27Ra_VHH9-DR596 | VHH9 | DR596 | 9.10E+04 | 4.10E−04 | 4.5 | 1.90E+05 | 8.20E−03 | 44 |
| hIL27Ra_VHH15-DR596 | VHH15 | DR596 | 5.90E+04 | 1.00E−03 | 17 | 1.90E+05 | 8.20E−03 | 44 |
| hIL27Ra_VHH19-DR596 | VHH19 | DR596 | 1.50E+05 | 7.60E−04 | 5.2 | 1.90E+05 | 8.20E−03 | 44 |
| hIL27Ra_VHH21-DR596 | VHH21 | DR596 | 1.30E+05 | 7.70E−04 | 6.1 | 1.90E+05 | 8.20E−03 | 44 |

SEQUENCE LISTING (1547 sequences)

SEQ ID NO: 1 - protein, 256 aa, synthetic construct
  source 1..256: note = Description of Artificial Sequence: Synthetic polypeptide
QVQLQESGGGSVQAGGSLRLSCTASGAIASGYIDSRWCMAWFRQAPGKEREGVAAIWPGGGLTVYADSVKGRFTISRDHAKNTLYLQMNNLKPEDTAMYYCAAGSPRMCPSLEFGFDYWGQGTQVTVSSGGGSQVQLQESGGGLVQPGGSLRLSCAASGFTFSSYPMSWVRQAPGKGLEWISTISAGGDTTLYADSVKGRFTSSRDNAKNTLYLQLNSLKTEDAAIYYCAKRIDCNSGYCYRRNYWGQGTQVTVSS

SEQ ID NO: 2 - protein, 257 aa, synthetic construct
  source 1..257: note = Description of Artificial Sequence: Synthetic polypeptide
QVQLQESGGGSVQAGGSLRLSCTASGAIASGYIDSRWCMAWFRQAPGKEREGVAAIWPGGGLTVYADSVKGRFTISRDHAKNTLYLQMNNLKPEDTAMYYCAAGSPRMCPSLEFGFDYWGQGTQVTVSSGGGSQVQLQESGGGLVQPGESLRLSCTASGFTFSNYAMSWVRQAPGKGLEWVSGINVAYGITSYADSVKGRFTISRDNTKNTLYLQLNSLKTEDTAIYYCVKHSGTTIPRGFISYTKRGQGTQVTVSS

SEQ ID NO: 3 - protein, 252 aa, synthetic construct
  source 1..252: note = Description of Artificial Sequence: Synthetic polypeptide
QVQLQESGGGSVQAGGSLRLSCTASGAIASGYIDSRWCMAWFRQAPGKEREGVAAIWPGGGLTVYADSVKGRFTISRDHAKNTLYLQMNNLKPEDTAMYYCAAGSPRMCPSLEFGFDYWGQGTQVTVSSGGGSQVQLQESGGGLVQPGGSLRLSCAASGFSFSSYAMKWVRQAPGKGLEWVSTISSGGSSTNYADSVKGRFTISRDNAKNTLYLQLNSLKIEDTAMYYCAKAIVPTGATMERGQGTQVTVSS

SEQ ID NO: 4 - protein, 261 aa, synthetic construct
  source 1..261: note = Description of Artificial Sequence: Synthetic polypeptide
QVQLQESGGGSVQAGGSLRLSCTASGAIASGYIDSRWCMAWFRQAPGKEREGVAAIWPGGGLTVYADSVKGRFTISRDHAKNTLYLQMNNLKPEDTAMYYCAAGSPRMCPSLEFGFDYWGQGTQVTVSSGGGSQVQLQESGGGSVQSGGSLRLSCAASGFTYSTSNSWMAWFRQAPGKEREGVAAIYTVGGSIFYADSVRGRFTISQDATKNMFYLQMNTLKPEDTAMYYCAAASGRLRGKWFWPYEYNYWGQGTQVTVSS

SEQ ID NO: 5 - protein, 253 aa, synthetic construct
  source 1..253: note = Description of Artificial Sequence: Synthetic polypeptide
QVQLQESGGGSVQAGGSLRLSCTASGAIASGYIDSRWCMAWFRQAPGKEREGVAAIWPGGGLTVYADSVKGRFTISRDHAKNTLYLQMNNLKPEDTAMYYCAAGSPRMCPSLEFGFDYWGQGTQVTVSSGGGSQVQLQESGGGSVQAGGSLRLSCVASGYVSCDYFLPSWYRQAPGKEREFVSIIDGTGSTSYAASVKGRFTASQDKGKNIAYLQMNTLKPEDTAMYYCKASCVRGRAISEYWGQGTQVTVSS

SEQ ID NO: 6 - protein, 262 aa, synthetic construct
  source 1..262: note = Description of Artificial Sequence: Synthetic polypeptide
QVQLQESGGGSVQAGGSLRLSCTASGAIASGYIDSRWCMAWFRQAPGKEREGVAAIWPGGGLTVYADSVKGRFTISRDHAKNTLYLQMNNLKPEDTAMYYCAAGSPRMCPSLEFGFDYWGQGTQVTVSSGGGSQVQLQESGGGSVQAGGSLRLSCRASGSTYSNYCLGWFRQITGKEREGVAVINWVGGMLYFADSVKGRFTVSQDQAKNTVYLQMNSLKPEDTAMYYCAAESVSSFSCGGWLTRPDRVPYWGQGTQVTVSS

SEQ ID NO: 7 - protein, 256 aa, synthetic construct
  source 1..256: note = Description of Artificial Sequence: Synthetic polypeptide
QVQLQESGGGSVQAGGSLRLSCTASGAIASGYIDSRWCMAWFRQAPGKEREGVAAIWPGGGLTVYADSVKGRFTISRDHAKNTLYLQMNNLKPEDTAMYYCAAGSPRMCPSLEFGFDYWGQGTQVTVSSGGGSQVQLQESGGGLVQPGGSLRLSCAASGFTFSLSSMSWVRQAPGKGLEWVSAISSGGASTYYTDSVKGRFTISRDNAKNMLYLQLNSLKTEDTAMYYCAKGGSGYGDASRMTSPGSQGTQVTVSS

SEQ ID NO: 8 - protein, 250 aa, synthetic construct
  source 1..250: note = Description of Artificial Sequence: Synthetic polypeptide
QVQLQESGGGSVQAGGSLRLSCTAPGFTSNSCGMDWYRQAPGKEREFVSSISTDGTTGYADSVKGRFTISKDKAKDTVYLQMNSLKPEDTGMYSCKTKDGTIATMELCDFGYWGQGTQVTVSSGGGSQVQLQESGGGLVQPGGSLRLSCAASGFTFSSYPMSWVRQAPGKGLEWISTISAGGDTTLYADSVKGRFTSSRDNAKNTLYLQLNSLKTEDAAIYYCAKRIDCNSGYCYRRNYWGQGTQVTVSS

SEQ ID NO: 9 - protein, 251 aa, synthetic construct
  source 1..251: note = Description of Artificial Sequence: Synthetic polypeptide
QVQLQESGGGSVQAGGSLRLSCTAPGFTSNSCGMDWYRQAPGKEREFVSSISTDGTTGYADSVKGRFTISKDKAKDTVYLQMNSLKPEDTGMYSCKTKDGTIATMELCDFGYWGQGTQVTVSSGGGSQVQLQESGGGLVQPGESLRLSCTASGFTFSNYAMSWVRQAPGKGLEWVSGINVAYGITSYADSVKGRFTISRDNTKNTLYLQLNSLKTEDTAIYYCVKHSGTTIPRGFISYTKRGQGTQVTVSS

SEQ ID NO: 10 - protein, 246 aa, synthetic construct
  source 1..246: note = Description of Artificial Sequence: Synthetic polypeptide
QVQLQESGGGSVQAGGSLRLSCTAPGFTSNSCGMDWYRQAPGKEREFVSSISTDGTTGYADSVKGRFTISKDKAKDTVYLQMNSLKPEDTGMYSCKTKDGTIATMELCDFGYWGQGTQVTVSSGGGSQVQLQESGGGLVQPGGSLRLSCAASGFSFSSYAMKWVRQAPGKGLEWVSTISSGGSSTNYADSVKGRFTISRDNAKNTLYLQLNSLKIEDTAMYYCAKAIVPTGATMERGQGTQVTVSS

SEQ ID NO: 11 - protein, 255 aa, synthetic construct
  source 1..255: note = Description of Artificial Sequence: Synthetic polypeptide
QVQLQESGGGSVQAGGSLRLSCTAPGFTSNSCGMDWYRQAPGKEREFVSSISTDGTTGYADSVKGRFTISKDKAKDTVYLQMNSLKPEDTGMYSCKTKDGTIATMELCDFGYWGQGTQVTVSSGGGSQVQLQESGGGSVQSGGSLRLSCAASGFTYSTSNSWMAWFRQAPGKEREGVAAIYTVGGSIFYADSVRGRFTISQDATKNMFYLQMNTLKPEDTAMYYCAAASGRLRGKWFWPYEYNYWGQGTQVTVSS

SEQ ID NO: 12 - protein, 247 aa, synthetic construct
  source 1..247: note = Description of Artificial Sequence: Synthetic polypeptide
QVQLQESGGGSVQAGGSLRLSCTAPGFTSNSCGMDWYRQAPGKEREFVSSISTDGTTGYADSVKGRFTISKDKAKDTVYLQMNSLKPEDTGMYSCKTKDGTIATMELCDFGYWGQGTQVTVSSGGGSQVQLQESGGGSVQAGGSLRLSCVASGYVSCDYFLPSWYRQAPGKEREFVSIIDGTGSTSYAASVKGRFTASQDKGKNIAYLQMNTLKPEDTAMYYCKASCVRGRAISEYWGQGTQVTVSS

SEQ ID NO: 13 - protein, 256 aa, synthetic construct
  source 1..256: note = Description of Artificial Sequence: Synthetic polypeptide
QVQLQESGGGSVQAGGSLRLSCTAPGFTSNSCGMDWYRQAPGKEREFVSSISTDGTTGYADSVKGRFTISKDKAKDTVYLQMNSLKPEDTGMYSCKTKDGTIATMELCDFGYWGQGTQVTVSSGGGSQVQLQESGGGSVQAGGSLRLSCRASGSTYSNYCLGWFRQITGKEREGVAVINWVGGMLYFADSVKGRFTVSQDQAKNTVYLQMNSLKPEDTAMYYCAAESVSSFSCGGWLTRPDRVPYWGQGTQVTVSS

SEQ ID NO: 14 - protein, 250 aa, synthetic construct
  source 1..250: note = Description of Artificial Sequence: Synthetic polypeptide
QVQLQESGGGSVQAGGSLRLSCTAPGFTSNSCGMDWYRQAPGKEREFVSSISTDGTTGYADSVKGRFTISKDKAKDTVYLQMNSLKPEDTGMYSCKTKDGTIATMELCDFGYWGQGTQVTVSSGGGSQVQLQESGGGLVQPGGSLRLSCAASGFTFSLSSMSWVRQAPGKGLEWVSAISSGGASTYYTDSVKGRFTISRDNAKNMLYLQLNSLKTEDTAMYYCAKGGSGYGDASRMTSPGSQGTQVTVSS

SEQ ID NO: 15 - protein, 255 aa, synthetic construct
  source 1..255: note = Description of Artificial Sequence: Synthetic polypeptide
QVQLQESGGGSVQAGGSLRLSCAASGYPYSNGYMGWFRQAPGKEREGVATIYTGDGRTYYADSVKGRFTISRDNAKNTVDLQMSSLKPEDTAMYYCAARAAPLYSSGSPLTRARYNVWGQGTQVTVSSGGGSQVQLQESGGGLVQPGGSLRLSCAASGFTFSSYPMSWVRQAPGKGLEWISTISAGGDTTLYADSVKGRFTSSRDNAKNTLYLQLNSLKTEDAAIYYCAKRIDCNSGYCYRRNYWGQGTQVTVSS

SEQ ID NO: 16 - protein, 256 aa, synthetic construct
  source 1..256: note = Description of Artificial Sequence: Synthetic polypeptide
QVQLQESGGGSVQAGGSLRLSCAASGYPYSNGYMGWFRQAPGKEREGVATIYTGDGRTYYADSVKGRFTISRDNAKNTVDLQMSSLKPEDTAMYYCAARAAPLYSSGSPLTRARYNVWGQGTQVTVSSGGGSQVQLQESGGGLVQPGESLRLSCTASGFTFSNYAMSWVRQAPGKGLEWVSGINVAYGITSYADSVKGRFTISRDNTKNTLYLQLNSLKTEDTAIYYCVKHSGTTIPRGFISYTKRGQGTQVTVSS

SEQ ID NO: 17 - protein, 251 aa, synthetic construct
  source 1..251: note = Description of Artificial Sequence: Synthetic polypeptide
QVQLQESGGGSVQAGGSLRLSCAASGYPYSNGYMGWFRQAPGKEREGVATIYTGDGRTYYADSVKGRFTISRDNAKNTVDLQMSSLKPEDTAMYYCAARAAPLYSSGSPLTRARYNVWGQGTQVTVSSGGGSQVQLQESGGGLVQPGGSLRLSCAASGFSFSSYAMKWVRQAPGKGLEWVSTISSGGSSTNYADSVKGRFTISRDNAKNTLYLQLNSLKIEDTAMYYCAKAIVPTGATMERGQGTQVTVSS

SEQ ID NO: 18 - protein, 260 aa, synthetic construct
  source 1..260: note = Description of Artificial Sequence: Synthetic polypeptide
QVQLQESGGGSVQAGGSLRLSCAASGYPYSNGYMGWFRQAPGKEREGVATIYTGDGRTYYADSVKGRFTISRDNAKNTVDLQMSSLKPEDTAMYYCAARAAPLYSSGSPLTRARYNVWGQGTQVTVSSGGGSQVQLQESGGGSVQSGGSLRLSCAASGFTYSTSNSWMAWFRQAPGKEREGVAAIYTVGGSIFYADSVRGRFTISQDATKNMFYLQMNTLKPEDTAMYYCAAASGRLRGKWFWPYEYNYWGQGTQVTVSS

SEQ ID NO: 19 - protein, 252 aa, synthetic construct
  source 1..252: note = Description of Artificial Sequence: Synthetic polypeptide
QVQLQESGGGSVQAGGSLRLSCAASGYPYSNGYMGWFRQAPGKEREGVATIYTGDGRTYYADSVKGRFTISRDNAKNTVDLQMSSLKPEDTAMYYCAARAAPLYSSGSPLTRARYNVWGQGTQVTVSSGGGSQVQLQESGGGSVQAGGSLRLSCVASGYVSCDYFLPSWYRQAPGKEREFVSIIDGTGSTSYAASVKGRFTASQDKGKNIAYLQMNTLKPEDTAMYYCKASCVRGRAISEYWGQGTQVTVSS

SEQ ID NO: 20 - protein, 261 aa, synthetic construct
  source 1..261: note = Description of Artificial Sequence: Synthetic polypeptide
QVQLQESGGGSVQAGGSLRLSCAASGYPYSNGYMGWFRQAPGKEREGVATIYTGDGRTYYADSVKGRFTISRDNAKNTVDLQMSSLKPEDTAMYYCAARAAPLYSSGSPLTRARYNVWGQGTQVTVSSGGGSQVQLQESGGGSVQAGGSLRLSCRASGSTYSNYCLGWFRQITGKEREGVAVINWVGGMLYFADSVKGRFTVSQDQAKNTVYLQMNSLKPEDTAMYYCAAESVSSFSCGGWLTRPDRVPYWGQGTQVTVSS

SEQ ID NO: 21 - protein, 255 aa, synthetic construct
  source 1..255: note = Description of Artificial Sequence: Synthetic polypeptide
QVQLQESGGGSVQAGGSLRLSCAASGYPYSNGYMGWFRQAPGKEREGVATIYTGDGRTYYADSVKGRFTISRDNAKNTVDLQMSSLKPEDTAMYYCAARAAPLYSSGSPLTRARYNVWGQGTQVTVSSGGGSQVQLQESGGGLVQPGGSLRLSCAASGFTFSLSSMSWVRQAPGKGLEWVSAISSGGASTYYTDSVKGRFTISRDNAKNMLYLQLNSLKTEDTAMYYCAKGGSGYGDASRMTSPGSQGTQVTVSS

SEQ ID NO: 22 - protein, 246 aa, synthetic construct
  source 1..246: note = Description of Artificial Sequence: Synthetic polypeptide
QVQLQESGGGSVQAGGSLRLSCVASASTYCTYDMHWYRQAPGKGREFVSAIDSDGTTRYADSVKGRFTISQGTAKNTVYLQMNSLQPEDTAMYYCKTVCVVGSRWSDYWGQGTQVTVSSGGGSQVQLQESGGGLVQPGGSLRLSCAASGFTFSSYPMSWVRQAPGKGLEWISTISAGGDTTLYADSVKGRFTSSRDNAKNTLYLQLNSLKTEDAAIYYCAKRIDCNSGYCYRRNYWGQGTQVTVSS

SEQ ID NO: 23 - protein, 247 aa, synthetic construct
  source 1..247: note = Description of Artificial Sequence: Synthetic polypeptide
QVQLQESGGGSVQAGGSLRLSCVASASTYCTYDMHWYRQAPGKGREFVSAIDSDGTTRYADSVKGRFTISQGTAKNTVYLQMNSLQPEDTAMYYCKTVCVVGSRWSDYWGQGTQVTVSSGGGSQVQLQESGGGLVQPGESLRLSCTASGFTFSNYAMSWVRQAPGKGLEWVSGINVAYGITSYADSVKGRFTISRDNTKNTLYLQLNSLKTEDTAIYYCVKHSGTTIPRGFISYTKRGQGTQVTVSS

SEQ ID NO: 24 - protein, 242 aa, synthetic construct
  source 1..242: note = Description of Artificial Sequence: Synthetic polypeptide
QVQLQESGGGSVQAGGSLRLSCVASASTYCTYDMHWYRQAPGKGREFVSAIDSDGTTRYADSVKGRFTISQGTAKNTVYLQMNSLQPEDTAMYYCKTVCVVGSRWSDYWGQGTQVTVSSGGGSQVQLQESGGGLVQPGGSLRLSCAASGFSFSSYAMKWVRQAPGKGLEWVSTISSGGSSTNYADSVKGRFTISRDNAKNTLYLQLNSLKIEDTAMYYCAKAIVPTGATMERGQGTQVTVSS

SEQ ID NO: 25 - protein, 251 aa, synthetic construct
  source 1..251: note = Description of Artificial Sequence: Synthetic polypeptide
QVQLQESGGGSVQAGGSLRLSCVASASTYCTYDMHWYRQAPGKGREFVSAIDSDGTTRYADSVKGRFTISQGTAKNTVYLQMNSLQPEDTAMYYCKTVCVVGSRWSDYWGQGTQVTVSSGGGSQVQLQESGGGSVQSGGSLRLSCAASGFTYSTSNSWMAWFRQAPGKEREGVAAIYTVGGSIFYADSVRGRFTISQDATKNMFYLQMNTLKPEDTAMYYCAAASGRLRGKWFWPYEYNYWGQGTQVTVSS

SEQ ID NO: 26 - protein, 243 aa, synthetic construct
  source 1..243: note = Description of Artificial Sequence: Synthetic polypeptide
QVQLQESGGGSVQAGGSLRLSCVASASTYCTYDMHWYRQAPGKGREFVSAIDSDGTTRYADSVKGRFTISQGTAKNTVYLQMNSLQPEDTAMYYCKTVCVVGSRWSDYWGQGTQVTVSSGGGSQVQLQESGGGSVQAGGSLRLSCVASGYVSCDYFLPSWYRQAPGKEREFVSIIDGTGSTSYAASVKGRFTASQDKGKNIAYLQMNTLKPEDTAMYYCKASCVRGRAISEYWGQGTQVTVSS

SEQ ID NO: 27 - protein, 252 aa, synthetic construct
  source 1..252: note = Description of Artificial Sequence: Synthetic polypeptide
QVQLQESGGGSVQAGGSLRLSCVASASTYCTYDMHWYRQAPGKGREFVSAIDSDGTTRYADSVKGRFTISQGTAKNTVYLQMNSLQPEDTAMYYCKTVCVVGSRWSDYWGQGTQVTVSSGGGSQVQLQESGGGSVQAGGSLRLSCRASGSTYSNYCLGWFRQITGKEREGVAVINWVGGMLYFADSVKGRFTVSQDQAKNTVYLQMNSLKPEDTAMYYCAAESVSSFSCGGWLTRPDRVPYWGQGTQVTVSS

SEQ ID NO: 28 - protein, 246 aa, synthetic construct
  source 1..246: note = Description of Artificial Sequence: Synthetic polypeptide
QVQLQESGGGSVQAGGSLRLSCVASASTYCTYDMHWYRQAPGKGREFVSAIDSDGTTRYADSVKGRFTISQGTAKNTVYLQMNSLQPEDTAMYYCKTVCVVGSRWSDYWGQGTQVTVSSGGGSQVQLQESGGGLVQPGGSLRLSCAASGFTFSLSSMSWVRQAPGKGLEWVSAISSGGASTYYTDSVKGRFTISRDNAKNMLYLQLNSLKTEDTAMYYCAKGGSGYGDASRMTSPGSQGTQVTVSS

SEQ ID NO: 29 - protein, 244 aa, synthetic construct
  source 1..244: note = Description of Artificial Sequence: Synthetic polypeptide
QVQLQESGGGSVQAGGSLTLSCAASEYAYSTCNMGWYRQAPGKERELVSAFISDGSTYYADSVKGRFTITRDNAKNTVYLQMNSLKPEDTAIYYCSANCYRRLRNYWGQGTQVTVSSGGGSQVQLQESGGGLVQPGGSLRLSCAASGFTFSSYPMSWVRQAPGKGLEWISTISAGGDTTLYADSVKGRFTSSRDNAKNTLYLQLNSLKTEDAAIYYCAKRIDCNSGYCYRRNYWGQGTQVTVSS

SEQ ID NO: 30 - protein, 245 aa, synthetic construct
  source 1..245: note = Description of Artificial Sequence: Synthetic polypeptide
QVQLQESGGGSVQAGGSLTLSCAASEYAYSTCNMGWYRQAPGKERELVSAFISDGSTYYADSVKGRFTITRDNAKNTVYLQMNSLKPEDTAIYYCSANCYRRLRNYWGQGTQVTVSSGGGSQVQLQESGGGLVQPGESLRLSCTASGFTFSNYAMSWVRQAPGKGLEWVSGINVAYGITSYADSVKGRFTISRDNTKNTLYLQLNSLKTEDTAIYYCVKHSGTTIPRGFISYTKRGQGTQVTVSS

SEQ ID NO: 31 - protein, 240 aa, synthetic construct
  source 1..240: note = Description of Artificial Sequence: Synthetic polypeptide
QVQLQESGGGSVQAGGSLTLSCAASEYAYSTCNMGWYRQAPGKERELVSAFISDGSTYYADSVKGRFTITRDNAKNTVYLQMNSLKPEDTAIYYCSANCYRRLRNYWGQGTQVTVSSGGGSQVQLQESGGGLVQPGGSLRLSCAASGFSFSSYAMKWVRQAPGKGLEWVSTISSGGSSTNYADSVKGRFTISRDNAKNTLYLQLNSLKIEDTAMYYCAKAIVPTGATMERGQGTQVTVSS

SEQ ID NO: 32 - protein, 249 aa, synthetic construct
  source 1..249: note = Description of Artificial Sequence: Synthetic polypeptide
QVQLQESGGGSVQAGGSLTLSCAASEYAYSTCNMGWYRQAPGKERELVSAFISDGSTYYADSVKGRFTITRDNAKNTVYLQMNSLKPEDTAIYYCSANCYRRLRNYWGQGTQVTVSSGGGSQVQLQESGGGSVQSGGSLRLSCAASGFTYSTSNSWMAWFRQAPGKEREGVAAIYTVGGSIFYADSVRGRFTISQDATKNMFYLQMNTLKPEDTAMYYCAAASGRLRGKWFWPYEYNYWGQGTQVTVSS

SEQ ID NO: 33 - protein, 241 aa, synthetic construct
  source 1..241: note = Description of Artificial Sequence: Synthetic polypeptide
QVQLQESGGGSVQAGGSLTLSCAASEYAYSTCNMGWYRQAPGKERELVSAFISDGSTYYADSVKGRFTITRDNAKNTVYLQMNSLKPEDTAIYYCSANCYRRLRNYWGQGTQVTVSSGGGSQVQLQESGGGSVQAGGSLRLSCVASGYVSCDYFLPSWYRQAPGKEREFVSIIDGTGSTSYAASVKGRFTASQDKGKNIAYLQMNTLKPEDTAMYYCKASCVRGRAISEYWGQGTQVTVSS

SEQ ID NO: 34 - protein, 250 aa, synthetic construct
  source 1..250: note = Description of Artificial Sequence: Synthetic polypeptide
QVQLQESGGGSVQAGGSLTLSCAASEYAYSTCNMGWYRQAPGKERELVSAFISDGSTYYADSVKGRFTITRDNAKNTVYLQMNSLKPEDTAIYYCSANCYRRLRNYWGQGTQVTVSSGGGSQVQLQESGGGSVQAGGSLRLSCRASGSTYSNYCLGWFRQITGKEREGVAVINWVGGMLYFADSVKGRFTVSQDQAKNTVYLQMNSLKPEDTAMYYCAAESVSSFSCGGWLTRPDRVPYWGQGTQVTVSS

SEQ ID NO: 35 - protein, 244 aa, synthetic construct
  source 1..244: note = Description of Artificial Sequence: Synthetic polypeptide
QVQLQESGGGSVQAGGSLTLSCAASEYAYSTCNMGWYRQAPGKERELVSAFISDGSTYYADSVKGRFTITRDNAKNTVYLQMNSLKPEDTAIYYCSANCYRRLRNYWGQGTQVTVSSGGGSQVQLQESGGGLVQPGGSLRLSCAASGFTFSLSSMSWVRQAPGKGLEWVSAISSGGASTYYTDSVKGRFTISRDNAKNMLYLQLNSLKTEDTAMYYCAKGGSGYGDASRMTSPGSQGTQVTVSS

SEQ ID NO: 36 - protein, 251 aa, synthetic construct
  source 1..251: note = Description of Artificial Sequence: Synthetic polypeptide
QVQLQESGGGLVQPGGSLRLSCTASGLTFDDSVMGWFRQAPGKGREAVSCISSSGANAFYADSVKGRFTISRDNAKNTLYLQMNSLKPEDTATYYCKRGHACAGYYPIPYDDYWGQGTQVTVSSGGGSQVQLQESGGGLVQPGGSLRLSCAASGFTFSSYPMSWVRQAPGKGLEWISTISAGGDTTLYADSVKGRFTSSRDNAKNTLYLQLNSLKTEDAAIYYCAKRIDCNSGYCYRRNYWGQGTQVTVSS

SEQ ID NO: 37 - protein, 252 aa, synthetic construct
  source 1..252: note = Description of Artificial Sequence: Synthetic polypeptide
QVQLQESGGGLVQPGGSLRLSCTASGLTFDDSVMGWFRQAPGKGREAVSCISSSGANAFYADSVKGRFTISRDNAKNTLYLQMNSLKPEDTATYYCKRGHACAGYYPIPYDDYWGQGTQVTVSSGGGSQVQLQESGGGLVQPGESLRLSCTASGFTFSNYAMSWVRQAPGKGLEWVSGINVAYGITSYADSVKGRFTISRDNTKNTLYLQLNSLKTEDTAIYYCVKHSGTTIPRGFISYTKRGQGTQVTVSS

SEQ ID NO: 38 - protein, 247 aa, synthetic construct
  source 1..247: note = Description of Artificial Sequence: Synthetic polypeptide
QVQLQESGGGLVQPGGSLRLSCTASGLTFDDSVMGWFRQAPGKGREAVSCISSSGANAFYADSVKGRFTISRDNAKNTLYLQMNSLKPEDTATYYCKRGHACAGYYPIPYDDYWGQGTQVTVSSGGGSQVQLQESGGGLVQPGGSLRLSCAASGFSFSSYAMKWVRQAPGKGLEWVSTISSGGSSTNYADSVKGRFTISRDNAKNTLYLQLNSLKIEDTAMYYCAKAIVPTGATMERGQGTQVTVSS

SEQ ID NO: 39 - protein, 256 aa, synthetic construct
  source 1..256: note = Description of Artificial Sequence: Synthetic polypeptide
QVQLQESGGGLVQPGGSLRLSCTASGLTFDDSVMGWFRQAPGKGREAVSCISSSGANAFYADSVKGRFTISRDNAKNTLYLQMNSLKPEDTATYYCKRGHACAGYYPIPYDDYWGQGTQVTVSSGGGSQVQLQESGGGSVQSGGSLRLSCAASGFTYSTSNSWMAWFRQAPGKEREGVAAIYTVGGSIFYADSVRGRFTISQDATKNMFYLQMNTLKPEDTAMYYCAAASGRLRGKWFWPYEYNYWGQGTQVTVSS

SEQ ID NO: 40 - protein, 248 aa, synthetic construct
  source 1..248: note = Description of Artificial Sequence: Synthetic polypeptide
QVQLQESGGGLVQPGGSLRLSCTASGLTFDDSVMGWFRQAPGKGREAVSCISSSGANAFYADSVKGRFTISRDNAKNTLYLQMNSLKPEDTATYYCKRGHACAGYYPIPYDDYWGQGTQVTVSSGGGSQVQLQESGGGSVQAGGSLRLSCVASGYVSCDYFLPSWYRQAPGKEREFVSIIDGTGSTSYAASVKGRFTASQDKGKNIAYLQMNTLKPEDTAMYYCKASCVRGRAISEYWGQGTQVTVSS

SEQ ID NO: 41 - protein, 257 aa, synthetic construct
  source 1..257: note = Description of Artificial Sequence: Synthetic polypeptide
QVQLQESGGGLVQPGGSLRLSCTASGLTFDDSVMGWFRQAPGKGREAVSCISSSGANAFYADSVKGRFTISRDNAKNTLYLQMNSLKPEDTATYYCKRGHACAGYYPIPYDDYWGQGTQVTVSSGGGSQVQLQESGGGSVQAGGSLRLSCRASGSTYSNYCLGWFRQITGKEREGVAVINWVGGMLYFADSVKGRFTVSQDQAKNTVYLQMNSLKPEDTAMYYCAAESVSSFSCGGWLTRPDRVPYWGQGTQVTVSS

SEQ ID NO: 42 - protein, 251 aa, synthetic construct
  source 1..251: note = Description of Artificial Sequence: Synthetic polypeptide
QVQLQESGGGLVQPGGSLRLSCTASGLTFDDSVMGWFRQAPGKGREAVSCISSSGANAFYADSVKGRFTISRDNAKNTLYLQMNSLKPEDTATYYCKRGHACAGYYPIPYDDYWGQGTQVTVSSGGGSQVQLQESGGGLVQPGGSLRLSCAASGFTFSLSSMSWVRQAPGKGLEWVSAISSGGASTYYTDSVKGRFTISRDNAKNMLYLQLNSLKTEDTAMYYCAKGGSGYGDASRMTSPGSQGTQVTVSS

SEQ ID NO: 43 - protein, 255 aa, synthetic construct
  source 1..255: note = Description of Artificial Sequence: Synthetic polypeptide
QVQLQESGGGLVQPGGSLRLSCAASGFTFSSYPMSWVRQAPGKGLEWISTISAGGDTTLYADSVKGRFTSSRDNAKNTLYLQLNSLKTEDAAIYYCAKRIDCNSGYCYRRNYWGQGTQVTVSSGGGSQVQLQESGGGSVQAGGSLRLSCTASGAIASGYIDSRWCMAWFRQAPGKEREGVAAIWPGGGLTVYADSVKGRFTISRDHAKNTLYLQMNNLKPEDTAMYYCAAGSPRMCPSLEFGFDYWGQGTQVTVS

SEQ ID NO: 44 - protein, 249 aa, synthetic construct
  source 1..249: note = Description of Artificial Sequence: Synthetic polypeptide
QVQLQESGGGLVQPGGSLRLSCAASGFTFSSYPMSWVRQAPGKGLEWISTISAGGDTTLYADSVKGRFTSSRDNAKNTLYLQLNSLKTEDAAIYYCAKRIDCNSGYCYRRNYWGQGTQVTVSSGGGSQVQLQESGGGSVQAGGSLRLSCTAPGFTSNSCGMDWYRQAPGKEREFVSSISTDGTTGYADSVKGRFTISKDKAKDTVYLQMNSLKPEDTGMYSCKTKDGTIATMELCDFGYWGQGTQVTVS

SEQ ID NO: 45 - protein, 254 aa, synthetic construct
  source 1..254: note = Description of Artificial Sequence: Synthetic polypeptide
QVQLQESGGGLVQPGGSLRLSCAASGFTFSSYPMSWVRQAPGKGLEWISTISAGGDTTLYADSVKGRFTSSRDNAKNTLYLQLNSLKTEDAAIYYCAKRIDCNSGYCYRRNYWGQGTQVTVSSGGGSQVQLQESGGGSVQAGGSLRLSCAASGYPYSNGYMGWFRQAPGKEREGVATIYTGDGRTYYADSVKGRFTISRDNAKNTVDLQMSSLKPEDTAMYYCAARAAPLYSSGSPLTRARYNVWGQGTQVTVS

SEQ ID NO: 46 - protein, 245 aa, synthetic construct
  source 1..245: note = Description of Artificial Sequence: Synthetic polypeptide
QVQLQESGGGLVQPGGSLRLSCAASGFTFSSYPMSWVRQAPGKGLEWISTISAGGDTTLYADSVKGRFTSSRDNAKNTLYLQLNSLKTEDAAIYYCAKRIDCNSGYCYRRNYWGQGTQVTVSSGGGSQVQLQESGGGSVQAGGSLRLSCVASASTYCTYDMHWYRQAPGKGREFVSAIDSDGTTRYADSVKGRFTISQGTAKNTVYLQMNSLQPEDTAMYYCKTVCVVGSRWSDYWGQGTQVTVS

SEQ ID NO: 47 - protein, 243 aa, synthetic construct
  source 1..243: note = Description of Artificial Sequence: Synthetic polypeptide
QVQLQESGGGLVQPGGSLRLSCAASGFTFSSYPMSWVRQAPGKGLEWISTISAGGDTTLYADSVKGRFTSSRDNAKNTLYLQLNSLKTEDAAIYYCAKRIDCNSGYCYRRNYWGQGTQVTVSSGGGSQVQLQESGGGSVQAGGSLTLSCAASEYAYSTCNMGWYRQAPGKERELVSAFISDGSTYYADSVKGRFTITRDNAKNTVYLQMNSLKPEDTAIYYCSANCYRRLRNYWGQGTQVTVS

SEQ ID NO: 48 - protein, 250 aa, synthetic construct
  source 1..250: note = Description of Artificial Sequence: Synthetic polypeptide
QVQLQESGGGLVQPGGSLRLSCAASGFTFSSYPMSWVRQAPGKGLEWISTISAGGDTTLYADSVKGRFTSSRDNAKNTLYLQLNSLKTEDAAIYYCAKRIDCNSGYCYRRNYWGQGTQVTVSSGGGSQVQLQESGGGLVQPGGSLRLSCTASGLTFDDSVMGWFRQAPGKGREAVSCISSSGANAFYADSVKGRFTISRDNAKNTLYLQMNSLKPEDTATYYCKRGHACAGYYPIPYDDYWGQGTQVTVS

SEQ ID NO: 49 - protein, 256 aa, synthetic construct
  source 1..256: note = Description of Artificial Sequence: Synthetic polypeptide
QVQLQESGGGLVQPGESLRLSCTASGFTFSNYAMSWVRQAPGKGLEWVSGINVAYGITSYADSVKGRFTISRDNTKNTLYLQLNSLKTEDTAIYYCVKHSGTTIPRGFISYTKRGQGTQVTVSSGGGSQVQLQESGGGSVQAGGSLRLSCTASGAIASGYIDSRWCMAWFRQAPGKEREGVAAIWPGGGLTVYADSVKGRFTISRDHAKNTLYLQMNNLKPEDTAMYYCAAGSPRMCPSLEFGFDYWGQGTQVTVS

SEQ ID NO: 50 - protein, 250 aa, synthetic construct
  source 1..250: note = Description of Artificial Sequence: Synthetic polypeptide
QVQLQESGGGLVQPGESLRLSCTASGFTFSNYAMSWVRQAPGKGLEWVSGINVAYGITSYADSVKGRFTISRDNTKNTLYLQLNSLKTEDTAIYYCVKHSGTTIPRGFISYTKRGQGTQVTVSSGGGSQVQLQESGGGSVQAGGSLRLSCTAPGFTSNSCGMDWYRQAPGKEREFVSSISTDGTTGYADSVKGRFTISKDKAKDTVYLQMNSLKPEDTGMYSCKTKDGTIATMELCDFGYWGQGTQVTVS

SEQ ID NO: 51 - protein, 255 aa, synthetic construct
  source 1..255: note = Description of Artificial Sequence: Synthetic polypeptide
QVQLQESGGGLVQPGESLRLSCTASGFTFSNYAMSWVRQAPGKGLEWVSGINVAYGITSYADSVKGRFTISRDNTKNTLYLQLNSLKTEDTAIYYCVKHSGTTIPRGFISYTKRGQGTQVTVSSGGGSQVQLQESGGGSVQAGGSLRLSCAASGYPYSNGYMGWFRQAPGKEREGVATIYTGDGRTYYADSVKGRFTISRDNAKNTVDLQMSSLKPEDTAMYYCAARAAPLYSSGSPLTRARYNVWGQGTQVTVS

SEQ ID NO: 52 - protein, 246 aa, synthetic construct
  source 1..246: note = Description of Artificial Sequence: Synthetic polypeptide
QVQLQESGGGLVQPGESLRLSCTASGFTFSNYAMSWVRQAPGKGLEWVSGINVAYGITSYADSVKGRFTISRDNTKNTLYLQLNSLKTEDTAIYYCVKHSGTTIPRGFISYTKRGQGTQVTVSSGGGSQVQLQESGGGSVQAGGSLRLSCVASASTYCTYDMHWYRQAPGKGREFVSAIDSDGTTRYADSVKGRFTISQGTAKNTVYLQMNSLQPEDTAMYYCKTVCVVGSRWSDYWGQGTQVTVS

SEQ ID NO: 53 - protein, 244 aa, synthetic construct
  source 1..244: note = Description of Artificial Sequence: Synthetic polypeptide
QVQLQESGGGLVQPGESLRLSCTASGFTFSNYAMSWVRQAPGKGLEWVSGINVAYGITSYADSVKGRFTISRDNTKNTLYLQLNSLKTEDTAIYYCVKHSGTTIPRGFISYTKRGQGTQVTVSSGGGSQVQLQESGGGSVQAGGSLTLSCAASEYAYSTCNMGWYRQAPGKERELVSAFISDGSTYYADSVKGRFTITRDNAKNTVYLQMNSLKPEDTAIYYCSANCYRRLRNYWGQGTQVTVS

SEQ ID NO: 54 - protein, 251 aa, synthetic construct
  source 1..251: note = Description of Artificial Sequence: Synthetic polypeptide
QVQLQESGGGLVQPGESLRLSCTASGFTFSNYAMSWVRQAPGKGLEWVSGINVAYGITSYADSVKGRFTISRDNTKNTLYLQLNSLKTEDTAIYYCVKHSGTTIPRGFISYTKRGQGTQVTVSSGGGSQVQLQESGGGLVQPGGSLRLSCTASGLTFDDSVMGWFRQAPGKGREAVSCISSSGANAFYADSVKGRFTISRDNAKNTLYLQMNSLKPEDTATYYCKRGHACAGYYPIPYDDYWGQGTQVTVS

SEQ ID NO: 55 - protein, 251 aa, synthetic construct
  source 1..251: note = Description of Artificial Sequence: Synthetic polypeptide
QVQLQESGGGLVQPGGSLRLSCAASGFSFSSYAMKWVRQAPGKGLEWVSTISSGGSSTNYADSVKGRFTISRDNAKNTLYLQLNSLKIEDTAMYYCAKAIVPTGATMERGQGTQVTVSSGGGSQVQLQESGGGSVQAGGSLRLSCTASGAIASGYIDSRWCMAWFRQAPGKEREGVAAIWPGGGLTVYADSVKGRFTISRDHAKNTLYLQMNNLKPEDTAMYYCAAGSPRMCPSLEFGFDYWGQGTQVTVS

SEQ ID NO: 56 - protein, 245 aa, synthetic construct
  source 1..245: note = Description of Artificial Sequence: Synthetic polypeptide
QVQLQESGGGLVQPGGSLRLSCAASGFSFSSYAMKWVRQAPGKGLEWVSTISSGGSSTNYADSVKGRFTISRDNAKNTLYLQLNSLKIEDTAMYYCAKAIVPTGATMERGQGTQVTVSSGGGSQVQLQESGGGSVQAGGSLRLSCTAPGFTSNSCGMDWYRQAPGKEREFVSSISTDGTTGYADSVKGRFTISKDKAKDTVYLQMNSLKPEDTGMYSCKTKDGTIATMELCDFGYWGQGTQVTVS

SEQ ID NO: 57 - protein, 250 aa, synthetic construct
  source 1..250: note = Description of Artificial Sequence: Synthetic polypeptide
QVQLQESGGGLVQPGGSLRLSCAASGFSFSSYAMKWVRQAPGKGLEWVSTISSGGSSTNYADSVKGRFTISRDNAKNTLYLQLNSLKIEDTAMYYCAKAIVPTGATMERGQGTQVTVSSGGGSQVQLQESGGGSVQAGGSLRLSCAASGYPYSNGYMGWFRQAPGKEREGVATIYTGDGRTYYADSVKGRFTISRDNAKNTVDLQMSSLKPEDTAMYYCAARAAPLYSSGSPLTRARYNVWGQGTQVTVS

SEQ ID NO: 58 - protein, 241 aa, synthetic construct
  source 1..241: note = Description of Artificial Sequence: Synthetic polypeptide
QVQLQESGGGLVQPGGSLRLSCAASGFSFSSYAMKWVRQAPGKGLEWVSTISSGGSSTNYADSVKGRFTISRDNAKNTLYLQLNSLKIEDTAMYYCAKAIVPTGATMERGQGTQVTVSSGGGSQVQLQESGGGSVQAGGSLRLSCVASASTYCTYDMHWYRQAPGKGREFVSAIDSDGTTRYADSVKGRFTISQGTAKNTVYLQMNSLQPEDTAMYYCKTVCVVGSRWSDYWGQGTQVTVS

SEQ ID NO: 59 - protein, 239 aa, synthetic construct
  source 1..239: note = Description of Artificial Sequence: Synthetic polypeptide
QVQLQESGGGLVQPGGSLRLSCAASGFSFSSYAMKWVRQAPGKGLEWVSTISSGGSSTNYADSVKGRFTISRDNAKNTLYLQLNSLKIEDTAMYYCAKAIVPTGATMERGQGTQVTVSSGGGSQVQLQESGGGSVQAGGSLTLSCAASEYAYSTCNMGWYRQAPGKERELVSAFISDGSTYYADSVKGRFTITRDNAKNTVYLQMNSLKPEDTAIYYCSANCYRRLRNYWGQGTQVTVS

SEQ ID NO: 60 - protein, 246 aa, synthetic construct
  source 1..246: note = Description of Artificial Sequence: Synthetic polypeptide
QVQLQESGGGLVQPGGSLRLSCAASGFSFSSYAMKWVRQAPGKGLEWVSTISSGGSSTNYADSVKGRFTISRDNAKNTLYLQLNSLKIEDTAMYYCAKAIVPTGATMERGQGTQVTVSSGGGSQVQLQESGGGLVQPGGSLRLSCTASGLTFDDSVMGWFRQAPGKGREAVSCISSSGANAFYADSVKGRFTISRDNAKNTLYLQMNSLKPEDTATYYCKRGHACAGYYPIPYDDYWGQGTQVTVS

SEQ ID NO: 61 - protein, 260 aa, synthetic construct
  source 1..260: note = Description of Artificial Sequence: Synthetic polypeptide
QVQLQESGGGSVQSGGSLRLSCAASGFTYSTSNSWMAWFRQAPGKEREGVAAIYTVGGSIFYADSVRGRFTISQDATKNMFYLQMNTLKPEDTAMYYCAAASGRLRGKWFWPYEYNYWGQGTQVTVSSGGGSQVQLQESGGGSVQAGGSLRLSCTASGAIASGYIDSRWCMAWFRQAPGKEREGVAAIWPGGGLTVYADSVKGRFTISRDHAKNTLYLQMNNLKPEDTAMYYCAAGSPRMCPSLEFGFDYWGQGTQVTVS

SEQ ID NO: 62 - protein, 254 aa, synthetic construct
  source 1..254: note = Description of Artificial Sequence: Synthetic polypeptide
QVQLQESGGGSVQSGGSLRLSCAASGFTYSTSNSWMAWFRQAPGKEREGVAAIYTVGGSIFYADSVRGRFTISQDATKNMFYLQMNTLKPEDTAMYYCAAASGRLRGKWFWPYEYNYWGQGTQVTVSSGGGSQVQLQESGGGSVQAGGSLRLSCTAPGFTSNSCGMDWYRQAPGKEREFVSSISTDGTTGYADSVKGRFTISKDKAKDTVYLQMNSLKPEDTGMYSCKTKDGTIATMELCDFGYWGQGTQVTVS

SEQ ID NO: 63 - protein, 259 aa, synthetic construct
  source 1..259: note = Description of Artificial Sequence: Synthetic polypeptide
QVQLQESGGGSVQSGGSLRLSCAASGFTYSTSNSWMAWFRQAPGKEREGVAAIYTVGGSIFYADSVRGRFTISQDATKNMFYLQMNTLKPEDTAMYYCAAASGRLRGKWFWPYEYNYWGQGTQVTVSSGGGSQVQLQESGGGSVQAGGSLRLSCAASGYPYSNGYMGWFRQAPGKEREGVATIYTGDGRTYYADSVKGRFTISRDNAKNTVDLQMSSLKPEDTAMYYCAARAAPLYSSGSPLTRARYNVWGQGTQVTVS

SEQ ID NO: 64 - protein, 250 aa, synthetic construct
  source 1..250: note = Description of Artificial Sequence: Synthetic polypeptide
QVQLQESGGGSVQSGGSLRLSCAASGFTYSTSNSWMAWFRQAPGKEREGVAAIYTVGGSIFYADSVRGRFTISQDATKNMFYLQMNTLKPEDTAMYYCAAASGRLRGKWFWPYEYNYWGQGTQVTVSSGGGSQVQLQESGGGSVQAGGSLRLSCVASASTYCTYDMHWYRQAPGKGREFVSAIDSDGTTRYADSVKGRFTISQGTAKNTVYLQMNSLQPEDTAMYYCKTVCVVGSRWSDYWGQGTQVTVS

SEQ ID NO: 65 - protein, 248 aa, synthetic construct
  source 1..248: note = Description of Artificial Sequence: Synthetic polypeptide
QVQLQESGGGSVQSGGSLRLSCAASGFTYSTSNSWMAWFRQAPGKEREGVAAIYTVGGSIFYADSVRGRFTISQDATKNMFYLQMNTLKPEDTAMYYCAAASGRLRGKWFWPYEYNYWGQGTQVTVSSGGGSQVQLQESGGGSVQAGGSLTLSCAASEYAYSTCNMGWYRQAPGKERELVSAFISDGSTYYADSVKGRFTITRDNAKNTVYLQMNSLKPEDTAIYYCSANCYRRLRNYWGQGTQVTVS

SEQ ID NO: 66 - protein, 255 aa, synthetic construct
  source 1..255: note = Description of Artificial Sequence: Synthetic polypeptide
QVQLQESGGGSVQSGGSLRLSCAASGFTYSTSNSWMAWFRQAPGKEREGVAAIYTVGGSIFYADSVRGRFTISQDATKNMFYLQMNTLKPEDTAMYYCAAASGRLRGKWFWPYEYNYWGQGTQVTVSSGGGSQVQLQESGGGLVQPGGSLRLSCTASGLTFDDSVMGWFRQAPGKGREAVSCISSSGANAFYADSVKGRFTISRDNAKNTLYLQMNSLKPEDTATYYCKRGHACAGYYPIPYDDYWGQGTQVTVS

SEQ ID NO: 67 - protein, 252 aa, synthetic construct
  source 1..252: note = Description of Artificial Sequence: Synthetic polypeptide
QVQLQESGGGSVQAGGSLRLSCVASGYVSCDYFLPSWYRQAPGKEREFVSIIDGTGSTSYAASVKGRFTASQDKGKNIAYLQMNTLKPEDTAMYYCKASCVRGRAISEYWGQGTQVTVSSGGGSQVQLQESGGGSVQAGGSLRLSCTASGAIASGYIDSRWCMAWFRQAPGKEREGVAAIWPGGGLTVYADSVKGRFTISRDHAKNTLYLQMNNLKPEDTAMYYCAAGSPRMCPSLEFGFDYWGQGTQVTVS

SEQ ID NO: 68 - protein, 246 aa, synthetic construct
  source 1..246: note = Description of Artificial Sequence: Synthetic polypeptide
QVQLQESGGGSVQAGGSLRLSCVASGYVSCDYFLPSWYRQAPGKEREFVSIIDGTGSTSYAASVKGRFTASQDKGKNIAYLQMNTLKPEDTAMYYCKASCVRGRAISEYWGQGTQVTVSSGGGSQVQLQESGGGSVQAGGSLRLSCTAPGFTSNSCGMDWYRQAPGKEREFVSSISTDGTTGYADSVKGRFTISKDKAKDTVYLQMNSLKPEDTGMYSCKTKDGTIATMELCDFGYWGQGTQVTVS

SEQ ID NO: 69 - protein, 251 aa, synthetic construct
  source 1..251: note = Description of Artificial Sequence: Synthetic polypeptide
QVQLQESGGGSVQAGGSLRLSCVASGYVSCDYFLPSWYRQAPGKEREFVSIIDGTGSTSYAASVKGRFTASQDKGKNIAYLQMNTLKPEDTAMYYCKASCVRGRAISEYWGQGTQVTVSSGGGSQVQLQESGGGSVQAGGSLRLSCAASGYPYSNGYMGWFRQAPGKEREGVATIYTGDGRTYYADSVKGRFTISRDNAKNTVDLQMSSLKPEDTAMYYCAARAAPLYSSGSPLTRARYNVWGQGTQVTVS

SEQ ID NO: 70 - protein, 242 aa, synthetic construct
  source 1..242: note = Description of Artificial Sequence: Synthetic polypeptide
QVQLQESGGGSVQAGGSLRLSCVASGYVSCDYFLPSWYRQAPGKEREFVSIIDGTGSTSYAASVKGRFTASQDKGKNIAYLQMNTLKPEDTAMYYCKASCVRGRAISEYWGQGTQVTVSSGGGSQVQLQESGGGSVQAGGSLRLSCVASASTYCTYDMHWYRQAPGKGREFVSAIDSDGTTRYADSVKGRFTISQGTAKNTVYLQMNSLQPEDTAMYYCKTVCVVGSRWSDYWGQGTQVTVS

SEQ ID NO: 71 - protein, 240 aa, synthetic construct
  source 1..240: note = Description of Artificial Sequence: Synthetic polypeptide
QVQLQESGGGSVQAGGSLRLSCVASGYVSCDYFLPSWYRQAPGKEREFVSIIDGTGSTSYAASVKGRFTASQDKGKNIAYLQMNTLKPEDTAMYYCKASCVRGRAISEYWGQGTQVTVSSGGGSQVQLQESGGGSVQAGGSLTLSCAASEYAYSTCNMGWYRQAPGKERELVSAFISDGSTYYADSVKGRFTITRDNAKNTVYLQMNSLKPEDTAIYYCSANCYRRLRNYWGQGTQVTVS

SEQ ID NO: 72 - protein, 247 aa, synthetic construct
  source 1..247: note = Description of Artificial Sequence: Synthetic polypeptide
QVQLQESGGGSVQAGGSLRLSCVASGYVSCDYFLPSWYRQAPGKEREFVSIIDGTGSTSYAASVKGRFTASQDKGKNIAYLQMNTLKPEDTAMYYCKASCVRGRAISEYWGQGTQVTVSSGGGSQVQLQESGGGLVQPGGSLRLSCTASGLTFDDSVMGWFRQAPGKGREAVSCISSSGANAFYADSVKGRFTISRDNAKNTLYLQMNSLKPEDTATYYCKRGHACAGYYPIPYDDYWGQGTQVTVS

SEQ ID NO: 73 - protein, 261 aa, synthetic construct
  source 1..261: note = Description of Artificial Sequence: Synthetic polypeptide
QVQLQESGGGSVQAGGSLRLSCRASGSTYSNYCLGWFRQITGKEREGVAVINWVGGMLYFADSVKGRFTVSQDQAKNTVYLQMNSLKPEDTAMYYCAAESVSSFSCGGWLTRPDRVPYWGQGTQVTVSSGGGSQVQLQESGGGSVQAGGSLRLSCTASGAIASGYIDSRWCMAWFRQAPGKEREGVAAIWPGGGLTVYADSVKGRFTISRDHAKNTLYLQMNNLKPEDTAMYYCAAGSPRMCPSLEFGFDYWGQGTQVTVS

SEQ ID NO: 74 - protein, 255 aa, synthetic construct
  source 1..255: note = Description of Artificial Sequence: Synthetic polypeptide
QVQLQESGGGSVQAGGSLRLSCRASGSTYSNYCLGWFRQITGKEREGVAVINWVGGMLYFADSVKGRFTVSQDQAKNTVYLQMNSLKPEDTAMYYCAAESVSSFSCGGWLTRPDRVPYWGQGTQVTVSSGGGSQVQLQESGGGSVQAGGSLRLSCTAPGFTSNSCGMDWYRQAPGKEREFVSSISTDGTTGYADSVKGRFTISKDKAKDTVYLQMNSLKPEDTGMYSCKTKDGTIATMELCDFGYWGQGTQVTVS

SEQ ID NO: 75 - protein, 260 aa, synthetic construct
  source 1..260: note = Description of Artificial Sequence: Synthetic polypeptide
QVQLQESGGGSVQAGGSLRLSCRASGSTYSNYCLGWFRQITGKEREGVAVINWVGGMLYFADSVKGRFTVSQDQAKNTVYLQMNSLKPEDTAMYYCAAESVSSFSCGGWLTRPDRVPYWGQGTQVTVSSGGGSQVQLQESGGGSVQAGGSLRLSCAASGYPYSNGYMGWFRQAPGKEREGVATIYTGDGRTYYADSVKGRFTISRDNAKNTVDLQMSSLKPEDTAMYYCAARAAPLYSSGSPLTRARYNVWGQGTQVTVS

SEQ ID NO: 76 - protein, 251 aa, synthetic construct
  source 1..251: note = Description of Artificial Sequence: Synthetic polypeptide
QVQLQESGGGSVQAGGSLRLSCRASGSTYSNYCLGWFRQITGKEREGVAVINWVGGMLYFADSVKGRFTVSQDQAKNTVYLQMNSLKPEDTAMYYCAAESVSSFSCGGWLTRPDRVPYWGQGTQVTVSSGGGSQVQLQESGGGSVQAGGSLRLSCVASASTYCTYDMHWYRQAPGKGREFVSAIDSDGTTRYADSVKGRFTISQGTAKNTVYLQMNSLQPEDTAMYYCKTVCVVGSRWSDYWGQGTQVTVS

SEQ ID NO: 77 - protein, 249 aa, synthetic construct
  source 1..249: note = Description of Artificial Sequence: Synthetic polypeptide
QVQLQESGGGSVQAGGSLRLSCRASGSTYSNYCLGWFRQITGKEREGVAVINWVGGMLYFADSVKGRFTVSQDQAKNTVYLQMNSLKPEDTAMYYCAAESVSSFSCGGWLTRPDRVPYWGQGTQVTVSSGGGSQVQLQESGGGSVQAGGSLTLSCAASEYAYSTCNMGWYRQAPGKERELVSAFISDGSTYYADSVKGRFTITRDNAKNTVYLQMNSLKPEDTAIYYCSANCYRRLRNYWGQGTQVTVS

SEQ ID NO: 78 - protein, 256 aa, synthetic construct
  source 1..256: note = Description of Artificial Sequence: Synthetic polypeptide
QVQLQESGGGSVQAGGSLRLSCRASGSTYSNYCLGWFRQITGKEREGVAVINWVGGMLYFADSVKGRFTVSQDQAKNTVYLQMNSLKPEDTAMYYCAAESVSSFSCGGWLTRPDRVPYWGQGTQVTVSSGGGSQVQLQESGGGLVQPGGSLRLSCTASGLTFDDSVMGWFRQAPGKGREAVSCISSSGANAFYADSVKGRFTISRDNAKNTLYLQMNSLKPEDTATYYCKRGHACAGYYPIPYDDYWGQGTQVTVS

SEQ ID NO: 79 - protein, 255 aa, synthetic construct
  source 1..255: note = Description of Artificial Sequence: Synthetic polypeptide
QVQLQESGGGLVQPGGSLRLSCAASGFTFSLSSMSWVRQAPGKGLEWVSAISSGGASTYYTDSVKGRFTISRDNAKNMLYLQLNSLKTEDTAMYYCAKGGSGYGDASRMTSPGSQGTQVTVSSGGGSQVQLQESGGGSVQAGGSLRLSCTASGAIASGYIDSRWCMAWFRQAPGKEREGVAAIWPGGGLTVYADSVKGRFTISRDHAKNTLYLQMNNLKPEDTAMYYCAAGSPRMCPSLEFGFDYWGQGTQVTVS

SEQ ID NO: 80 - protein, 249 aa, synthetic construct
  source 1..249: note = Description of Artificial Sequence: Synthetic polypeptide
QVQLQESGGGLVQPGGSLRLSCAASGFTFSLSSMSWVRQAPGKGLEWVSAISSGGASTYYTDSVKGRFTISRDNAKNMLYLQLNSLKTEDTAMYYCAKGGSGYGDASRMTSPGSQGTQVTVSSGGGSQVQLQESGGGSVQAGGSLRLSCTAPGFTSNSCGMDWYRQAPGKEREFVSSISTDGTTGYADSVKGRFTISKDKAKDTVYLQMNSLKPEDTGMYSCKTKDGTIATMELCDFGYWGQGTQVTVS

SEQ ID NO: 81 - protein, 254 aa, synthetic construct
  source 1..254: note = Description of Artificial Sequence: Synthetic polypeptide
QVQLQESGGGLVQPGGSLRLSCAASGFTFSLSSMSWVRQAPGKGLEWVSAISSGGASTYYTDSVKGRFTISRDNAKNMLYLQLNSLKTEDTAMYYCAKGGSGYGDASRMTSPGSQGTQVTVSSGGGSQVQLQESGGGSVQAGGSLRLSCAASGYPYSNGYMGWFRQAPGKEREGVATIYTGDGRTYYADSVKGRFTISRDNAKNTVDLQMSSLKPEDTAMYYCAARAAPLYSSGSPLTRARYNVWGQGTQVTVS

SEQ ID NO: 82 - protein, 245 aa, synthetic construct
  source 1..245: note = Description of Artificial Sequence: Synthetic polypeptide
QVQLQESGGGLVQPGGSLRLSCAASGFTFSLSSMSWVRQAPGKGLEWVSAISSGGASTYYTDSVKGRFTISRDNAKNMLYLQLNSLKTEDTAMYYCAKGGSGYGDASRMTSPGSQGTQVTVSSGGGSQVQLQESGGGSVQAGGSLRLSCVASASTYCTYDMHWYRQAPGKGREFVSAIDSDGTTRYADSVKGRFTISQGTAKNTVYLQMNSLQPEDTAMYYCKTVCVVGSRWSDYWGQGTQVTVS

SEQ ID NO: 83 - protein, 243 aa, synthetic construct
  source 1..243: note = Description of Artificial Sequence: Synthetic polypeptide
QVQLQESGGGLVQPGGSLRLSCAASGFTFSLSSMSWVRQAPGKGLEWVSAISSGGASTYYTDSVKGRFTISRDNAKNMLYLQLNSLKTEDTAMYYCAKGGSGYGDASRMTSPGSQGTQVTVSSGGGSQVQLQESGGGSVQAGGSLTLSCAASEYAYSTCNMGWYRQAPGKERELVSAFISDGSTYYADSVKGRFTITRDNAKNTVYLQMNSLKPEDTAIYYCSANCYRRLRNYWGQGTQVTVS

SEQ ID NO: 84 - protein, 250 aa, synthetic construct
  source 1..250: note = Description of Artificial Sequence: Synthetic polypeptide
QVQLQESGGGLVQPGGSLRLSCAASGFTFSLSSMSWVRQAPGKGLEWVSAISSGGASTYYTDSVKGRFTISRDNAKNMLYLQLNSLKTEDTAMYYCAKGGSGYGDASRMTSPGSQGTQVTVSSGGGSQVQLQESGGGLVQPGGSLRLSCTASGLTFDDSVMGWFRQAPGKGREAVSCISSSGANAFYADSVKGRFTISRDNAKNTLYLQMNSLKPEDTATYYCKRGHACAGYYPIPYDDYWGQGTQVTVS

SEQ ID NO: 85 - protein, 5 aa, synthetic construct
  source 1..5: note = Description of Artificial Sequence: Synthetic peptide
GGGGS

SEQ ID NO: 86 - protein, 6 aa, synthetic construct
  source 1..6: note = Description of Artificial Sequence: Synthetic peptide
GGGGGS

SEQ ID NO: 87 - protein, 4 aa, synthetic construct
  source 1..4: note = Description of Artificial Sequence: Synthetic peptide
GGSG

SEQ ID NO: 88 - protein, 4 aa, synthetic construct
  source 1..4: note = Description of Artificial Sequence: Synthetic peptide
SGGG

SEQ ID NO: 89 - protein, 4 aa, synthetic construct
  source 1..4: note = Description of Artificial Sequence: Synthetic peptide
GSGS

SEQ ID NO: 90 - protein, 6 aa, synthetic construct
  source 1..6: note = Description of Artificial Sequence: Synthetic peptide
GSGSGS

SEQ ID NO: 91 - protein, 8 aa, synthetic construct
  source 1..8: note = Description of Artificial Sequence: Synthetic peptide
GSGSGSGS

SEQ ID NO: 92 - protein, 10 aa, synthetic construct
  source 1..10: note = Description of Artificial Sequence: Synthetic peptide
GSGSGSGSGS

SEQ ID NO: 93 - protein, 12 aa, synthetic construct
  source 1..12: note = Description of Artificial Sequence: Synthetic peptide
GSGSGSGSGSGS

SEQ ID NO: 94 - protein, 6 aa, synthetic construct
  source 1..6: note = Description of Artificial Sequence: Synthetic peptide
GGSGGS

SEQ ID NO: 95 - protein, 9 aa, synthetic construct
  source 1..9: note = Description of Artificial Sequence: Synthetic peptide
GGSGGSGGS

SEQ ID NO: 96 - protein, 12 aa, synthetic construct
  source 1..12: note = Description of Artificial Sequence: Synthetic peptide
GGSGGSGGSGGS

SEQ ID NO: 97 - protein, 8 aa, synthetic construct
  source 1..8: note = Description of Artificial Sequence: Synthetic peptide
GGSGGGSG

SEQ ID NO: 98 - protein, 12 aa, synthetic construct
  source 1..12: note = Description of Artificial Sequence: Synthetic peptide
GGSGGGSGGGSG

SEQ ID NO: 99 - protein, 16 aa, synthetic construct
  source 1..16: note = Description of Artificial Sequence: Synthetic peptide
GGSGGGSGGGSGGGSG

SEQ ID NO: 100 - protein, 20 aa, synthetic construct
  source 1..20: note = Description of Artificial Sequence: Synthetic peptide
GGSGGGSGGGSGGGSGGGSG

SEQ ID NO: 101 - protein, 10 aa, synthetic construct
  source 1..10: note = Description of Artificial Sequence: Synthetic peptide
GGGGSGGGGS

SEQ ID NO: 102 - protein, 15 aa, synthetic construct
  source 1..15: note = Description of Artificial Sequence: Synthetic peptide
GGGGSGGGGSGGGGS

SEQ ID NO: 103 - protein, 5 aa, synthetic construct
  source 1..5: note = Description of Artificial Sequence: Synthetic peptide
GGSGG

SEQ ID NO: 104 - protein, 5 aa, synthetic construct
  source 1..5: note = Description of Artificial Sequence: Synthetic peptide
GSGSG

SEQ ID NO: 105 - protein, 5 aa, synthetic construct
  source 1..5: note = Description of Artificial Sequence: Synthetic peptide
GSGGG

SEQ ID NO: 106 - protein, 5 aa, synthetic construct
  source 1..5: note = Description of Artificial Sequence: Synthetic peptide
GGGSG

SEQ ID NO: 107 - protein, 5 aa, synthetic construct
  source 1..5: note = Description of Artificial Sequence: Synthetic peptide
GSSSG

SEQ ID NO: 108 - protein, 4 aa, synthetic construct
  source 1..4: note = Description of Artificial Sequence: Synthetic peptide
GGGS

SEQ ID NO: 109 - DNA, 795 bp, synthetic construct
  source 1..795: mol_type = other DNA; note = Description of Artificial Sequence: Synthetic polynucleotide
caggtgcagctgcaggagagcggcggcggcagcgtgcaggccggcggcagcctgaggctgagctgcaccgccagcggcgccatcgccagcggctacatcgacagcaggtggtgcatggcctggttcaggcaggcccccggcaaggagagggagggcgtggccgccatctggcccggcggcggcctgaccgtgtacgccgacagcgtgaagggcaggttcaccatcagcagggaccacgccaagaacaccctgtacctgcagatgaacaacctgaagcccgaggacaccgccatgtactactgcgccgccggcagccccaggatgtgccccagcctggagttcggcttcgactactggggccagggcacccaggtgaccgtctcgagtggcggcggatcccaggtgcagctgcaggagagcggcggcggcctggtgcagcccggcggcagcctgaggctgagctgcgccgccagcggcttcaccttcagcagctaccccatgagctgggtgaggcaggcccccggcaagggcctggagtggatcagcaccatcagcgccggcggcgacaccaccctgtacgccgacagcgtgaagggcaggttcaccagcagcagggacaacgccaagaacaccctgtacctgcagctgaacagcctgaagaccgaggacgccgccatctactactgcgccaagaggatcgactgcaacagcggctactgctacaggaggaactactggggccagggcacccaggtgaccgtgagcgctagccaccaccaccaccaccaccaccac

SEQ ID NO: 110 - DNA, 798 bp, synthetic construct
  source 1..798: mol_type = other DNA; note = Description of Artificial Sequence: Synthetic polynucleotide
caggtgcagctgcaggagagcggcggcggcagcgtgcaggccggcggcagcctgaggctgagctgcaccgccagcggcgccatcgccagcggctacatcgacagcaggtggtgcatggcctggttcaggcaggcccccggcaaggagagggagggcgtggccgccatctggcccggcggcggcctgaccgtgtacgccgacagcgtgaagggcaggttcaccatcagcagggaccacgccaagaacaccctgtacctgcagatgaacaacctgaagcccgaggacaccgccatgtactactgcgccgccggcagccccaggatgtgccccagcctggagttcggcttcgactactggggccagggcacccaggtgaccgtctcgagtggcggcggatcccaggtgcagctgcaggagagcggcggcggcctggtgcagcccggcgagagcctgaggctgagctgcaccgccagcggcttcaccttcagcaactacgccatgagctgggtgaggcaggcccccggcaagggcctggagtgggtgagcggcatcaacgtggcctacggcatcaccagctacgccgacagcgtgaagggcaggttcaccatcagcagggacaacaccaagaacaccctgtacctgcagctgaacagcctgaagaccgaggacaccgccatctactactgcgtgaagcacagcggcaccaccatccccaggggcttcatcagctacaccaagaggggccagggcacccaggtgaccgtgagcgctagccaccaccaccaccaccaccaccac

SEQ ID NO: 111 - DNA, 783 bp, synthetic construct
  source 1..783: mol_type = other DNA; note = Description of Artificial Sequence: Synthetic polynucleotide
caggtgcagctgcaggagagcggcggcggcagcgtgcaggccggcggcagcctgaggctgagctgcaccgccagcggcgccatcgccagcggctacatcgacagcaggtggtgcatggcctggttcaggcaggcccccggcaaggagagggagggcgtggccgccatctggcccggcggcggcctgaccgtgtacgccgacagcgtgaagggcaggttcaccatcagcagggaccacgccaagaacaccctgtacctgcagatgaacaacctgaagcccgaggacaccgccatgtactactgcgccgccggcagccccaggatgtgccccagcctggagttcggcttcgactactggggccagggcacccaggtgaccgtctcgagtggcggcggatcccaggtgcagctgcaggagagcggcggcggcctggtgcagcccggcggcagcctgaggctgagctgcgccgccagcggcttcagcttcagcagctacgccatgaagtgggtgaggcaggcccccggcaagggcctggagtgggtgagcaccatcagcagcggcggcagcagcaccaactacgccgacagcgtgaagggcaggttcaccatcagcagggacaacgccaagaacaccctgtacctgcagctgaacagcctgaagatcgaggacaccgccatgtactactgcgccaaggccatcgtgcccaccggcgccaccatggagaggggccagggcacccaggtgaccgtgagcgctagccaccaccaccaccaccaccaccac

SEQ ID NO: 112 - DNA, 810 bp, synthetic construct
  source 1..810: mol_type = other DNA; note = Description of Artificial Sequence: Synthetic polynucleotide
caggtgcagctgcaggagagcggcggcggcagcgtgcaggccggcggcagcctgaggctgagctgcaccgccagcggcgccatcgccagcggctacatcgacagcaggtggtgcatggcctggttcaggcaggcccccggcaaggagagggagggcgtggccgccatctggcccggcggcggcctgaccgtgtacgccgacagcgtgaagggcaggttcaccatcagcagggaccacgccaagaacaccctgtacctgcagatgaacaacctgaagcccgaggacaccgccatgtactactgcgccgccggcagccccaggatgtgccccagcctggagttcggcttcgactactggggccagggcacccaggtgaccgtctcgagtggcggcggatcccaggtgcagctgcaggagagcggcggcggcagcgtgcagagcggcggcagcctgaggctgagctgcgccgccagcggcttcacctacagcaccagcaacagctggatggcctggttcaggcaggcccccggcaaggagagggagggcgtggccgccatctacaccgtgggcggcagcatcttctacgccgacagcgtgaggggcaggttcaccatcagccaggacgccaccaagaacatgttctacctgcagatgaacaccctgaagcccgaggacaccgccatgtactactgcgccgccgccagcggcaggctgaggggcaagtggttctggccctacgagtacaactactggggccagggcacccaggtgaccgtgagcgctagccaccaccaccaccaccaccaccac

SEQ ID NO: 113 - DNA, 786 bp, synthetic construct
  source 1..786: mol_type = other DNA; note = Description of Artificial Sequence: Synthetic polynucleotide
caggtgcagctgcaggagagcggcggcggcagcgtgcaggccggcggcagcctgaggctgagctgcaccgccagcggcgccatcgccagcggctacatcgacagcaggtggtgcatggcctggttcaggcaggcccccggcaaggagagggagggcgtggccgccatctggcccggcggcggcctgaccgtgtacgccgacagcgtgaagggcaggttcaccatcagcagggaccacgccaagaacaccctgtacctgcagatgaacaacctgaagcccgaggacaccgccatgtactactgcgccgccggcagccccaggatgtgccccagcctggagttcggcttcgactactggggccagggcacccaggtgaccgtctcgagtggcggcggatcccaggtgcagctgcaggagagcggcggcggcagcgtgcaggccggcggcagcctgaggctgagctgcgtggccagcggctacgtgagctgcgactacttcctgcccagctggtacaggcaggcccccggcaaggagagggagttcgtgagcatcatcgacggcaccggcagcaccagctacgccgccagcgtgaagggcaggttcaccgccagccaggacaagggcaagaacatcgcctacctgcagatgaacaccctgaagcccgaggacaccgccatgtactactgcaaggccagctgcgtgaggggcagggccatcagcgagtactggggccagggcacccaggtgaccgtgagcgctagccaccaccaccaccaccaccaccac

SEQ ID NO: 114 - DNA, 813 bp, synthetic construct
  source 1..813: mol_type = other DNA; note = Description of Artificial Sequence: Synthetic polynucleotide
caggtgcagctgcaggagagcggcggcggcagcgtgcaggccggcggcagcctgaggctgagctgcaccgccagcggcgccatcgccagcggctacatcgacagcaggtggtgcatggcctggttcaggcaggcccccggcaaggagagggagggcgtggccgccatctggcccggcggcggcctgaccgtgtacgccgacagcgtgaagggcaggttcaccatcagcagggaccacgccaagaacaccctgtacctgcagatgaacaacctgaagcccgaggacaccgccatgtactactgcgccgccggcagccccaggatgtgccccagcctggagttcggcttcgactactggggccagggcacccaggtgaccgtctcgagtggcggcggatcccaggtgcagctgcaggagagcggcggcggcagcgtgcaggccggcggcagcctgaggctgagctgcagggccagcggcagcacctacagcaactactgcctgggctggttcaggcagatcaccggcaaggagagggagggcgtggccgtgatcaactgggtgggcggcatgctgtacttcgccgacagcgtgaagggcaggttcaccgtgagccaggaccaggccaagaacaccgtgtacctgcagatgaacagcctgaagcccgaggacaccgccatgtactactgcgccgccgagagcgtgagcagcttcagctgcggcggctggctgaccaggcccgacagggtgccctactggggccagggcacccaggtgaccgtgagcgctagccaccaccaccaccaccaccaccac

SEQ ID NO: 115 - DNA, 795 bp, synthetic construct
  source 1..795: mol_type = other DNA; note = Description of Artificial Sequence: Synthetic polynucleotide
caggtgcagctgcaggagagcggcggcggcagcgtgcaggccggcggcagcctgaggctgagctgcaccgccagcggcgccatcgccagcggctacatcgacagcaggtggtgcatggcctggttcaggcaggcccccggcaaggagagggagggcgtggccgccatctggcccggcggcggcctgaccgtgtacgccgacagcgtgaagggcaggttcaccatcagcagggaccacgccaagaacaccctgtacctgcagatgaacaacctgaagcccgaggacaccgccatgtactactgcgccgccggcagccccaggatgtgccccagcctggagttcggcttcgactactggggccagggcacccaggtgaccgtctcgagtggcggcggatcccaggtgcagctgcaggagagcggcggcggcctggtgcagcccggcggcagcctgaggctgagctgcgccgccagcggcttcaccttcagcctgagcagcatgagctgggtgaggcaggcccccggcaagggcctggagtgggtgagcgccatcagcagcggcggcgccagcacctactacaccgacagcgtgaagggcaggttcaccatcagcagggacaacgccaagaacatgctgtacctgcagctgaacagcctgaagaccgaggacaccgccatgtactactgcgccaagggcggcagcggctacggcgacgccagcaggatgaccagccccggcagccagggcacccaggtgaccgtgagcgctagccaccaccaccaccaccaccaccac

SEQ ID NO: 116 - DNA, 777 bp, synthetic construct
  source 1..777: mol_type = other DNA; note = Description of Artificial Sequence: Synthetic polynucleotide
caggtgcagctgcaggagagcggcggcggcagcgtgcaggccggcggcagcctgaggctgagctgcaccgcccccggcttcaccagcaacagctgcggcatggactggtacaggcaggcccccggcaaggagagggagttcgtgagcagcatcagcaccgacggcaccaccggctacgccgacagcgtgaagggcaggttcaccatcagcaaggacaaggccaaggacaccgtgtacctgcagatgaacagcctgaagcccgaggacaccggcatgtacagctgcaagaccaaggacggcaccatcgccaccatggagctgtgcgacttcggctactggggccagggcacccaggtgaccgtctcgagtggcggcggatcccaggtgcagctgcaggagagcggcggcggcctggtgcagcccggcggcagcctgaggctgagctgcgccgccagcggcttcaccttcagcagctaccccatgagctgggtgaggcaggcccccggcaagggcctggagtggatcagcaccatcagcgccggcggcgacaccaccctgtacgccgacagcgtgaagggcaggttcaccagcagcagggacaacgccaagaacaccctgtacctgcagctgaacagcctgaagaccgaggacgccgccatctactactgcgccaagaggatcgactgcaacagcggctactgctacaggaggaactactggggccagggcacccaggtgaccgtgagcgctagccaccaccaccaccaccaccaccac

SEQ ID NO: 117 - DNA, 780 bp, synthetic construct
  source 1..780: mol_type = other DNA; note = Description of Artificial Sequence: Synthetic polynucleotide
caggtgcagctgcaggagagcggcggcggcagcgtgcaggccggcggcagcctgaggctgagctgcaccgcccccggcttcaccagcaacagctgcggcatggactggtacaggcaggcccccggcaaggagagggagttcgtgagcagcatcagcaccgacggcaccaccggctacgccgacagcgtgaagggcaggttcaccatcagcaaggacaaggccaaggacaccgtgtacctgcagatgaacagcctgaagcccgaggacaccggcatgtacagctgcaagaccaaggacggcaccatcgccaccatggagctgtgcgacttcggctactggggccagggcacccaggtgaccgtctcgagtggcggcggatcccaggtgcagctgcaggagagcggcggcggcctggtgcagcccggcgagagcctgaggctgagctgcaccgccagcggcttcaccttcagcaactacgccatgagctgggtgaggcaggcccccggcaagggcctggagtgggtgagcggcatcaacgtggcctacggcatcaccagctacgccgacagcgtgaagggcaggttcaccatcagcagggacaacaccaagaacaccctgtacctgcagctgaacagcctgaagaccgaggacaccgccatctactactgcgtgaagcacagcggcaccaccatccccaggggcttcatcagctacaccaagaggggccagggcacccaggtgaccgtgagcgctagccaccaccaccaccaccaccaccac

SEQ ID NO: 118 - DNA, 765 bp, synthetic construct
  source 1..765: mol_type = other DNA; note = Description of Artificial Sequence: Synthetic polynucleotide
caggtgcagctgcaggagagcggcggcggcagcgtgcaggccggcggcagcctgaggctgagctgcaccgcccccggcttcaccagcaacagctgcggcatggactggtacaggcaggcccccggcaaggagagggagttcgtgagcagcatcagcaccgacggcaccaccggctacgccgacagcgtgaagggcaggttcaccatcagcaaggacaaggccaaggacaccgtgtacctgcagatgaacagcctgaagcccgaggacaccggcatgtacagctgcaagaccaaggacggcaccatcgccaccatggagctgtgcgacttcggctactggggccagggcacccaggtgaccgtctcgagtggcggcggatcccaggtgcagctgcaggagagcggcggcggcctggtgcagcccggcggcagcctgaggctgagctgcgccgccagcggcttcagcttcagcagctacgccatgaagtgggtgaggcaggcccccggcaagggcctggagtgggtgagcaccatcagcagcggcggcagcagcaccaactacgccgacagcgtgaagggcaggttcaccatcagcagggacaacgccaagaacaccctgtacctgcagctgaacagcctgaagatcgaggacaccgccatgtactactgcgccaaggccatcgtgcccaccggcgccaccatggagaggggccagggcacccaggtgaccgtgagcgctagccaccaccaccaccaccaccaccac

SEQ ID NO: 119 - DNA, 792 bp, synthetic construct
  source 1..792: mol_type = other DNA; note = Description of Artificial Sequence: Synthetic polynucleotide
caggtgcagctgcaggagagcggcggcggcagcgtgcaggccggcggcagcctgaggctgagctgcaccgcccccggcttcaccagcaacagctgcggcatggactggtacaggcaggcccccggcaaggagagggagttcgtgagcagcatcagcaccgacggcaccaccggctacgccgacagcgtgaagggcaggttcaccatcagcaaggacaaggccaaggacaccgtgtacctgcagatgaacagcctgaagcccgaggacaccggcatgtacagctgcaagaccaaggacggcaccatcgccaccatggagctgtgcgacttcggctactggggccagggcacccaggtgaccgtctcgagtggcggcggatcccaggtgcagctgcaggagagcggcggcggcagcgtgcagagcggcggcagcctgaggctgagctgcgccgccagcggcttcacctacagcaccagcaacagctggatggcctggttcaggcaggcccccggcaaggagagggagggcgtggccgccatctacaccgtgggcggcagcatcttctacgccgacagcgtgaggggcaggttcaccatcagccaggacgccaccaagaacatgttctacctgcagatgaacaccctgaagcccgaggacaccgccatgtactactgcgccgccgccagcggcaggctgaggggcaagtggttctggccctacgagtacaactactggggccagggcacccaggtgaccgtgagcgctagccaccaccaccaccaccaccaccac

SEQ ID NO: 120 - DNA, 768 bp, synthetic construct
  source 1..768: mol_type = other DNA; note = Description of Artificial Sequence: Synthetic polynucleotide
caggtgcagctgcaggagagcggcggcggcagcgtgcaggccggcggcagcctgaggctgagctgcaccgcccccggcttcaccagcaacagctgcggcatggactggtacaggcaggcccccggcaaggagagggagttcgtgagcagcatcagcaccgacggcaccaccggctacgccgacagcgtgaagggcaggttcaccatcagcaaggacaaggccaaggacaccgtgtacctgcagatgaacagcctgaagcccgaggacaccggcatgtacagctgcaagaccaaggacggcaccatcgccaccatggagctgtgcgacttcggctactggggccagggcacccaggtgaccgtctcgagtggcggcggatcccaggtgcagctgcaggagagcggcggcggcagcgtgcaggccggcggcagcctgaggctgagctgcgtggccagcggctacgtgagctgcgactacttcctgcccagctggtacaggcaggcccccggcaaggagagggagttcgtgagcatcatcgacggcaccggcagcaccagctacgccgccagcgtgaagggcaggttcaccgccagccaggacaagggcaagaacatcgcctacctgcagatgaacaccctgaagcccgaggacaccgccatgtactactgcaaggccagctgcgtgaggggcagggccatcagcgagtactggggccagggcacccaggtgaccgtgagcgctagccaccaccaccaccaccaccaccac

SEQ ID NO: 121 - DNA, 795 bp, synthetic construct
  source 1..795: mol_type = other DNA; note = Description of Artificial Sequence: Synthetic polynucleotide
caggtgcagctgcaggagagcggcggcggcagcgtgcaggccggcggcagcctgaggctgagctgcaccgcccccggcttcaccagcaacagctgcggcatggactggtacaggcaggcccccggcaaggagagggagttcgtgagcagcatcagcaccgacggcaccaccggctacgccgacagcgtgaagggcaggttcaccatcagcaaggacaaggccaaggacaccgtgtacctgcagatgaacagcctgaagcccgaggacaccggcatgtacagctgcaagaccaaggacggcaccatcgccaccatggagctgtgcgacttcggctactggggccagggcacccaggtgaccgtctcgagtggcggcggatcccaggtgcagctgcaggagagcggcggcggcagcgtgcaggccggcggcagcctgaggctgagctgcagggccagcggcagcacctacagcaactactgcctgggctggttcaggcagatcaccggcaaggagagggagggcgtggccgtgatcaactgggtgggcggcatgctgtacttcgccgacagcgtgaagggcaggttcaccgtgagccaggaccaggccaagaacaccgtgtacctgcagatgaacagcctgaagcccgaggacaccgccatgtactactgcgccgccgagagcgtgagcagcttcagctgcggcggctggctgaccaggcccgacagggtgccctactggggccagggcacccaggtgaccgtgagcgctagccaccaccaccaccaccaccaccac

SEQ ID NO: 122 - DNA, 777 bp, synthetic construct
  source 1..777: mol_type = other DNA; note = Description of Artificial Sequence: Synthetic polynucleotide
caggtgcagctgcaggagagcggcggcggcagcgtgcaggccggcggcagcctgaggctgagctgcaccgcccccggcttcaccagcaacagctgcggcatggactggtacaggcaggcccccggcaaggagagggagttcgtgagcagcatcagcaccgacggcaccaccggctacgccgacagcgtgaagggcaggttcaccatcagcaaggacaaggccaaggacaccgtgtacctgcagatgaacagcctgaagcccgaggacaccggcatgtacagctgcaagaccaaggacggcaccatcgccaccatggagctgtgcgacttcggctactggggccagggcacccaggtgaccgtctcgagtggcggcggatcccaggtgcagctgcaggagagcggcggcggcctggtgcagcccggcggcagcctgaggctgagctgcgccgccagcggcttcaccttcagcctgagcagcatgagctgggtgaggcaggcccccggcaagggcctggagtgggtgagcgccatcagcagcggcggcgccagcacctactacaccgacagcgtgaagggcaggttcaccatcagcagggacaacgccaagaacatgctgtacctgcagctgaacagcctgaagaccgaggacaccgccatgtactactgcgccaagggcggcagcggctacggcgacgccagcaggatgaccagccccggcagccagggcacccaggtgaccgtgagcgctagccaccaccaccaccaccaccaccac

SEQ ID NO: 123 - DNA, 792 bp, synthetic construct
  source 1..792: mol_type = other DNA; note = Description of Artificial Sequence: Synthetic polynucleotide
caggtgcagctgcaggagagcggcggcggcagcgtgcaggccggcggcagcctgaggctgagctgcgccgccagcggctacccctacagcaacggctacatgggctggttcaggcaggcccccggcaaggagagggagggcgtggccaccatctacaccggcgacggcaggacctactacgccgacagcgtgaagggcaggttcaccatcagcagggacaacgccaagaacaccgtggacctgcagatgagcagcctgaagcccgaggacaccgccatgtactactgcgccgccagggccgcccccctgtacagcagcggcagccccctgaccagggccaggtacaacgtgtggggccagggcacccaggtgaccgtctcgagtggcggcggatcccaggtgcagctgcaggagagcggcggcggcctggtgcagcccggcggcagcctgaggctgagctgcgccgccagcggcttcaccttcagcagctaccccatgagctgggtgaggcaggcccccggcaagggcctggagtggatcagcaccatcagcgccggcggcgacaccaccctgtacgccgacagcgtgaagggcaggttcaccagcagcagggacaacgccaagaacaccctgtacctgcagctgaacagcctgaagaccgaggacgccgccatctactactgcgccaagaggatcgactgcaacagcggctactgctacaggaggaactactggggccagggcacccaggtgaccgtgagcgctagccaccaccaccaccaccaccaccac

SEQ ID NO: 124 - DNA, 795 bp, synthetic construct
  source 1..795: mol_type = other DNA; note = Description of Artificial Sequence: Synthetic polynucleotide
caggtgcagctgcaggagagcggcggcggcagcgtgcaggccggcggcagcctgaggctgagctgcgccgccagcggctacccctacagcaacggctacatgggctggttcaggcaggcccccggcaaggagagggagggcgtggccaccatctacaccggcgacggcaggacctactacgccgacagcgtgaagggcaggttcaccatcagcagggacaacgccaagaacaccgtggacctgcagatgagcagcctgaagcccgaggacaccgccatgtactactgcgccgccagggccgcccccctgtacagcagcggcagccccctgaccagggccaggtacaacgtgtggggccagggcacccaggtgaccgtctcgagtggcggcggatcccaggtgcagctgcaggagagcggcggcggcctggtgcagcccggcgagagcctgaggctgagctgcaccgccagcggcttcaccttcagcaactacgccatgagctgggtgaggcaggcccccggcaagggcctggagtgggtgagcggcatcaacgtggcctacggcatcaccagctacgccgacagcgtgaagggcaggttcaccatcagcagggacaacaccaagaacaccctgtacctgcagctgaacagcctgaagaccgaggacaccgccatctactactgcgtgaagcacagcggcaccaccatccccaggggcttcatcagctacaccaagaggggccagggcacccaggtgaccgtgagcgctagccaccaccaccaccaccaccaccac

SEQ ID NO: 125 - DNA, 780 bp, synthetic construct
  source 1..780: mol_type = other DNA; note = Description of Artificial Sequence: Synthetic polynucleotide
caggtgcagctgcaggagagcggcggcggcagcgtgcaggccggcggcagcctgaggctgagctgcgccgccagcggctacccctacagcaacggctacatgggctggttcaggcaggcccccggcaaggagagggagggcgtggccaccatctacaccggcgacggcaggacctactacgccgacagcgtgaagggcaggttcaccatcagcagggacaacgccaagaacaccgtggacctgcagatgagcagcctgaagcccgaggacaccgccatgtactactgcgccgccagggccgcccccctgtacagcagcggcagccccctgaccagggccaggtacaacgtgtggggccagggcacccaggtgaccgtctcgagtggcggcggatcccaggtgcagctgcaggagagcggcggcggcctggtgcagcccggcggcagcctgaggctgagctgcgccgccagcggcttcagcttcagcagctacgccatgaagtgggtgaggcaggcccccggcaagggcctggagtgggtgagcaccatcagcagcggcggcagcagcaccaactacgccgacagcgtgaagggcaggttcaccatcagcagggacaacgccaagaacaccctgtacctgcagctgaacagcctgaagatcgaggacaccgccatgtactactgcgccaaggccatcgtgcccaccggcgccaccatggagaggggccagggcacccaggtgaccgtgagcgctagccaccaccaccaccaccaccaccac

SEQ ID NO: 126 - DNA, 807 bp, synthetic construct
  source 1..807: mol_type = other DNA; note = Description of Artificial Sequence: Synthetic polynucleotide
caggtgcagctgcaggagagcggcggcggcagcgtgcaggccggcggcagcctgaggctgagctgcgccgccagcggctacccctacagcaacggctacatgggctggttcaggcaggcccccggcaaggagagggagggcgtggccaccatctacaccggcgacggcaggacctactacgccgacagcgtgaagggcaggttcaccatcagcagggacaacgccaagaacaccgtggacctgcagatgagcagcctgaagcccgaggacaccgccatgtactactgcgccgccagggccgcccccctgtacagcagcggcagccccctgaccagggccaggtacaacgtgtggggccagggcacccaggtgaccgtctcgagtggcggcggatcccaggtgcagctgcaggagagcggcggcggcagcgtgcagagcggcggcagcctgaggctgagctgcgccgccagcggcttcacctacagcaccagcaacagctggatggcctggttcaggcaggcccccggcaaggagagggagggcgtggccgccatctacaccgtgggcggcagcatcttctacgccgacagcgtgaggggcaggttcaccatcagccaggacgccaccaagaacatgttctacctgcagatgaacaccctgaagcccgaggacaccgccatgtactactgcgccgccgccagcggcaggctgaggggcaagtggttctggccctacgagtacaactactggggccagggcacccaggtgaccgtgagcgctagccaccaccaccaccaccaccaccac

SEQ ID NO: 127 - DNA, 783 bp, synthetic construct
  source 1..783: mol_type = other DNA; note = Description of Artificial Sequence: Synthetic polynucleotide
caggtgcagctgcaggagagcggcggcggcagcgtgcaggccggcggcagcctgaggctgagctgcgccgccagcggctacccctacagcaacggctacatgggctggttcaggcaggcccccggcaaggagagggagggcgtggccaccatctacaccggcgacggcaggacctactacgccgacagcgtgaagggcaggttcaccatcagcagggacaacgccaagaacaccgtggacctgcagatgagcagcctgaagcccgaggacaccgccatgtactactgcgccgccagggccgcccccctgtacagcagcggcagccccctgaccagggccaggtacaacgtgtggggccagggcacccaggtgaccgtctcgagtggcggcggatcccaggtgcagctgcaggagagcggcggcggcagcgtgcaggccggcggcagcctgaggctgagctgcgtggccagcggctacgtgagctgcgactacttcctgcccagctggtacaggcaggcccccggcaaggagagggagttcgtgagcatcatcgacggcaccggcagcaccagctacgccgccagcgtgaagggcaggttcaccgccagccaggacaagggcaagaacatcgcctacctgcagatgaacaccctgaagcccgaggacaccgccatgtactactgcaaggccagctgcgtgaggggcagggccatcagcgagtactggggccagggcacccaggtgaccgtgagcgctagccaccaccaccaccaccaccaccac

SEQ ID NO: 128 - DNA, 810 bp, synthetic construct
  source 1..810: mol_type = other DNA; note = Description of Artificial Sequence: Synthetic polynucleotide
caggtgcagctgcaggagagcggcggcggcagcgtgcaggccggcggcagcctgaggctgagctgcgccgccagcggctacccctacagcaacggctacatgggctggttcaggcaggcccccggcaaggagagggagggcgtggccaccatctacaccggcgacggcaggacctactacgccgacagcgtgaagggcaggttcaccatcagcagggacaacgccaagaacaccgtggacctgcagatgagcagcctgaagcccgaggacaccgccatgtactactgcgccgccagggccgcccccctgtacagcagcggcagccccctgaccagggccaggtacaacgtgtggggccagggcacccaggtgaccgtctcgagtggcggcggatcccaggtgcagctgcaggagagcggcggcggcagcgtgcaggccggcggcagcctgaggctgagctgcagggccagcggcagcacctacagcaactactgcctgggctggttcaggcagatcaccggcaaggagagggagggcgtggccgtgatcaactgggtgggcggcatgctgtacttcgccgacagcgtgaagggcaggttcaccgtgagccaggaccaggccaagaacaccgtgtacctgcagatgaacagcctgaagcccgaggacaccgccatgtactactgcgccgccgagagcgtgagcagcttcagctgcggcggctggctgaccaggcccgacagggtgccctactggggccagggcacccaggtgaccgtgagcgctagccaccaccaccaccaccaccaccac

SEQ ID NO: 129 - DNA, 792 bp, synthetic construct
  source 1..792: mol_type = other DNA; note = Description of Artificial Sequence: Synthetic polynucleotide
caggtgcagctgcaggagagcggcggcggcagcgtgcaggccggcggcagcctgaggctgagctgcgccgccagcggctacccctacagcaacggctacatgggctggttcaggcaggcccccggcaaggagagggagggcgtggccaccatctacaccggcgacggcaggacctactacgccgacagcgtgaagggcaggttcaccatcagcagggacaacgccaagaacaccgtggacctgcagatgagcagcctgaagcccgaggacaccgccatgtactactgcgccgccagggccgcccccctgtacagcagcggcagccccctgaccagggccaggtacaacgtgtggggccagggcacccaggtgaccgtctcgagtggcggcggatcccaggtgcagctgcaggagagcggcggcggcctggtgcagcccggcggcagcctgaggctgagctgcgccgccagcggcttcaccttcagcctgagcagcatgagctgggtgaggcaggcccccggcaagggcctggagtgggtgagcgccatcagcagcggcggcgccagcacctactacaccgacagcgtgaagggcaggttcaccatcagcagggacaacgccaagaacatgctgtacctgcagctgaacagcctgaagaccgaggacaccgccatgtactactgcgccaagggcggcagcggctacggcgacgccagcaggatgaccagccccggcagccagggcacccaggtgaccgtgagcgctagccaccaccaccaccaccaccaccac

SEQ ID NO: 130 - DNA, 765 bp, synthetic construct
  source 1..765: mol_type = other DNA; note = Description of Artificial Sequence: Synthetic polynucleotide
caggtgcagctgcaggagagcggcggcggcagcgtgcaggccggcggcagcctgaggctgagctgcgtggccagcgccagcacctactgcacctacgacatgcactggtacaggcaggcccccggcaagggcagggagttcgtgagcgccatcgacagcgacggcaccaccaggtacgccgacagcgtgaagggcaggttcaccatcagccagggcaccgccaagaacaccgtgtacctgcagatgaacagcctgcagcccgaggacaccgccatgtactactgcaagaccgtgtgcgtggtgggcagcaggtggagcgactactggggccagggcacccaggtgaccgtctcgagtggcggcggatcccaggtgcagctgcaggagagcggcggcggcctggtgcagcccggcggcagcctgaggctgagctgcgccgccagcggcttcaccttcagcagctaccccatgagctgggtgaggcaggcccccggcaagggcctggagtggatcagcaccatcagcgccggcggcgacaccaccctgtacgccgacagcgtgaagggcaggttcaccagcagcagggacaacgccaagaacaccctgtacctgcagctgaacagcctgaagaccgaggacgccgccatctactactgcgccaagaggatcgactgcaacagcggctactgctacaggaggaactactggggccagggcacccaggtgaccgtgagcgctagccaccaccaccaccaccaccaccac

SEQ ID NO: 131 - DNA, 768 bp, synthetic construct
  source 1..768: mol_type = other DNA; note = Description of Artificial Sequence: Synthetic polynucleotide
caggtgcagctgcaggagagcggcggcggcagcgtgcaggccggcggcagcctgaggctgagctgcgtggccagcgccagcacctactgcacctacgacatgcactggtacaggcaggcccccggcaagggcagggagttcgtgagcgccatcgacagcgacggcaccaccaggtacgccgacagcgtgaagggcaggttcaccatcagccagggcaccgccaagaacaccgtgtacctgcagatgaacagcctgcagcccgaggacaccgccatgtactactgcaagaccgtgtgcgtggtgggcagcaggtggagcgactactggggccagggcacccaggtgaccgtctcgagtggcggcggatcccaggtgcagctgcaggagagcggcggcggcctggtgcagcccggcgagagcctgaggctgagctgcaccgccagcggcttcaccttcagcaactacgccatgagctgggtgaggcaggcccccggcaagggcctggagtgggtgagcggcatcaacgtggcctacggcatcaccagctacgccgacagcgtgaagggcaggttcaccatcagcagggacaacaccaagaacaccctgtacctgcagctgaacagcctgaagaccgaggacaccgccatctactactgcgtgaagcacagcggcaccaccatccccaggggcttcatcagctacaccaagaggggccagggcacccaggtgaccgtgagcgctagccaccaccaccaccaccaccaccac

SEQ ID NO: 132 - DNA, 753 bp, synthetic construct
  source 1..753: mol_type = other DNA; note = Description of Artificial Sequence: Synthetic polynucleotide
caggtgcagctgcaggagagcggcggcggcagcgtgcaggccggcggcagcctgaggctgagctgcgtggccagcgccagcacctactgcacctacgacatgcactggtacaggcaggcccccggcaagggcagggagttcgtgagcgccatcgacagcgacggcaccaccaggtacgccgacagcgtgaagggcaggttcaccatcagccagggcaccgccaagaacaccgtgtacctgcagatgaacagcctgcagcccgaggacaccgccatgtactactgcaagaccgtgtgcgtggtgggcagcaggtggagcgactactggggccagggcacccaggtgaccgtctcgagtggcggcggatcccaggtgcagctgcaggagagcggcggcggcctggtgcagcccggcggcagcctgaggctgagctgcgccgccagcggcttcagcttcagcagctacgccatgaagtgggtgaggcaggcccccggcaagggcctggagtgggtgagcaccatcagcagcggcggcagcagcaccaactacgccgacagcgtgaagggcaggttcaccatcagcagggacaacgccaagaacaccctgtacctgcagctgaacagcctgaagatcgaggacaccgccatgtactactgcgccaaggccatcgtgcccaccggcgccaccatggagaggggccagggcacccaggtgaccgtgagcgctagccaccaccaccaccaccaccaccac

SEQ ID NO: 133 - DNA, 780 bp, synthetic construct
  source 1..780: mol_type = other DNA; note = Description of Artificial Sequence: Synthetic polynucleotide
caggtgcagctgcaggagagcggcggcggcagcgtgcaggccggcggcagcctgaggctgagctgcgtggccagcgccagcacctactgcacctacgacatgcactggtacaggcaggcccccggcaagggcagggagttcgtgagcgccatcgacagcgacggcaccaccaggtacgccgacagcgtgaagggcaggttcaccatcagccagggcaccgccaagaacaccgtgtacctgcagatgaacagcctgcagcccgaggacaccgccatgtactactgcaagaccgtgtgcgtggtgggcagcaggtggagcgactactggggccagggcacccaggtgaccgtctcgagtggcggcggatcccaggtgcagctgcaggagagcggcggcggcagcgtgcagagcggcggcagcctgaggctgagctgcgccgccagcggcttcacctacagcaccagcaacagctggatggcctggttcaggcaggcccccggcaaggagagggagggcgtggccgccatctacaccgtgggcggcagcatcttctacgccgacagcgtgaggggcaggttcaccatcagccaggacgccaccaagaacatgttctacctgcagatgaacaccctgaagcccgaggacaccgccatgtactactgcgccgccgccagcggcaggctgaggggcaagtggttctggccctacgagtacaactactggggccagggcacccaggtgaccgtgagcgctagccaccaccaccaccaccaccaccac

SEQ ID NO: 134 - DNA, 756 bp, synthetic construct
  source 1..756: mol_type = other DNA; note = Description of Artificial Sequence: Synthetic polynucleotide
caggtgcagctgcaggagagcggcggcggcagcgtgcaggccggcggcagcctgaggctgagctgcgtggccagcgccagcacctactgcacctacgacatgcactggtacaggcaggcccccggcaagggcagggagttcgtgagcgccatcgacagcgacggcaccaccaggtacgccgacagcgtgaagggcaggttcaccatcagccagggcaccgccaagaacaccgtgtacctgcagatgaacagcctgcagcccgaggacaccgccatgtactactgcaagaccgtgtgcgtggtgggcagcaggtggagcgactactggggccagggcacccaggtgaccgtctcgagtggcggcggatcccaggtgcagctgcaggagagcggcggcggcagcgtgcaggccggcggcagcctgaggctgagctgcgtggccagcggctacgtgagctgcgactacttcctgcccagctggtacaggcaggcccccggcaaggagagggagttcgtgagcatcatcgacggcaccggcagcaccagctacgccgccagcgtgaagggcaggttcaccgccagccaggacaagggcaagaacatcgcctacctgcagatgaacaccctgaagcccgaggacaccgccatgtactactgcaaggccagctgcgtgaggggcagggccatcagcgagtactggggccagggcacccaggtgaccgtgagcgctagccaccaccaccaccaccaccaccac

SEQ ID NO: 135 - DNA, 783 bp, synthetic construct
  source 1..783: mol_type = other DNA; note = Description of Artificial Sequence: Synthetic polynucleotide
caggtgcagctgcaggagagcggcggcggcagcgtgcaggccggcggcagcctgaggctgagctgcgtggccagcgccagcacctactgcacctacgacatgcactggtacaggcaggcccccggcaagggcagggagttcgtgagcgccatcgacagcgacggcaccaccaggtacgccgacagcgtgaagggcaggttcaccatcagccagggcaccgccaagaacaccgtgtacctgcagatgaacagcctgcagcccgaggacaccgccatgtactactgcaagaccgtgtgcgtggtgggcagcaggtggagcgactactggggccagggcacccaggtgaccgtctcgagtggcggcggatcccaggtgcagctgcaggagagcggcggcggcagcgtgcaggccggcggcagcctgaggctgagctgcagggccagcggcagcacctacagcaactactgcctgggctggttcaggcagatcaccggcaaggagagggagggcgtggccgtgatcaactgggtgggcggcatgctgtacttcgccgacagcgtgaagggcaggttcaccgtgagccaggaccaggccaagaacaccgtgtacctgcagatgaacagcctgaagcccgaggacaccgccatgtactactgcgccgccgagagcgtgagcagcttcagctgcggcggctggctgaccaggcccgacagggtgccctactggggccagggcacccaggtgaccgtgagcgctagccaccaccaccaccaccaccaccac

SEQ ID NO: 136 - DNA, 765 bp, synthetic construct
  source 1..765: mol_type = other DNA; note = Description of Artificial Sequence: Synthetic polynucleotide
caggtgcagctgcaggagagcggcggcggcagcgtgcaggccggcggcagcctgaggctgagctgcgtggccagcgccagcacctactgcacctacgacatgcactggtacaggcaggcccccggcaagggcagggagttcgtgagcgccatcgacagcgacggcaccaccaggtacgccgacagcgtgaagggcaggttcaccatcagccagggcaccgccaagaacaccgtgtacctgcagatgaacagcctgcagcccgaggacaccgccatgtactactgcaagaccgtgtgcgtggtgggcagcaggtggagcgactactggggccagggcacccaggtgaccgtctcgagtggcggcggatcccaggtgcagctgcaggagagcggcggcggcctggtgcagcccggcggcagcctgaggctgagctgcgccgccagcggcttcaccttcagcctgagcagcatgagctgggtgaggcaggcccccggcaagggcctggagtgggtgagcgccatcagcagcggcggcgccagcacctactacaccgacagcgtgaagggcaggttcaccatcagcagggacaacgccaagaacatgctgtacctgcagctgaacagcctgaagaccgaggacaccgccatgtactactgcgccaagggcggcagcggctacggcgacgccagcaggatgaccagccccggcagccagggcacccaggtgaccgtgagcgctagccaccaccaccaccaccaccaccac

SEQ ID NO: 137 - DNA, 759 bp, synthetic construct
  source 1..759: mol_type = other DNA; note = Description of Artificial Sequence: Synthetic polynucleotide
caggtgcagctgcaggagagcggcggcggcagcgtgcaggccggcggcagcctgaccctgagctgcgccgccagcgagtacgcctacagcacctgcaacatgggctggtacaggcaggcccccggcaaggagagggagctggtgagcgccttcatcagcgacggcagcacctactacgccgacagcgtgaagggcaggttcaccatcaccagggacaacgccaagaacaccgtgtacctgcagatgaacagcctgaagcccgaggacaccgccatctactactgcagcgccaactgctacaggaggctgaggaactactggggccagggcacccaggtgaccgtctcgagtggcggcggatcccaggtgcagctgcaggagagcggcggcggcctggtgcagcccggcggcagcctgaggctgagctgcgccgccagcggcttcaccttcagcagctaccccatgagctgggtgaggcaggcccccggcaagggcctggagtggatcagcaccatcagcgccggcggcgacaccaccctgtacgccgacagcgtgaagggcaggttcaccagcagcagggacaacgccaagaacaccctgtacctgcagctgaacagcctgaagaccgaggacgccgccatctactactgcgccaagaggatcgactgcaacagcggctactgctacaggaggaactactggggccagggcacccaggtgaccgtgagcgctagccaccaccaccaccaccaccaccac

SEQ ID NO: 138 - DNA, 762 bp, synthetic construct
  source 1..762: mol_type = other DNA; note = Description of Artificial Sequence: Synthetic polynucleotide
caggtgcagctgcaggagagcggcggcggcagcgtgcaggccggcggcagcctgaccctgagctgcgccgccagcgagtacgcctacagcacctgcaacatgggctggtacaggcaggcccccggcaaggagagggagctggtgagcgccttcatcagcgacggcagcacctactacgccgacagcgtgaagggcaggttcaccatcaccagggacaacgccaagaacaccgtgtacctgcagatgaacagcctgaagcccgaggacaccgccatctactactgcagcgccaactgctacaggaggctgaggaactactggggccagggcacccaggtgaccgtctcgagtggcggcggatcccaggtgcagctgcaggagagcggcggcggcctggtgcagcccggcgagagcctgaggctgagctgcaccgccagcggcttcaccttcagcaactacgccatgagctgggtgaggcaggcccccggcaagggcctggagtgggtgagcggcatcaacgtggcctacggcatcaccagctacgccgacagcgtgaagggcaggttcaccatcagcagggacaacaccaagaacaccctgtacctgcagctgaacagcctgaagaccgaggacaccgccatctactactgcgtgaagcacagcggcaccaccatccccaggggcttcatcagctacaccaagaggggccagggcacccaggtgaccgtgagcgctagccaccaccaccaccaccaccaccac

SEQ ID NO: 139 - DNA, 747 bp, synthetic construct
  source 1..747: mol_type = other DNA; note = Description of Artificial Sequence: Synthetic polynucleotide
caggtgcagctgcaggagagcggcggcggcagcgtgcaggccggcggcagcctgaccctgagctgcgccgccagcgagtacgcctacagcacctgcaacatgggctggtacaggcaggcccccggcaaggagagggagctggtgagcgccttcatcagcgacggcagcacctactacgccgacagcgtgaagggcaggttcaccatcaccagggacaacgccaagaacaccgtgtacctgcagatgaacagcctgaagcccgaggacaccgccatctactactgcagcgccaactgctacaggaggctgaggaactactggggccagggcacccaggtgaccgtctcgagtggcggcggatcccaggtgcagctgcaggagagcggcggcggcctggtgcagcccggcggcagcctgaggctgagctgcgccgccagcggcttcagcttcagcagctacgccatgaagtgggtgaggcaggcccccggcaagggcctggagtgggtgagcaccatcagcagcggcggcagcagcaccaactacgccgacagcgtgaagggcaggttcaccatcagcagggacaacgccaagaacaccctgtacctgcagctgaacagcctgaagatcgaggacaccgccatgtactactgcgccaaggccatcgtgcccaccggcgccaccatggagaggggccagggcacccaggtgaccgtgagcgctagccaccaccaccaccaccaccaccac

SEQ ID NO: 140 - DNA, 774 bp, synthetic construct
  source 1..774: mol_type = other DNA; note = Description of Artificial Sequence: Synthetic polynucleotide
caggtgcagctgcaggagagcggcggcggcagcgtgcaggccggcggcagcctgaccctgagctgcgccgccagcgagtacgcctacagcacctgcaacatgggctggtacaggcaggcccccggcaaggagagggagctggtgagcgccttcatcagcgacggcagcacctactacgccgacagcgtgaagggcaggttcaccatcaccagggacaacgccaagaacaccgtgtacctgcagatgaacagcctgaagcccgaggacaccgccatctactactgcagcgccaactgctacaggaggctgaggaactactggggccagggcacccaggtgaccgtctcgagtggcggcggatcccaggtgcagctgcaggagagcggcggcggcagcgtgcagagcggcggcagcctgaggctgagctgcgccgccagcggcttcacctacagcaccagcaacagctggatggcctggttcaggcaggcccccggcaaggagagggagggcgtggccgccatctacaccgtgggcggcagcatcttctacgccgacagcgtgaggggcaggttcaccatcagccaggacgccaccaagaacatgttctacctgcagatgaacaccctgaagcccgaggacaccgccatgtactactgcgccgccgccagcggcaggctgaggggcaagtggttctggccctacgagtacaactactggggccagggcacccaggtgaccgtgagcgctagccaccaccaccaccaccaccaccac

SEQ ID NO: 141 - DNA, 750 bp, synthetic construct
  source 1..750: mol_type = other DNA; note = Description of Artificial Sequence: Synthetic polynucleotide
caggtgcagctgcaggagagcggcggcggcagcgtgcaggccggcggcagcctgaccctgagctgcgccgccagcgagtacgcctacagcacctgcaacatgggctggtacaggcaggcccccggcaaggagagggagctggtgagcgccttcatcagcgacggcagcacctactacgccgacagcgtgaagggcaggttcaccatcaccagggacaacgccaagaacaccgtgtacctgcagatgaacagcctgaagcccgaggacaccgccatctactactgcagcgccaactgctacaggaggctgaggaactactggggccagggcacccaggtgaccgtctcgagtggcggcggatcccaggtgcagctgcaggagagcggcggcggcagcgtgcaggccggcggcagcctgaggctgagctgcgtggccagcggctacgtgagctgcgactacttcctgcccagctggtacaggcaggcccccggcaaggagagggagttcgtgagcatcatcgacggcaccggcagcaccagctacgccgccagcgtgaagggcaggttcaccgccagccaggacaagggcaagaacatcgcctacctgcagatgaacaccctgaagcccgaggacaccgccatgtactactgcaaggccagctgcgtgaggggcagggccatcagcgagtactggggccagggcacccaggtgaccgtgagcgctagccaccaccaccaccaccaccaccac

SEQ ID NO: 142 - DNA, 777 bp, synthetic construct
  source 1..777: mol_type = other DNA; note = Description of Artificial Sequence: Synthetic polynucleotide
caggtgcagctgcaggagagcggcggcggcagcgtgcaggccggcggcagcctgaccctgagctgcgccgccagcgagtacgcctacagcacctgcaacatgggctggtacaggcaggcccccggcaaggagagggagctggtgagcgccttcatcagcgacggcagcacctactacgccgacagcgtgaagggcaggttcaccatcaccagggacaacgccaagaacaccgtgtacctgcagatgaacagcctgaagcccgaggacaccgccatctactactgcagcgccaactgctacaggaggctgaggaactactggggccagggcacccaggtgaccgtctcgagtggcggcggatcccaggtgcagctgcaggagagcggcggcggcagcgtgcaggccggcggcagcctgaggctgagctgcagggccagcggcagcacctacagcaactactgcctgggctggttcaggcagatcaccggcaaggagagggagggcgtggccgtgatcaactgggtgggcggcatgctgtacttcgccgacagcgtgaagggcaggttcaccgtgagccaggaccaggccaagaacaccgtgtacctgcagatgaacagcctgaagcccgaggacaccgccatgtactactgcgccgccgagagcgtgagcagcttcagctgcggcggctggctgaccaggcccgacagggtgccctactggggccagggcacccaggtgaccgtgagcgctagccaccaccaccaccaccaccaccac

SEQ ID NO: 143 - DNA, 759 bp, synthetic construct
  source 1..759: mol_type = other DNA; note = Description of Artificial Sequence: Synthetic polynucleotide
caggtgcagctgcaggagagcggcggcggcagcgtgcaggccggcggcagcctgaccctgagctgcgccgccagcgagtacgcctacagcacctgcaacatgggctggtacaggcaggcccccggcaaggagagggagctggtgagcgccttcatcagcgacggcagcacctactacgccgacagcgtgaagggcaggttcaccatcaccagggacaacgccaagaacaccgtgtacctgcagatgaacagcctgaagcccgaggacaccgccatctactactgcagcgccaactgctacaggaggctgaggaactactggggccagggcacccaggtgaccgtctcgagtggcggcggatcccaggtgcagctgcaggagagcggcggcggcctggtgcagcccggcggcagcctgaggctgagctgcgccgccagcggcttcaccttcagcctgagcagcatgagctgggtgaggcaggcccccggcaagggcctggagtgggtgagcgccatcagcagcggcggcgccagcacctactacaccgacagcgtgaagggcaggttcaccatcagcagggacaacgccaagaacatgctgtacctgcagctgaacagcctgaagaccgaggacaccgccatgtactactgcgccaagggcggcagcggctacggcgacgccagcaggatgaccagccccggcagccagggcacccaggtgaccgtgagcgctagccaccaccaccaccaccaccaccac

SEQ ID NO: 144 - DNA, 780 bp, synthetic construct
  source 1..780: mol_type = other DNA; note = Description of Artificial Sequence: Synthetic polynucleotide
caggtgcagctgcaggagagcggcggcggcctggtgcagcccggcggcagcctgaggctgagctgcaccgccagcggcctgaccttcgacgacagcgtgatgggctggttcaggcaggcccccggcaagggcagggaggccgtgagctgcatcagcagcagcggcgccaacgccttctacgccgacagcgtgaagggcaggttcaccatcagcagggacaacgccaagaacaccctgtacctgcagatgaacagcctgaagcccgaggacaccgccacctactactgcaagaggggccacgcctgcgccggctactaccccatcccctacgacgactactggggccagggcacccaggtgaccgtctcgagtggcggcggatcccaggtgcagctgcaggagagcggcggcggcctggtgcagcccggcggcagcctgaggctgagctgcgccgccagcggcttcaccttcagcagctaccccatgagctgggtgaggcaggcccccggcaagggcctggagtggatcagcaccatcagcgccggcggcgacaccaccctgtacgccgacagcgtgaagggcaggttcaccagcagcagggacaacgccaagaacaccctgtacctgcagctgaacagcctgaagaccgaggacgccgccatctactactgcgccaagaggatcgactgcaacagcggctactgctacaggaggaactactggggccagggcacccaggtgaccgtgagcgctagccaccaccaccaccaccaccaccac

SEQ ID NO: 145 - DNA, 783 bp, synthetic construct
  source 1..783: mol_type = other DNA; note = Description of Artificial Sequence: Synthetic polynucleotide
caggtgcagctgcaggagagcggcggcggcctggtgcagcccggcggcagcctgaggctgagctgcaccgccagcggcctgaccttcgacgacagcgtgatgggctggttcaggcaggcccccggcaagggcagggaggccgtgagctgcatcagcagcagcggcgccaacgccttctacgccgacagcgtgaagggcaggttcaccatcagcagggacaacgccaagaacaccctgtacctgcagatgaacagcctgaagcccgaggacaccgccacctactactgcaagaggggccacgcctgcgccggctactaccccatcccctacgacgactactggggccagggcacccaggtgaccgtctcgagtggcggcggatcccaggtgcagctgcaggagagcggcggcggcctggtgcagcccggcgagagcctgaggctgagctgcaccgccagcggcttcaccttcagcaactacgccatgagctgggtgaggcaggcccccggcaagggcctggagtgggtgagcggcatcaacgtggcctacggcatcaccagctacgccgacagcgtgaagggcaggttcaccatcagcagggacaacaccaagaacaccctgtacctgcagctgaacagcctgaagaccgaggacaccgccatctactactgcgtgaagcacagcggcaccaccatccccaggggcttcatcagctacaccaagaggggccagggcacccaggtgaccgtgagcgctagccaccaccaccaccaccaccaccac

SEQ ID NO: 146 - DNA, 768 bp, synthetic construct
  source 1..768: mol_type = other DNA; note = Description of Artificial Sequence: Synthetic polynucleotide
caggtgcagctgcaggagagcggcggcggcctggtgcagcccggcggcagcctgaggctgagctgcaccgccagcggcctgaccttcgacgacagcgtgatgggctggttcaggcaggcccccggcaagggcagggaggccgtgagctgcatcagcagcagcggcgccaacgccttctacgccgacagcgtgaagggcaggttcaccatcagcagggacaacgccaagaacaccctgtacctgcagatgaacagcctgaagcccgaggacaccgccacctactactgcaagaggggccacgcctgcgccggctactaccccatcccctacgacgactactggggccagggcacccaggtgaccgtctcgagtggcggcggatcccaggtgcagctgcaggagagcggcggcggcctggtgcagcccggcggcagcctgaggctgagctgcgccgccagcggcttcagcttcagcagctacgccatgaagtgggtgaggcaggcccccggcaagggcctggagtgggtgagcaccatcagcagcggcggcagcagcaccaactacgccgacagcgtgaagggcaggttcaccatcagcagggacaacgccaagaacaccctgtacctgcagctgaacagcctgaagatcgaggacaccgccatgtactactgcgccaaggccatcgtgcccaccggcgccaccatggagaggggccagggcacccaggtgaccgtgagcgctagccaccaccaccaccaccaccaccac

SEQ ID NO: 147 - DNA, 795 bp, synthetic construct
  source 1..795: mol_type = other DNA; note = Description of Artificial Sequence: Synthetic polynucleotide
caggtgcagctgcaggagagcggcggcggcctggtgcagcccggcggcagcctgaggctgagctgcaccgccagcggcctgaccttcgacgacagcgtgatgggctggttcaggcaggcccccggcaagggcagggaggccgtgagctgcatcagcagcagcggcgccaacgccttctacgccgacagcgtgaagggcaggttcaccatcagcagggacaacgccaagaacaccctgtacctgcagatgaacagcctgaagcccgaggacaccgccacctactactgcaagaggggccacgcctgcgccggctactaccccatcccctacgacgactactggggccagggcacccaggtgaccgtctcgagtggcggcggatcccaggtgcagctgcaggagagcggcggcggcagcgtgcagagcggcggcagcctgaggctgagctgcgccgccagcggcttcacctacagcaccagcaacagctggatggcctggttcaggcaggcccccggcaaggagagggagggcgtggccgccatctacaccgtgggcggcagcatcttctacgccgacagcgtgaggggcaggttcaccatcagccaggacgccaccaagaacatgttctacctgcagatgaacaccctgaagcccgaggacaccgccatgtactactgcgccgccgccagcggcaggctgaggggcaagtggttctggccctacgagtacaactactggggccagggcacccaggtgaccgtgagcgctagccaccaccaccaccaccaccaccac

SEQ ID NO: 148 - DNA, 771 bp, synthetic construct
  source 1..771: mol_type = other DNA; note = Description of Artificial Sequence: Synthetic polynucleotide
caggtgcagctgcaggagagcggcggcggcctggtgcagcccggcggcagcctgaggctgagctgcaccgccagcggcctgaccttcgacgacagcgtgatgggctggttcaggcaggcccccggcaagggcagggaggccgtgagctgcatcagcagcagcggcgccaacgccttctacgccgacagcgtgaagggcaggttcaccatcagcagggacaacgccaagaacaccctgtacctgcagatgaacagcctgaagcccgaggacaccgccacctactactgcaagaggggccacgcctgcgccggctactaccccatcccctacgacgactactggggccagggcacccaggtgaccgtctcgagtggcggcggatcccaggtgcagctgcaggagagcggcggcggcagcgtgcaggccggcggcagcctgaggctgagctgcgtggccagcggctacgtgagctgcgactacttcctgcccagctggtacaggcaggcccccggcaaggagagggagttcgtgagcatcatcgacggcaccggcagcaccagctacgccgccagcgtgaagggcaggttcaccgccagccaggacaagggcaagaacatcgcctacctgcagatgaacaccctgaagcccgaggacaccgccatgtactactgcaaggccagctgcgtgaggggcagggccatcagcgagtactggggccagggcacccaggtgaccgtgagcgctagccaccaccaccaccaccaccaccac

SEQ ID NO: 149 - DNA, 798 bp, synthetic construct
  source 1..798: mol_type = other DNA; note = Description of Artificial Sequence: Synthetic polynucleotide
caggtgcagctgcaggagagcggcggcggcctggtgcagcccggcggcagcctgaggctgagctgcaccgccagcggcctgaccttcgacgacagcgtgatgggctggttcaggcaggcccccggcaagggcagggaggccgtgagctgcatcagcagcagcggcgccaacgccttctacgccgacagcgtgaagggcaggttcaccatcagcagggacaacgccaagaacaccctgtacctgcagatgaacagcctgaagcccgaggacaccgccacctactactgcaagaggggccacgcctgcgccggctactaccccatcccctacgacgactactggggccagggcacccaggtgaccgtctcgagtggcggcggatcccaggtgcagctgcaggagagcggcggcggcagcgtgcaggccggcggcagcctgaggctgagctgcagggccagcggcagcacctacagcaactactgcctgggctggttcaggcagatcaccggcaaggagagggagggcgtggccgtgatcaactgggtgggcggcatgctgtacttcgccgacagcgtgaagggcaggttcaccgtgagccaggaccaggccaagaacaccgtgtacctgcagatgaacagcctgaagcccgaggacaccgccatgtactactgcgccgccgagagcgtgagcagcttcagctgcggcggctggctgaccaggcccgacagggtgccctactggggccagggcacccaggtgaccgtgagcgctagccaccaccaccaccaccaccaccac

SEQ ID NO: 150 - DNA, 780 bp, synthetic construct
  source 1..780: mol_type = other DNA; note = Description of Artificial Sequence: Synthetic polynucleotide
caggtgcagctgcaggagagcggcggcggcctggtgcagcccggcggcagcctgaggctgagctgcaccgccagcggcctgaccttcgacgacagcgtgatgggctggttcaggcaggcccccggcaagggcagggaggccgtgagctgcatcagcagcagcggcgccaacgccttctacgccgacagcgtgaagggcaggttcaccatcagcagggacaacgccaagaacaccctgtacctgcagatgaacagcctgaagcccgaggacaccgccacctactactgcaagaggggccacgcctgcgccggctactaccccatcccctacgacgactactggggccagggcacccaggtgaccgtctcgagtggcggcggatcccaggtgcagctgcaggagagcggcggcggcctggtgcagcccggcggcagcctgaggctgagctgcgccgccagcggcttcaccttcagcctgagcagcatgagctgggtgaggcaggcccccggcaagggcctggagtgggtgagcgccatcagcagcggcggcgccagcacctactacaccgacagcgtgaagggcaggttcaccatcagcagggacaacgccaagaacatgctgtacctgcagctgaacagcctgaagaccgaggacaccgccatgtactactgcgccaagggcggcagcggctacggcgacgccagcaggatgaccagccccggcagccagggcacccaggtgaccgtgagcgctagccaccaccaccaccaccaccaccac

SEQ ID NO: 151 - DNA, 795 bp, synthetic construct
  source 1..795: mol_type = other DNA; note = Description of Artificial Sequence: Synthetic polynucleotide
caggtgcagctgcaggagagcggcggcggcctggtgcagcccggcggcagcctgaggctgagctgcgccgccagcggcttcaccttcagcagctaccccatgagctgggtgaggcaggcccccggcaagggcctggagtggatcagcaccatcagcgccggcggcgacaccaccctgtacgccgacagcgtgaagggcaggttcaccagcagcagggacaacgccaagaacaccctgtacctgcagctgaacagcctgaagaccgaggacgccgccatctactactgcgccaagaggatcgactgcaacagcggctactgctacaggaggaactactggggccagggcacccaggtgaccgtctcgagtggcggcggatcccaggtgcagctgcaggagagcggcggcggcagcgtgcaggccggcggcagcctgaggctgagctgcaccgccagcggcgccatcgccagcggctacatcgacagcaggtggtgcatggcctggttcaggcaggcccccggcaaggagagggagggcgtggccgccatctggcccggcggcggcctgaccgtgtacgccgacagcgtgaagggcaggttcaccatcagcagggaccacgccaagaacaccctgtacctgcagatgaacaacctgaagcccgaggacaccgccatgtactactgcgccgccggcagccccaggatgtgccccagcctggagttcggcttcgactactggggccagggcacccaggtgaccgtgagcgctagccaccaccaccaccaccaccaccac

SEQ ID NO: 152 - DNA, 777 bp, synthetic construct
  source 1..777: mol_type = other DNA; note = Description of Artificial Sequence: Synthetic polynucleotide
caggtgcagctgcaggagagcggcggcggcctggtgcagcccggcggcagcctgaggctgagctgcgccgccagcggcttcaccttcagcagctaccccatgagctgggtgaggcaggcccccggcaagggcctggagtggatcagcaccatcagcgccggcggcgacaccaccctgtacgccgacagcgtgaagggcaggttcaccagcagcagggacaacgccaagaacaccctgtacctgcagctgaacagcctgaagaccgaggacgccgccatctactactgcgccaagaggatcgactgcaacagcggctactgctacaggaggaactactggggccagggcacccaggtgaccgtctcgagtggcggcggatcccaggtgcagctgcaggagagcggcggcggcagcgtgcaggccggcggcagcctgaggctgagctgcaccgcccccggcttcaccagcaacagctgcggcatggactggtacaggcaggcccccggcaaggagagggagttcgtgagcagcatcagcaccgacggcaccaccggctacgccgacagcgtgaagggcaggttcaccatcagcaaggacaaggccaaggacaccgtgtacctgcagatgaacagcctgaagcccgaggacaccggcatgtacagctgcaagaccaaggacggcaccatcgccaccatggagctgtgcgacttcggctactggggccagggcacccaggtgaccgtgagcgctagccaccaccaccaccaccaccaccac

SEQ ID NO: 153 - DNA, 792 bp, synthetic construct
  source 1..792: mol_type = other DNA; note = Description of Artificial Sequence: Synthetic polynucleotide
caggtgcagctgcaggagagcggcggcggcctggtgcagcccggcggcagcctgaggctgagctgcgccgccagcggcttcaccttcagcagctaccccatgagctgggtgaggcaggcccccggcaagggcctggagtggatcagcaccatcagcgccggcggcgacaccaccctgtacgccgacagcgtgaagggcaggttcaccagcagcagggacaacgccaagaacaccctgtacctgcagctgaacagcctgaagaccgaggacgccgccatctactactgcgccaagaggatcgactgcaacagcggctactgctacaggaggaactactggggccagggcacccaggtgaccgtctcgagtggcggcggatcccaggtgcagctgcaggagagcggcggcggcagcgtgcaggccggcggcagcctgaggctgagctgcgccgccagcggctacccctacagcaacggctacatgggctggttcaggcaggcccccggcaaggagagggagggcgtggccaccatctacaccggcgacggcaggacctactacgccgacagcgtgaagggcaggttcaccatcagcagggacaacgccaagaacaccgtggacctgcagatgagcagcctgaagcccgaggacaccgccatgtactactgcgccgccagggccgcccccctgtacagcagcggcagccccctgaccagggccaggtacaacgtgtggggccagggcacccaggtgaccgtgagcgctagccaccaccaccaccaccaccaccac

SEQ ID NO: 154 - DNA, 765 bp, synthetic construct
  source 1..765: mol_type = other DNA; note = Description of Artificial Sequence: Synthetic polynucleotide
caggtgcagctgcaggagagcggcggcggcctggtgcagcccggcggcagcctgaggctgagctgcgccgccagcggcttcaccttcagcagctaccccatgagctgggtgaggcaggcccccggcaagggcctggagtggatcagcaccatcagcgccggcggcgacaccaccctgtacgccgacagcgtgaagggcaggttcaccagcagcagggacaacgccaagaacaccctgtacctgcagctgaacagcctgaagaccgaggacgccgccatctactactgcgccaagaggatcgactgcaacagcggctactgctacaggaggaactactggggccagggcacccaggtgaccgtctcgagtggcggcggatcccaggtgcagctgcaggagagcggcggcggcagcgtgcaggccggcggcagcctgaggctgagctgcgtggccagcgccagcacctactgcacctacgacatgcactggtacaggcaggcccccggcaagggcagggagttcgtgagcgccatcgacagcgacggcaccaccaggtacgccgacagcgtgaagggcaggttcaccatcagccagggcaccgccaagaacaccgtgtacctgcagatgaacagcctgcagcccgaggacaccgccatgtactactgcaagaccgtgtgcgtggtgggcagcaggtggagcgactactggggccagggcacccaggtgaccgtgagcgctagccaccaccaccaccaccaccaccac

SEQ ID NO: 155 - DNA, 759 bp, synthetic construct
  source 1..759: mol_type = other DNA; note = Description of Artificial Sequence: Synthetic polynucleotide
caggtgcagctgcaggagagcggcggcggcctggtgcagcccggcggcagcctgaggctgagctgcgccgccagcggcttcaccttcagcagctaccccatgagctgggtgaggcaggcccccggcaagggcctggagtggatcagcaccatcagcgccggcggcgacaccaccctgtacgccgacagcgtgaagggcaggttcaccagcagcagggacaacgccaagaacaccctgtacctgcagctgaacagcctgaagaccgaggacgccgccatctactactgcgccaagaggatcgactgcaacagcggctactgctacaggaggaactactggggccagggcacccaggtgaccgtctcgagtggcggcggatcccaggtgcagctgcaggagagcggcggcggcagcgtgcaggccggcggcagcctgaccctgagctgcgccgccagcgagtacgcctacagcacctgcaacatgggctggtacaggcaggcccccggcaaggagagggagctggtgagcgccttcatcagcgacggcagcacctactacgccgacagcgtgaagggcaggttcaccatcaccagggacaacgccaagaacaccgtgtacctgcagatgaacagcctgaagcccgaggacaccgccatctactactgcagcgccaactgctacaggaggctgaggaactactggggccagggcacccaggtgaccgtgagcgctagccaccaccaccaccaccaccaccac

SEQ ID NO: 156 - DNA, 780 bp, synthetic construct
  source 1..780: mol_type = other DNA; note = Description of Artificial Sequence: Synthetic polynucleotide
caggtgcagctgcaggagagcggcggcggcctggtgcagcccggcggcagcctgaggctgagctgcgccgccagcggcttcaccttcagcagctaccccatgagctgggtgaggcaggcccccggcaagggcctggagtggatcagcaccatcagcgccggcggcgacaccaccctgtacgccgacagcgtgaagggcaggttcaccagcagcagggacaacgccaagaacaccctgtacctgcagctgaacagcctgaagaccgaggacgccgccatctactactgcgccaagaggatcgactgcaacagcggctactgctacaggaggaactactggggccagggcacccaggtgaccgtctcgagtggcggcggatcccaggtgcagctgcaggagagcggcggcggcctggtgcagcccggcggcagcctgaggctgagctgcaccgccagcggcctgaccttcgacgacagcgtgatgggctggttcaggcaggcccccggcaagggcagggaggccgtgagctgcatcagcagcagcggcgccaacgccttctacgccgacagcgtgaagggcaggttcaccatcagcagggacaacgccaagaacaccctgtacctgcagatgaacagcctgaagcccgaggacaccgccacctactactgcaagaggggccacgcctgcgccggctactaccccatcccctacgacgactactggggccagggcacccaggtgaccgtgagcgctagccaccaccaccaccaccaccaccac

SEQ ID NO: 157 - DNA, 798 bp, synthetic construct
  source 1..798: mol_type = other DNA; note = Description of Artificial Sequence: Synthetic polynucleotide
caggtgcagctgcaggagagcggcggcggcctggtgcagcccggcgagagcctgaggctgagctgcaccgccagcggcttcaccttcagcaactacgccatgagctgggtgaggcaggcccccggcaagggcctggagtgggtgagcggcatcaacgtggcctacggcatcaccagctacgccgacagcgtgaagggcaggttcaccatcagcagggacaacaccaagaacaccctgtacctgcagctgaacagcctgaagaccgaggacaccgccatctactactgcgtgaagcacagcggcaccaccatccccaggggcttcatcagctacaccaagaggggccagggcacccaggtgaccgtctcgagtggcggcggatcccaggtgcagctgcaggagagcggcggcggcagcgtgcaggccggcggcagcctgaggctgagctgcaccgccagcggcgccatcgccagcggctacatcgacagcaggtggtgcatggcctggttcaggcaggcccccggcaaggagagggagggcgtggccgccatctggcccggcggcggcctgaccgtgtacgccgacagcgtgaagggcaggttcaccatcagcagggaccacgccaagaacaccctgtacctgcagatgaacaacctgaagcccgaggacaccgccatgtactactgcgccgccggcagccccaggatgtgccccagcctggagttcggcttcgactactggggccagggcacccaggtgaccgtgagcgctagccaccaccaccaccaccaccaccac

SEQ ID NO: 158 - DNA, 780 bp, synthetic construct
  source 1..780: mol_type = other DNA; note = Description of Artificial Sequence: Synthetic polynucleotide
caggtgcagctgcaggagagcggcggcggcctggtgcagcccggcgagagcctgaggctgagctgcaccgccagcggcttcaccttcagcaactacgccatgagctgggtgaggcaggcccccggcaagggcctggagtgggtgagcggcatcaacgtggcctacggcatcaccagctacgccgacagcgtgaagggcaggttcaccatcagcagggacaacaccaagaacaccctgtacctgcagctgaacagcctgaagaccgaggacaccgccatctactactgcgtgaagcacagcggcaccaccatccccaggggcttcatcagctacaccaagaggggccagggcacccaggtgaccgtctcgagtggcggcggatcccaggtgcagctgcaggagagcggcggcggcagcgtgcaggccggcggcagcctgaggctgagctgcaccgcccccggcttcaccagcaacagctgcggcatggactggtacaggcaggcccccggcaaggagagggagttcgtgagcagcatcagcaccgacggcaccaccggctacgccgacagcgtgaagggcaggttcaccatcagcaaggacaaggccaaggacaccgtgtacctgcagatgaacagcctgaagcccgaggacaccggcatgtacagctgcaagaccaaggacggcaccatcgccaccatggagctgtgcgacttcggctactggggccagggcacccaggtgaccgtgagcgctagccaccaccaccaccaccaccaccac

SEQ ID NO: 159 - DNA, 795 bp, synthetic construct
  source 1..795: mol_type = other DNA; note = Description of Artificial Sequence: Synthetic polynucleotide
caggtgcagctgcaggagagcggcggcggcctggtgcagcccggcgagagcctgaggctgagctgcaccgccagcggcttcaccttcagcaactacgccatgagctgggtgaggcaggcccccggcaagggcctggagtgggtgagcggcatcaacgtggcctacggcatcaccagctacgccgacagcgtgaagggcaggttcaccatcagcagggacaacaccaagaacaccctgtacctgcagctgaacagcctgaagaccgaggacaccgccatctactactgcgtgaagcacagcggcaccaccatccccaggggcttcatcagctacaccaagaggggccagggcacccaggtgaccgtctcgagtggcggcggatcccaggtgcagctgcaggagagcggcggcggcagcgtgcaggccggcggcagcctgaggctgagctgcgccgccagcggctacccctacagcaacggctacatgggctggttcaggcaggcccccggcaaggagagggagggcgtggccaccatctacaccggcgacggcaggacctactacgccgacagcgtgaagggcaggttcaccatcagcagggacaacgccaagaacaccgtggacctgcagatgagcagcctgaagcccgaggacaccgccatgtactactgcgccgccagggccgcccccctgtacagcagcggcagccccctgaccagggccaggtacaacgtgtggggccagggcacccaggtgaccgtgagcgctagccaccaccaccaccaccaccaccac

SEQ ID NO: 160 - DNA, 768 bp, synthetic construct
  source 1..768: mol_type = other DNA; note = Description of Artificial Sequence: Synthetic polynucleotide
caggtgcagctgcaggagagcggcggcggcctggtgcagcccggcgagagcctgaggctgagctgcaccgccagcggcttcaccttcagcaactacgccatgagctgggtgaggcaggcccccggcaagggcctggagtgggtgagcggcatcaacgtggcctacggcatcaccagctacgccgacagcgtgaagggcaggttcaccatcagcagggacaacaccaagaacaccctgtacctgcagctgaacagcctgaagaccgaggacaccgccatctactactgcgtgaagcacagcggcaccaccatccccaggggcttcatcagctacaccaagaggggccagggcacccaggtgaccgtctcgagtggcggcggatcccaggtgcagctgcaggagagcggcggcggcagcgtgcaggccggcggcagcctgaggctgagctgcgtggccagcgccagcacctactgcacctacgacatgcactggtacaggcaggcccccggcaagggcagggagttcgtgagcgccatcgacagcgacggcaccaccaggtacgccgacagcgtgaagggcaggttcaccatcagccagggcaccgccaagaacaccgtgtacctgcagatgaacagcctgcagcccgaggacaccgccatgtactactgcaagaccgtgtgcgtggtgggcagcaggtggagcgactactggggccagggcacccaggtgaccgtgagcgctagccaccaccaccaccaccaccaccac

SEQ ID NO: 161 - DNA, 762 bp, synthetic construct
  source 1..762: mol_type = other DNA; note = Description of Artificial Sequence: Synthetic polynucleotide
caggtgcagctgcaggagagcggcggcggcctggtgcagcccggcgagagcctgaggctgagctgcaccgccagcggcttcaccttcagcaactacgccatgagctgggtgaggcaggcccccggcaagggcctggagtgggtgagcggcatcaacgtggcctacggcatcaccagctacgccgacagcgtgaagggcaggttcaccatcagcagggacaacaccaagaacaccctgtacctgcagctgaacagcctgaagaccgaggacaccgccatctactactgcgtgaagcacagcggcaccaccatccccaggggcttcatcagctacaccaagaggggccagggcacccaggtgaccgtctcgagtggcggcggatcccaggtgcagctgcaggagagcggcggcggcagcgtgcaggccggcggcagcctgaccctgagctgcgccgccagcgagtacgcctacagcacctgcaacatgggctggtacaggcaggcccccggcaaggagagggagctggtgagcgccttcatcagcgacggcagcacctactacgccgacagcgtgaagggcaggttcaccatcaccagggacaacgccaagaacaccgtgtacctgcagatgaacagcctgaagcccgaggacaccgccatctactactgcagcgccaactgctacaggaggctgaggaactactggggccagggcacccaggtgaccgtgagcgctagccaccaccaccaccaccaccaccac

SEQ ID NO: 162 - DNA, 783 bp, synthetic construct
  source 1..783: mol_type = other DNA; note = Description of Artificial Sequence: Synthetic polynucleotide
caggtgcagctgcaggagagcggcggcggcctggtgcagcccggcgagagcctgaggctgagctgcaccgccagcggcttcaccttcagcaactacgccatgagctgggtgaggcaggcccccggcaagggcctggagtgggtgagcggcatcaacgtggcctacggcatcaccagctacgccgacagcgtgaagggcaggttcaccatcagcagggacaacaccaagaacaccctgtacctgcagctgaacagcctgaagaccgaggacaccgccatctactactgcgtgaagcacagcggcaccaccatccccaggggcttcatcagctacaccaagaggggccagggcacccaggtgaccgtctcgagtggcggcggatcccaggtgcagctgcaggagagcggcggcggcctggtgcagcccggcggcagcctgaggctgagctgcaccgccagcggcctgaccttcgacgacagcgtgatgggctggttcaggcaggcccccggcaagggcagggaggccgtgagctgcatcagcagcagcggcgccaacgccttctacgccgacagcgtgaagggcaggttcaccatcagcagggacaacgccaagaacaccctgtacctgcagatgaacagcctgaagcccgaggacaccgccacctactactgcaagaggggccacgcctgcgccggctactaccccatcccctacgacgactactggggccagggcacccaggtgaccgtgagcgctagccaccaccaccaccaccaccaccac

SEQ ID NO: 163 - DNA, 783 bp, synthetic construct
  source 1..783: mol_type = other DNA; note = Description of Artificial Sequence: Synthetic polynucleotide
caggtgcagctgcaggagagcggcggcggcctggtgcagcccggcggcagcctgaggctgagctgcgccgccagcggcttcagcttcagcagctacgccatgaagtgggtgaggcaggcccccggcaagggcctggagtgggtgagcaccatcagcagcggcggcagcagcaccaactacgccgacagcgtgaagggcaggttcaccatcagcagggacaacgccaagaacaccctgtacctgcagctgaacagcctgaagatcgaggacaccgccatgtactactgcgccaaggccatcgtgcccaccggcgccaccatggagaggggccagggcacccaggtgaccgtctcgagtggcggcggatcccaggtgcagctgcaggagagcggcggcggcagcgtgcaggccggcggcagcctgaggctgagctgcaccgccagcggcgccatcgccagcggctacatcgacagcaggtggtgcatggcctggttcaggcaggcccccggcaaggagagggagggcgtggccgccatctggcccggcggcggcctgaccgtgtacgccgacagcgtgaagggcaggttcaccatcagcagggaccacgccaagaacaccctgtacctgcagatgaacaacctgaagcccgaggacaccgccatgtactactgcgccgccggcagccccaggatgtgccccagcctggagttcggcttcgactactggggccagggcacccaggtgaccgtgagcgctagccaccaccaccaccaccaccaccac

SEQ ID NO: 164 - DNA, 765 bp, synthetic construct
  source 1..765: mol_type = other DNA; note = Description of Artificial Sequence: Synthetic polynucleotide
caggtgcagctgcaggagagcggcggcggcctggtgcagcccggcggcagcctgaggctgagctgcgccgccagcggcttcagcttcagcagctacgccatgaagtgggtgaggcaggcccccggcaagggcctggagtgggtgagcaccatcagcagcggcggcagcagcaccaactacgccgacagcgtgaagggcaggttcaccatcagcagggacaacgccaagaacaccctgtacctgcagctgaacagcctgaagatcgaggacaccgccatgtactactgcgccaaggccatcgtgcccaccggcgccaccatggagaggggccagggcacccaggtgaccgtctcgagtggcggcggatcccaggtgcagctgcaggagagcggcggcggcagcgtgcaggccggcggcagcctgaggctgagctgcaccgcccccggcttcaccagcaacagctgcggcatggactggtacaggcaggcccccggcaaggagagggagttcgtgagcagcatcagcaccgacggcaccaccggctacgccgacagcgtgaagggcaggttcaccatcagcaaggacaaggccaaggacaccgtgtacctgcagatgaacagcctgaagcccgaggacaccggcatgtacagctgcaagaccaaggacggcaccatcgccaccatggagctgtgcgacttcggctactggggccagggcacccaggtgaccgtgagcgctagccaccaccaccaccaccaccaccac

SEQ ID NO: 165 - DNA, 780 bp, synthetic construct
  source 1..780: mol_type = other DNA; note = Description of Artificial Sequence: Synthetic polynucleotide
caggtgcagctgcaggagagcggcggcggcctggtgcagcccggcggcagcctgaggctgagctgcgccgccagcggcttcagcttcagcagctacgccatgaagtgggtgaggcaggcccccggcaagggcctggagtgggtgagcaccatcagcagcggcggcagcagcaccaactacgccgacagcgtgaagggcaggttcaccatcagcagggacaacgccaagaacaccctgtacctgcagctgaacagcctgaagatcgaggacaccgccatgtactactgcgccaaggccatcgtgcccaccggcgccaccatggagaggggccagggcacccaggtgaccgtctcgagtggcggcggatcccaggtgcagctgcaggagagcggcggcggcagcgtgcaggccggcggcagcctgaggctgagctgcgccgccagcggctacccctacagcaacggctacatgggctggttcaggcaggcccccggcaaggagagggagggcgtggccaccatctacaccggcgacggcaggacctactacgccgacagcgtgaagggcaggttcaccatcagcagggacaacgccaagaacaccgtggacctgcagatgagcagcctgaagcccgaggacaccgccatgtactactgcgccgccagggccgcccccctgtacagcagcggcagccccctgaccagggccaggtacaacgtgtggggccagggcacccaggtgaccgtgagcgctagccaccaccaccaccaccaccaccac

SEQ ID NO: 166 - DNA, 753 bp, synthetic construct
  source 1..753: mol_type = other DNA; note = Description of Artificial Sequence: Synthetic polynucleotide
caggtgcagctgcaggagagcggcggcggcctggtgcagcccggcggcagcctgaggctgagctgcgccgccagcggcttcagcttcagcagctacgccatgaagtgggtgaggcaggcccccggcaagggcctggagtgggtgagcaccatcagcagcggcggcagcagcaccaactacgccgacagcgtgaagggcaggttcaccatcagcagggacaacgccaagaacaccctgtacctgcagctgaacagcctgaagatcgaggacaccgccatgtactactgcgccaaggccatcgtgcccaccggcgccaccatggagaggggccagggcacccaggtgaccgtctcgagtggcggcggatcccaggtgcagctgcaggagagcggcggcggcagcgtgcaggccggcggcagcctgaggctgagctgcgtggccagcgccagcacctactgcacctacgacatgcactggtacaggcaggcccccggcaagggcagggagttcgtgagcgccatcgacagcgacggcaccaccaggtacgccgacagcgtgaagggcaggttcaccatcagccagggcaccgccaagaacaccgtgtacctgcagatgaacagcctgcagcccgaggacaccgccatgtactactgcaagaccgtgtgcgtggtgggcagcaggtggagcgactactggggccagggcacccaggtgaccgtgagcgctagccaccaccaccaccaccaccaccac

SEQ ID NO: 167 - DNA, 747 bp, synthetic construct
  source 1..747: mol_type = other DNA; note = Description of Artificial Sequence: Synthetic polynucleotide
caggtgcagctgcaggagagcggcggcggcctggtgcagcccggcggcagcctgaggctgagctgcgccgccagcggcttcagcttcagcagctacgccatgaagtgggtgaggcaggcccccggcaagggcctggagtgggtgagcaccatcagcagcggcggcagcagcaccaactacgccgacagcgtgaagggcaggttcaccatcagcagggacaacgccaagaacaccctgtacctgcagctgaacagcctgaagatcgaggacaccgccatgtactactgcgccaaggccatcgtgcccaccggcgccaccatggagaggggccagggcacccaggtgaccgtctcgagtggcggcggatcccaggtgcagctgcaggagagcggcggcggcagcgtgcaggccggcggcagcctgaccctgagctgcgccgccagcgagtacgcctacagcacctgcaacatgggctggtacaggcaggcccccggcaaggagagggagctggtgagcgccttcatcagcgacggcagcacctactacgccgacagcgtgaagggcaggttcaccatcaccagggacaacgccaagaacaccgtgtacctgcagatgaacagcctgaagcccgaggacaccgccatctactactgcagcgccaactgctacaggaggctgaggaactactggggccagggcacccaggtgaccgtgagcgctagccaccaccaccaccaccaccaccac

SEQ ID NO: 168 - DNA, 768 bp, synthetic construct
  source 1..768: mol_type = other DNA; note = Description of Artificial Sequence: Synthetic polynucleotide
caggtgcagctgcaggagagcggcggcggcctggtgcagcccggcggcagcctgaggctgagctgcgccgccagcggcttcagcttcagcagctacgccatgaagtgggtgaggcaggcccccggcaagggcctggagtgggtgagcaccatcagcagcggcggcagcagcaccaactacgccgacagcgtgaagggcaggttcaccatcagcagggacaacgccaagaacaccctgtacctgcagctgaacagcctgaagatcgaggacaccgccatgtactactgcgccaaggccatcgtgcccaccggcgccaccatggagaggggccagggcacccaggtgaccgtctcgagtggcggcggatcccaggtgcagctgcaggagagcggcggcggcctggtgcagcccggcggcagcctgaggctgagctgcaccgccagcggcctgaccttcgacgacagcgtgatgggctggttcaggcaggcccccggcaagggcagggaggccgtgagctgcatcagcagcagcggcgccaacgccttctacgccgacagcgtgaagggcaggttcaccatcagcagggacaacgccaagaacaccctgtacctgcagatgaacagcctgaagcccgaggacaccgccacctactactgcaagaggggccacgcctgcgccggctactaccccatcccctacgacgactactggggccagggcacccaggtgaccgtgagcgctagccaccaccaccaccaccaccaccac

SEQ ID NO: 169 - DNA, 810 bp, synthetic construct
  source 1..810: mol_type = other DNA; note = Description of Artificial Sequence: Synthetic polynucleotide
caggtgcagctgcaggagagcggcggcggcagcgtgcagagcggcggcagcctgaggctgagctgcgccgccagcggcttcacctacagcaccagcaacagctggatggcctggttcaggcaggcccccggcaaggagagggagggcgtggccgccatctacaccgtgggcggcagcatcttctacgccgacagcgtgaggggcaggttcaccatcagccaggacgccaccaagaacatgttctacctgcagatgaacaccctgaagcccgaggacaccgccatgtactactgcgccgccgccagcggcaggctgaggggcaagtggttctggccctacgagtacaactactggggccagggcacccaggtgaccgtctcgagtggcggcggatcccaggtgcagctgcaggagagcggcggcggcagcgtgcaggccggcggcagcctgaggctgagctgcaccgccagcggcgccatcgccagcggctacatcgacagcaggtggtgcatggcctggttcaggcaggcccccggcaaggagagggagggcgtggccgccatctggcccggcggcggcctgaccgtgtacgccgacagcgtgaagggcaggttcaccatcagcagggaccacgccaagaacaccctgtacctgcagatgaacaacctgaagcccgaggacaccgccatgtactactgcgccgccggcagccccaggatgtgccccagcctggagttcggcttcgactactggggccagggcacccaggtgaccgtgagcgctagccaccaccaccaccaccaccaccac

SEQ ID NO: 170 - DNA, 792 bp, synthetic construct
  source 1..792: mol_type = other DNA; note = Description of Artificial Sequence: Synthetic polynucleotide
caggtgcagctgcaggagagcggcggcggcagcgtgcagagcggcggcagcctgaggctgagctgcgccgccagcggcttcacctacagcaccagcaacagctggatggcctggttcaggcaggcccccggcaaggagagggagggcgtggccgccatctacaccgtgggcggcagcatcttctacgccgacagcgtgaggggcaggttcaccatcagccaggacgccaccaagaacatgttctacctgcagatgaacaccctgaagcccgaggacaccgccatgtactactgcgccgccgccagcggcaggctgaggggcaagtggttctggccctacgagtacaactactggggccagggcacccaggtgaccgtctcgagtggcggcggatcccaggtgcagctgcaggagagcggcggcggcagcgtgcaggccggcggcagcctgaggctgagctgcaccgcccccggcttcaccagcaacagctgcggcatggactggtacaggcaggcccccggcaaggagagggagttcgtgagcagcatcagcaccgacggcaccaccggctacgccgacagcgtgaagggcaggttcaccatcagcaaggacaaggccaaggacaccgtgtacctgcagatgaacagcctgaagcccgaggacaccggcatgtacagctgcaagaccaaggacggcaccatcgccaccatggagctgtgcgacttcggctactggggccagggcacccaggtgaccgtgagcgctagccaccaccaccaccaccaccaccac

SEQ ID NO: 171 - DNA, 807 bp, synthetic construct
  source 1..807: mol_type = other DNA; note = Description of Artificial Sequence: Synthetic polynucleotide
caggtgcagctgcaggagagcggcggcggcagcgtgcagagcggcggcagcctgaggctgagctgcgccgccagcggcttcacctacagcaccagcaacagctggatggcctggttcaggcaggcccccggcaaggagagggagggcgtggccgccatctacaccgtgggcggcagcatcttctacgccgacagcgtgaggggcaggttcaccatcagccaggacgccaccaagaacatgttctacctgcagatgaacaccctgaagcccgaggacaccgccatgtactactgcgccgccgccagcggcaggctgaggggcaagtggttctggccctacgagtacaactactggggccagggcacccaggtgaccgtctcgagtggcggcggatcccaggtgcagctgcaggagagcggcggcggcagcgtgcaggccggcggcagcctgaggctgagctgcgccgccagcggctacccctacagcaacggctacatgggctggttcaggcaggcccccggcaaggagagggagggcgtggccaccatctacaccggcgacggcaggacctactacgccgacagcgtgaagggcaggttcaccatcagcagggacaacgccaagaacaccgtggacctgcagatgagcagcctgaagcccgaggacaccgccatgtactactgcgccgccagggccgcccccctgtacagcagcggcagccccctgaccagggccaggtacaacgtgtggggccagggcacccaggtgaccgtgagcgctagccaccaccaccaccaccaccaccac

SEQ ID NO: 172 - DNA, 780 bp, synthetic construct
  source 1..780: mol_type = other DNA; note = Description of Artificial Sequence: Synthetic polynucleotide
caggtgcagctgcaggagagcggcggcggcagcgtgcagagcggcggcagcctgaggctgagctgcgccgccagcggcttcacctacagcaccagcaacagctggatggcctggttcaggcaggcccccggcaaggagagggagggcgtggccgccatctacaccgtgggcggcagcatcttctacgccgacagcgtgaggggcaggttcaccatcagccaggacgccaccaagaacatgttctacctgcagatgaacaccctgaagcccgaggacaccgccatgtactactgcgccgccgccagcggcaggctgaggggcaagtggttctggccctacgagtacaactactggggccagggcacccaggtgaccgtctcgagtggcggcggatcccaggtgcagctgcaggagagcggcggcggcagcgtgcaggccggcggcagcctgaggctgagctgcgtggccagcgccagcacctactgcacctacgacatgcactggtacaggcaggcccccggcaagggcagggagttcgtgagcgccatcgacagcgacggcaccaccaggtacgccgacagcgtgaagggcaggttcaccatcagccagggcaccgccaagaacaccgtgtacctgcagatgaacagcctgcagcccgaggacaccgccatgtactactgcaagaccgtgtgcgtggtgggcagcaggtggagcgactactggggccagggcacccaggtgaccgtgagcgctagccaccaccaccaccaccaccaccac

SEQ ID NO: 173 - DNA, 774 bp, synthetic construct
  source 1..774: mol_type = other DNA; note = Description of Artificial Sequence: Synthetic polynucleotide
caggtgcagctgcaggagagcggcggcggcagcgtgcagagcggcggcagcctgaggctgagctgcgccgccagcggcttcacctacagcaccagcaacagctggatggcctggttcaggcaggcccccggcaaggagagggagggcgtggccgccatctacaccgtgggcggcagcatcttctacgccgacagcgtgaggggcaggttcaccatcagccaggacgccaccaagaacatgttctacctgcagatgaacaccctgaagcccgaggacaccgccatgtactactgcgccgccgccagcggcaggctgaggggcaagtggttctggccctacgagtacaactactggggccagggcacccaggtgaccgtctcgagtggcggcggatcccaggtgcagctgcaggagagcggcggcggcagcgtgcaggccggcggcagcctgaccctgagctgcgccgccagcgagtacgcctacagcacctgcaacatgggctggtacaggcaggcccccggcaaggagagggagctggtgagcgccttcatcagcgacggcagcacctactacgccgacagcgtgaagggcaggttcaccatcaccagggacaacgccaagaacaccgtgtacctgcagatgaacagcctgaagcccgaggacaccgccatctactactgcagcgccaactgctacaggaggctgaggaactactggggccagggcacccaggtgaccgtgagcgctagccaccaccaccaccaccaccaccac

SEQ ID NO: 174 - DNA, 795 bp, synthetic construct
  source 1..795: mol_type = other DNA; note = Description of Artificial Sequence: Synthetic polynucleotide
caggtgcagctgcaggagagcggcggcggcagcgtgcagagcggcggcagcctgaggctgagctgcgccgccagcggcttcacctacagcaccagcaacagctggatggcctggttcaggcaggcccccggcaaggagagggagggcgtggccgccatctacaccgtgggcggcagcatcttctacgccgacagcgtgaggggcaggttcaccatcagccaggacgccaccaagaacatgttctacctgcagatgaacaccctgaagcccgaggacaccgccatgtactactgcgccgccgccagcggcaggctgaggggcaagtggttctggccctacgagtacaactactggggccagggcacccaggtgaccgtctcgagtggcggcggatcccaggtgcagctgcaggagagcggcggcggcctggtgcagcccggcggcagcctgaggctgagctgcaccgccagcggcctgaccttcgacgacagcgtgatgggctggttcaggcaggcccccggcaagggcagggaggccgtgagctgcatcagcagcagcggcgccaacgccttctacgccgacagcgtgaagggcaggttcaccatcagcagggacaacgccaagaacaccctgtacctgcagatgaacagcctgaagcccgaggacaccgccacctactactgcaagaggggccacgcctgcgccggctactaccccatcccctacgacgactactggggccagggcacccaggtgaccgtgagcgctagccaccaccaccaccaccaccaccac

SEQ ID NO: 175 - DNA, 786 bp, synthetic construct
  source 1..786: mol_type = other DNA; note = Description of Artificial Sequence: Synthetic polynucleotide
caggtgcagctgcaggagagcggcggcggcagcgtgcaggccggcggcagcctgaggctgagctgcgtggccagcggctacgtgagctgcgactacttcctgcccagctggtacaggcaggcccccggcaaggagagggagttcgtgagcatcatcgacggcaccggcagcaccagctacgccgccagcgtgaagggcaggttcaccgccagccaggacaagggcaagaacatcgcctacctgcagatgaacaccctgaagcccgaggacaccgccatgtactactgcaaggccagctgcgtgaggggcagggccatcagcgagtactggggccagggcacccaggtgaccgtctcgagtggcggcggatcccaggtgcagctgcaggagagcggcggcggcagcgtgcaggccggcggcagcctgaggctgagctgcaccgccagcggcgccatcgccagcggctacatcgacagcaggtggtgcatggcctggttcaggcaggcccccggcaaggagagggagggcgtggccgccatctggcccggcggcggcctgaccgtgtacgccgacagcgtgaagggcaggttcaccatcagcagggaccacgccaagaacaccctgtacctgcagatgaacaacctgaagcccgaggacaccgccatgtactactgcgccgccggcagccccaggatgtgccccagcctggagttcggcttcgactactggggccagggcacccaggtgaccgtgagcgctagccaccaccaccaccaccaccaccac

SEQ ID NO: 176 - DNA, 768 bp, synthetic construct
  source 1..768: mol_type = other DNA; note = Description of Artificial Sequence: Synthetic polynucleotide
caggtgcagctgcaggagagcggcggcggcagcgtgcaggccggcggcagcctgaggctgagctgcgtggccagcggctacgtgagctgcgactacttcctgcccagctggtacaggcaggcccccggcaaggagagggagttcgtgagcatcatcgacggcaccggcagcaccagctacgccgccagcgtgaagggcaggttcaccgccagccaggacaagggcaagaacatcgcctacctgcagatgaacaccctgaagcccgaggacaccgccatgtactactgcaaggccagctgcgtgaggggcagggccatcagcgagtactggggccagggcacccaggtgaccgtctcgagtggcggcggatcccaggtgcagctgcaggagagcggcggcggcagcgtgcaggccggcggcagcctgaggctgagctgcaccgcccccggcttcaccagcaacagctgcggcatggactggtacaggcaggcccccggcaaggagagggagttcgtgagcagcatcagcaccgacggcaccaccggctacgccgacagcgtgaagggcaggttcaccatcagcaaggacaaggccaaggacaccgtgtacctgcagatgaacagcctgaagcccgaggacaccggcatgtacagctgcaagaccaaggacggcaccatcgccaccatggagctgtgcgacttcggctactggggccagggcacccaggtgaccgtgagcgctagccaccaccaccaccaccaccaccac

SEQ ID NO: 177 - DNA, 783 bp, synthetic construct
  source 1..783: mol_type = other DNA; note = Description of Artificial Sequence: Synthetic polynucleotide
caggtgcagctgcaggagagcggcggcggcagcgtgcaggccggcggcagcctgaggctgagctgcgtggccagcggctacgtgagctgcgactacttcctgcccagctggtacaggcaggcccccggcaaggagagggagttcgtgagcatcatcgacggcaccggcagcaccagctacgccgccagcgtgaagggcaggttcaccgccagccaggacaagggcaagaacatcgcctacctgcagatgaacaccctgaagcccgaggacaccgccatgtactactgcaaggccagctgcgtgaggggcagggccatcagcgagtactggggccagggcacccaggtgaccgtctcgagtggcggcggatcccaggtgcagctgcaggagagcggcggcggcagcgtgcaggccggcggcagcctgaggctgagctgcgccgccagcggctacccctacagcaacggctacatgggctggttcaggcaggcccccggcaaggagagggagggcgtggccaccatctacaccggcgacggcaggacctactacgccgacagcgtgaagggcaggttcaccatcagcagggacaacgccaagaacaccgtggacctgcagatgagcagcctgaagcccgaggacaccgccatgtactactgcgccgccagggccgcccccctgtacagcagcggcagccccctgaccagggccaggtacaacgtgtggggccagggcacccaggtgaccgtgagcgctagccaccaccaccaccaccaccaccac

SEQ ID NO: 178 - DNA, 756 bp, synthetic construct
  source 1..756: mol_type = other DNA; note = Description of Artificial Sequence: Synthetic polynucleotide
caggtgcagctgcaggagagcggcggcggcagcgtgcaggccggcggcagcctgaggctgagctgcgtggccagcggctacgtgagctgcgactacttcctgcccagctggtacaggcaggcccccggcaaggagagggagttcgtgagcatcatcgacggcaccggcagcaccagctacgccgccagcgtgaagggcaggttcaccgccagccaggacaagggcaagaacatcgcctacctgcagatgaacaccctgaagcccgaggacaccgccatgtactactgcaaggccagctgcgtgaggggcagggccatcagcgagtactggggccagggcacccaggtgaccgtctcgagtggcggcggatcccaggtgcagctgcaggagagcggcggcggcagcgtgcaggccggcggcagcctgaggctgagctgcgtggccagcgccagcacctactgcacctacgacatgcactggtacaggcaggcccccggcaagggcagggagttcgtgagcgccatcgacagcgacggcaccaccaggtacgccgacagcgtgaagggcaggttcaccatcagccagggcaccgccaagaacaccgtgtacctgcagatgaacagcctgcagcccgaggacaccgccatgtactactgcaagaccgtgtgcgtggtgggcagcaggtggagcgactactggggccagggcacccaggtgaccgtgagcgctagccaccaccaccaccaccaccaccac

SEQ ID NO: 179 - DNA, 750 bp, synthetic construct
  source 1..750: mol_type = other DNA; note = Description of Artificial Sequence: Synthetic polynucleotide
caggtgcagctgcaggagagcggcggcggcagcgtgcaggccggcggcagcctgaggctgagctgcgtggccagcggctacgtgagctgcgactacttcctgcccagctggtacaggcaggcccccggcaaggagagggagttcgtgagcatcatcgacggcaccggcagcaccagctacgccgccagcgtgaagggcaggttcaccgccagccaggacaagggcaagaacatcgcctacctgcagatgaacaccctgaagcccgaggacaccgccatgtactactgcaaggccagctgcgtgaggggcagggccatcagcgagtactggggccagggcacccaggtgaccgtctcgagtggcggcggatcccaggtgcagctgcaggagagcggcggcggcagcgtgcaggccggcggcagcctgaccctgagctgcgccgccagcgagtacgcctacagcacctgcaacatgggctggtacaggcaggcccccggcaaggagagggagctggtgagcgccttcatcagcgacggcagcacctactacgccgacagcgtgaagggcaggttcaccatcaccagggacaacgccaagaacaccgtgtacctgcagatgaacagcctgaagcccgaggacaccgccatctactactgcagcgccaactgctacaggaggctgaggaactactggggccagggcacccaggtgaccgtgagcgctagccaccaccaccaccaccaccaccac

SEQ ID NO: 180 - DNA, 771 bp, synthetic construct
  source 1..771: mol_type = other DNA; note = Description of Artificial Sequence: Synthetic polynucleotide
caggtgcagctgcaggagagcggcggcggcagcgtgcaggccggcggcagcctgaggctgagctgcgtggccagcggctacgtgagctgcgactacttcctgcccagctggtacaggcaggcccccggcaaggagagggagttcgtgagcatcatcgacggcaccggcagcaccagctacgccgccagcgtgaagggcaggttcaccgccagccaggacaagggcaagaacatcgcctacctgcagatgaacaccctgaagcccgaggacaccgccatgtactactgcaaggccagctgcgtgaggggcagggccatcagcgagtactggggccagggcacccaggtgaccgtctcgagtggcggcggatcccaggtgcagctgcaggagagcggcggcggcctggtgcagcccggcggcagcctgaggctgagctgcaccgccagcggcctgaccttcgacgacagcgtgatgggctggttcaggcaggcccccggcaagggcagggaggccgtgagctgcatcagcagcagcggcgccaacgccttctacgccgacagcgtgaagggcaggttcaccatcagcagggacaacgccaagaacaccctgtacctgcagatgaacagcctgaagcccgaggacaccgccacctactactgcaagaggggccacgcctgcgccggctactaccccatcccctacgacgactactggggccagggcacccaggtgaccgtgagcgctagccaccaccaccaccaccaccaccac

SEQ ID NO: 181 - DNA, 813 bp, synthetic construct
  source 1..813: mol_type = other DNA; note = Description of Artificial Sequence: Synthetic polynucleotide
caggtgcagctgcaggagagcggcggcggcagcgtgcaggccggcggcagcctgaggctgagctgcagggccagcggcagcacctacagcaactactgcctgggctggttcaggcagatcaccggcaaggagagggagggcgtggccgtgatcaactgggtgggcggcatgctgtacttcgccgacagcgtgaagggcaggttcaccgtgagccaggaccaggccaagaacaccgtgtacctgcagatgaacagcctgaagcccgaggacaccgccatgtactactgcgccgccgagagcgtgagcagcttcagctgcggcggctggctgaccaggcccgacagggtgccctactggggccagggcacccaggtgaccgtctcgagtggcggcggatcccaggtgcagctgcaggagagcggcggcggcagcgtgcaggccggcggcagcctgaggctgagctgcaccgccagcggcgccatcgccagcggctacatcgacagcaggtggtgcatggcctggttcaggcaggcccccggcaaggagagggagggcgtggccgccatctggcccggcggcggcctgaccgtgtacgccgacagcgtgaagggcaggttcaccatcagcagggaccacgccaagaacaccctgtacctgcagatgaacaacctgaagcccgaggacaccgccatgtactactgcgccgccggcagccccaggatgtgccccagcctggagttcggcttcgactactggggccagggcacccaggtgaccgtgagcgctagccaccaccaccaccaccaccaccac

SEQ ID NO: 182 - DNA, 795 bp, synthetic construct
  source 1..795: mol_type = other DNA; note = Description of Artificial Sequence: Synthetic polynucleotide
caggtgcagctgcaggagagcggcggcggcagcgtgcaggccggcggcagcctgaggctgagctgcagggccagcggcagcacctacagcaactactgcctgggctggttcaggcagatcaccggcaaggagagggagggcgtggccgtgatcaactgggtgggcggcatgctgtacttcgccgacagcgtgaagggcaggttcaccgtgagccaggaccaggccaagaacaccgtgtacctgcagatgaacagcctgaagcccgaggacaccgccatgtactactgcgccgccgagagcgtgagcagcttcagctgcggcggctggctgaccaggcccgacagggtgccctactggggccagggcacccaggtgaccgtctcgagtggcggcggatcccaggtgcagctgcaggagagcggcggcggcagcgtgcaggccggcggcagcctgaggctgagctgcaccgcccccggcttcaccagcaacagctgcggcatggactggtacaggcaggcccccggcaaggagagggagttcgtgagcagcatcagcaccgacggcaccaccggctacgccgacagcgtgaagggcaggttcaccatcagcaaggacaaggccaaggacaccgtgtacctgcagatgaacagcctgaagcccgaggacaccggcatgtacagctgcaagaccaaggacggcaccatcgccaccatggagctgtgcgacttcggctactggggccagggcacccaggtgaccgtgagcgctagccaccaccaccaccaccaccaccac

SEQ ID NO: 183 - DNA, 810 bp, synthetic construct
  source 1..810: mol_type = other DNA; note = Description of Artificial Sequence: Synthetic polynucleotide
caggtgcagctgcaggagagcggcggcggcagcgtgcaggccggcggcagcctgaggctgagctgcagggccagcggcagcacctacagcaactactgcctgggctggttcaggcagatcaccggcaaggagagggagggcgtggccgtgatcaactgggtgggcggcatgctgtacttcgccgacagcgtgaagggcaggttcaccgtgagccaggaccaggccaagaacaccgtgtacctgcagatgaacagcctgaagcccgaggacaccgccatgtactactgcgccgccgagagcgtgagcagcttcagctgcggcggctggctgaccaggcccgacagggtgccctactggggccagggcacccaggtgaccgtctcgagtggcggcggatcccaggtgcagctgcaggagagcggcggcggcagcgtgcaggccggcggcagcctgaggctgagctgcgccgccagcggctacccctacagcaacggctacatgggctggttcaggcaggcccccggcaaggagagggagggcgtggccaccatctacaccggcgacggcaggacctactacgccgacagcgtgaagggcaggttcaccatcagcagggacaacgccaagaacaccgtggacctgcagatgagcagcctgaagcccgaggacaccgccatgtactactgcgccgccagggccgcccccctgtacagcagcggcagccccctgaccagggccaggtacaacgtgtggggccagggcacccaggtgaccgtgagcgctagccaccaccaccaccaccaccaccac

SEQ ID NO: 184 - DNA, 783 bp, synthetic construct
  source 1..783: mol_type = other DNA; note = Description of Artificial Sequence: Synthetic polynucleotide
caggtgcagctgcaggagagcggcggcggcagcgtgcaggccggcggcagcctgaggctgagctgcagggccagcggcagcacctacagcaactactgcctgggctggttcaggcagatcaccggcaaggagagggagggcgtggccgtgatcaactgggtgggcggcatgctgtacttcgccgacagcgtgaagggcaggttcaccgtgagccaggaccaggccaagaacaccgtgtacctgcagatgaacagcctgaagcccgaggacaccgccatgtactactgcgccgccgagagcgtgagcagcttcagctgcggcggctggctgaccaggcccgacagggtgccctactggggccagggcacccaggtgaccgtctcgagtggcggcggatcccaggtgcagctgcaggagagcggcggcggcagcgtgcaggccggcggcagcctgaggctgagctgcgtggccagcgccagcacctactgcacctacgacatgcactggtacaggcaggcccccggcaagggcagggagttcgtgagcgccatcgacagcgacggcaccaccaggtacgccgacagcgtgaagggcaggttcaccatcagccagggcaccgccaagaacaccgtgtacctgcagatgaacagcctgcagcccgaggacaccgccatgtactactgcaagaccgtgtgcgtggtgggcagcaggtggagcgactactggggccagggcacccaggtgaccgtgagcgctagccaccaccaccaccaccaccaccac

SEQ ID NO: 185 - DNA, 777 bp, synthetic construct
  source 1..777: mol_type = other DNA; note = Description of Artificial Sequence: Synthetic polynucleotide
caggtgcagctgcaggagagcggcggcggcagcgtgcaggccggcggcagcctgaggctgagctgcagggccagcggcagcacctacagcaactactgcctgggctggttcaggcagatcaccggcaaggagagggagggcgtggccgtgatcaactgggtgggcggcatgctgtacttcgccgacagcgtgaagggcaggttcaccgtgagccaggaccaggccaagaacaccgtgtacctgcagatgaacagcctgaagcccgaggacaccgccatgtactactgcgccgccgagagcgtgagcagcttcagctgcggcggctggctgaccaggcccgacagggtgccctactggggccagggcacccaggtgaccgtctcgagtggcggcggatcccaggtgcagctgcaggagagcggcggcggcagcgtgcaggccggcggcagcctgaccctgagctgcgccgccagcgagtacgcctacagcacctgcaacatgggctggtacaggcaggcccccggcaaggagagggagctggtgagcgccttcatcagcgacggcagcacctactacgccgacagcgtgaagggcaggttcaccatcaccagggacaacgccaagaacaccgtgtacctgcagatgaacagcctgaagcccgaggacaccgccatctactactgcagcgccaactgctacaggaggctgaggaactactggggccagggcacccaggtgaccgtgagcgctagccaccaccaccaccaccaccaccac

SEQ ID NO: 186 - DNA, 798 bp, synthetic construct
  source 1..798: mol_type = other DNA; note = Description of Artificial Sequence: Synthetic polynucleotide
caggtgcagctgcaggagagcggcggcggcagcgtgcaggccggcggcagcctgaggctgagctgcagggccagcggcagcacctacagcaactactgcctgggctggttcaggcagatcaccggcaaggagagggagggcgtggccgtgatcaactgggtgggcggcatgctgtacttcgccgacagcgtgaagggcaggttcaccgtgagccaggaccaggccaagaacaccgtgtacctgcagatgaacagcctgaagcccgaggacaccgccatgtactactgcgccgccgagagcgtgagcagcttcagctgcggcggctggctgaccaggcccgacagggtgccctactggggccagggcacccaggtgaccgtctcgagtggcggcggatcccaggtgcagctgcaggagagcggcggcggcctggtgcagcccggcggcagcctgaggctgagctgcaccgccagcggcctgaccttcgacgacagcgtgatgggctggttcaggcaggcccccggcaagggcagggaggccgtgagctgcatcagcagcagcggcgccaacgccttctacgccgacagcgtgaagggcaggttcaccatcagcagggacaacgccaagaacaccctgtacctgcagatgaacagcctgaagcccgaggacaccgccacctactactgcaagaggggccacgcctgcgccggctactaccccatcccctacgacgactactggggccagggcacccaggtgaccgtgagcgctagccaccaccaccaccaccaccaccac

SEQ ID NO: 187 - DNA, 795 bp, synthetic construct
  source 1..795: mol_type = other DNA; note = Description of Artificial Sequence: Synthetic polynucleotide
caggtgcagctgcaggagagcggcggcggcctggtgcagcccggcggcagcctgaggctgagctgcgccgccagcggcttcaccttcagcctgagcagcatgagctgggtgaggcaggcccccggcaagggcctggagtgggtgagcgccatcagcagcggcggcgccagcacctactacaccgacagcgtgaagggcaggttcaccatcagcagggacaacgccaagaacatgctgtacctgcagctgaacagcctgaagaccgaggacaccgccatgtactactgcgccaagggcggcagcggctacggcgacgccagcaggatgaccagccccggcagccagggcacccaggtgaccgtctcgagtggcggcggatcccaggtgcagctgcaggagagcggcggcggcagcgtgcaggccggcggcagcctgaggctgagctgcaccgccagcggcgccatcgccagcggctacatcgacagcaggtggtgcatggcctggttcaggcaggcccccggcaaggagagggagggcgtggccgccatctggcccggcggcggcctgaccgtgtacgccgacagcgtgaagggcaggttcaccatcagcagggaccacgccaagaacaccctgtacctgcagatgaacaacctgaagcccgaggacaccgccatgtactactgcgccgccggcagccccaggatgtgccccagcctggagttcggcttcgactactggggccagggcacccaggtgaccgtgagcgctagccaccaccaccaccaccaccaccac

SEQ ID NO: 188 - DNA, 777 bp, synthetic construct
  source 1..777: mol_type = other DNA; note = Description of Artificial Sequence: Synthetic polynucleotide
caggtgcagctgcaggagagcggcggcggcctggtgcagcccggcggcagcctgaggctgagctgcgccgccagcggcttcaccttcagcctgagcagcatgagctgggtgaggcaggcccccggcaagggcctggagtgggtgagcgccatcagcagcggcggcgccagcacctactacaccgacagcgtgaagggcaggttcaccatcagcagggacaacgccaagaacatgctgtacctgcagctgaacagcctgaagaccgaggacaccgccatgtactactgcgccaagggcggcagcggctacggcgacgccagcaggatgaccagccccggcagccagggcacccaggtgaccgtctcgagtggcggcggatcccaggtgcagctgcaggagagcggcggcggcagcgtgcaggccggcggcagcctgaggctgagctgcaccgcccccggcttcaccagcaacagctgcggcatggactggtacaggcaggcccccggcaaggagagggagttcgtgagcagcatcagcaccgacggcaccaccggctacgccgacagcgtgaagggcaggttcaccatcagcaaggacaaggccaaggacaccgtgtacctgcagatgaacagcctgaagcccgaggacaccggcatgtacagctgcaagaccaaggacggcaccatcgccaccatggagctgtgcgacttcggctactggggccagggcacccaggtgaccgtgagcgctagccaccaccaccaccaccaccaccac

SEQ ID NO: 189 - DNA, 792 bp, synthetic construct
  source 1..792: mol_type = other DNA; note = Description of Artificial Sequence: Synthetic polynucleotide
caggtgcagctgcaggagagcggcggcggcctggtgcagcccggcggcagcctgaggctgagctgcgccgccagcggcttcaccttcagcctgagcagcatgagctgggtgaggcaggcccccggcaagggcctggagtgggtgagcgccatcagcagcggcggcgccagcacctactacaccgacagcgtgaagggcaggttcaccatcagcagggacaacgccaagaacatgctgtacctgcagctgaacagcctgaagaccgaggacaccgccatgtactactgcgccaagggcggcagcggctacggcgacgccagcaggatgaccagccccggcagccagggcacccaggtgaccgtctcgagtggcggcggatcccaggtgcagctgcaggagagcggcggcggcagcgtgcaggccggcggcagcctgaggctgagctgcgccgccagcggctacccctacagcaacggctacatgggctggttcaggcaggcccccggcaaggagagggagggcgtggccaccatctacaccggcgacggcaggacctactacgccgacagcgtgaagggcaggttcaccatcagcagggacaacgccaagaacaccgtggacctgcagatgagcagcctgaagcccgaggacaccgccatgtactactgcgccgccagggccgcccccctgtacagcagcggcagccccctgaccagggccaggtacaacgtgtggggccagggcacccaggtgaccgtgagcgctagccaccaccaccaccaccaccaccac

SEQ ID NO: 190 - DNA, 765 bp, synthetic construct
  source 1..765: mol_type = other DNA; note = Description of Artificial Sequence: Synthetic polynucleotide
caggtgcagctgcaggagagcggcggcggcctggtgcagcccggcggcagcctgaggctgagctgcgccgccagcggcttcaccttcagcctgagcagcatgagctgggtgaggcaggcccccggcaagggcctggagtgggtgagcgccatcagcagcggcggcgccagcacctactacaccgacagcgtgaagggcaggttcaccatcagcagggacaacgccaagaacatgctgtacctgcagctgaacagcctgaagaccgaggacaccgccatgtactactgcgccaagggcggcagcggctacggcgacgccagcaggatgaccagccccggcagccagggcacccaggtgaccgtctcgagtggcggcggatcccaggtgcagctgcaggagagcggcggcggcagcgtgcaggccggcggcagcctgaggctgagctgcgtggccagcgccagcacctactgcacctacgacatgcactggtacaggcaggcccccggcaagggcagggagttcgtgagcgccatcgacagcgacggcaccaccaggtacgccgacagcgtgaagggcaggttcaccatcagccagggcaccgccaagaacaccgtgtacctgcagatgaacagcctgcagcccgaggacaccgccatgtactactgcaagaccgtgtgcgtggtgggcagcaggtggagcgactactggggccagggcacccaggtgaccgtgagcgctagccaccaccaccaccaccaccaccac

SEQ ID NO: 191 - DNA, 759 bp, synthetic construct
  source 1..759: mol_type = other DNA; note = Description of Artificial Sequence: Synthetic polynucleotide
caggtgcagctgcaggagagcggcggcggcctggtgcagcccggcggcagcctgaggctgagctgcgccgccagcggcttcaccttcagcctgagcagcatgagctgggtgaggcaggcccccggcaagggcctggagtgggtgagcgccatcagcagcggcggcgccagcacctactacaccgacagcgtgaagggcaggttcaccatcagcagggacaacgccaagaacatgctgtacctgcagctgaacagcctgaagaccgaggacaccgccatgtactactgcgccaagggcggcagcggctacggcgacgccagcaggatgaccagccccggcagccagggcacccaggtgaccgtctcgagtggcggcggatcccaggtgcagctgcaggagagcggcggcggcagcgtgcaggccggcggcagcctgaccctgagctgcgccgccagcgagtacgcctacagcacctgcaacatgggctggtacaggcaggcccccggcaaggagagggagctggtgagcgccttcatcagcgacggcagcacctactacgccgacagcgtgaagggcaggttcaccatcaccagggacaacgccaagaacaccgtgtacctgcagatgaacagcctgaagcccgaggacaccgccatctactactgcagcgccaactgctacaggaggctgaggaactactggggccagggcacccaggtgaccgtgagcgctagccaccaccaccaccaccaccaccac

SEQ ID NO: 192 - DNA, 780 bp, synthetic construct
  source 1..780: mol_type = other DNA; note = Description of Artificial Sequence: Synthetic polynucleotide
caggtgcagctgcaggagagcggcggcggcctggtgcagcccggcggcagcctgaggctgagctgcgccgccagcggcttcaccttcagcctgagcagcatgagctgggtgaggcaggcccccggcaagggcctggagtgggtgagcgccatcagcagcggcggcgccagcacctactacaccgacagcgtgaagggcaggttcaccatcagcagggacaacgccaagaacatgctgtacctgcagctgaacagcctgaagaccgaggacaccgccatgtactactgcgccaagggcggcagcggctacggcgacgccagcaggatgaccagccccggcagccagggcacccaggtgaccgtctcgagtggcggcggatcccaggtgcagctgcaggagagcggcggcggcctggtgcagcccggcggcagcctgaggctgagctgcaccgccagcggcctgaccttcgacgacagcgtgatgggctggttcaggcaggcccccggcaagggcagggaggccgtgagctgcatcagcagcagcggcgccaacgccttctacgccgacagcgtgaagggcaggttcaccatcagcagggacaacgccaagaacaccctgtacctgcagatgaacagcctgaagcccgaggacaccgccacctactactgcaagaggggccacgcctgcgccggctactaccccatcccctacgacgactactggggccagggcacccaggtgaccgtgagcgctagccaccaccaccaccaccaccaccac

SEQ ID NO: 193 - protein, 10 aa, synthetic construct
  source 1..10: note = Description of Artificial Sequence: Synthetic peptide
AIASGYIDSR

SEQ ID NO: 194 - protein, 9 aa, synthetic construct
  source 1..9: note = Description of Artificial Sequence: Synthetic peptide
FTSNSCGMD

SEQ ID NO: 195 - protein, 9 aa, synthetic construct
  source 1..9: note = Description of Artificial Sequence: Synthetic peptide
YPYSNGYMG

SEQ ID NO: 196 - protein, 9 aa, synthetic construct
  source 1..9: note = Description of Artificial Sequence: Synthetic peptide
STYCTYDMH

SEQ ID NO: 197 - protein, 9 aa, synthetic construct
  source 1..9: note = Description of Artificial Sequence: Synthetic peptide
YAYSTCNMG

SEQ ID NO: 198 - protein, 9 aa, synthetic construct
  source 1..9: note = Description of Artificial Sequence: Synthetic peptide
LTFDDSVMG

SEQ ID NO: 199 - protein, 17 aa, synthetic construct
  source 1..17: note = Description of Artificial Sequence: Synthetic peptide
AIWPGGGLTVYADSVKG

SEQ ID NO: 200 - protein, 16 aa, synthetic construct
  source 1..16: note = Description of Artificial Sequence: Synthetic peptide
SISTDGTTGYADSVKG

SEQ ID NO: 201 - protein, 17 aa, synthetic construct
  source 1..17: note = Description of Artificial Sequence: Synthetic peptide
TIYTGDGRTYYADSVKG

SEQ ID NO: 202 - protein, 16 aa, synthetic construct
  source 1..16: note = Description of Artificial Sequence: Synthetic peptide
AIDSDGTTRYADSVKG

SEQ ID NO: 203 - protein, 16 aa, synthetic construct
  source 1..16: note = Description of Artificial Sequence: Synthetic peptide
AFISDGSTYYADSVKG

SEQ ID NO: 204 - protein, 17 aa, synthetic construct
  source 1..17: note = Description of Artificial Sequence: Synthetic peptide
CISSSGANAFYADSVKG

SEQ ID NO: 205 - protein, 15 aa, synthetic construct
  source 1..15: note = Description of Artificial Sequence: Synthetic peptide
GSPRMCPSLEFGFDY

SEQ ID NO: 206 - protein, 15 aa, synthetic construct
  source 1..15: note = Description of Artificial Sequence: Synthetic peptide
KDGTIATMELCDFGY

SEQ ID NO: 207 - protein, 19 aa, synthetic construct
  source 1..19: note = Description of Artificial Sequence: Synthetic peptide
RAAPLYSSGSPLTRARYNV

SEQ ID NO: 208 - protein, 7 aa, synthetic construct
  source 1..7: note = Description of Artificial Sequence: Synthetic peptide
GSRWSDY

SEQ ID NO: 209 - protein, 9 aa, synthetic construct
  source 1..9: note = Description of Artificial Sequence: Synthetic peptide
NCYRRLRNY

SEQ ID NO: 210 - protein, 15 aa, synthetic construct
  source 1..15: note = Description of Artificial Sequence: Synthetic peptide
GHACAGYYPIPYDDY

SEQ ID NO: 211 - protein, 9 aa, synthetic construct
  source 1..9: note = Description of Artificial Sequence: Synthetic peptide
FTFSSYPMS

SEQ ID NO: 212 - protein, 9 aa, synthetic construct
  source 1..9: note = Description of Artificial Sequence: Synthetic peptide
FTFSNYAMS

SEQ ID NO: 213 - protein, 9 aa, synthetic construct
  source 1..9: note = Description of Artificial Sequence: Synthetic peptide
FSFSSYAMK

SEQ ID NO: 214 - protein, 11 aa, synthetic construct
  source 1..11: note = Description of Artificial Sequence: Synthetic peptide
FTYSTSNSWMA

SEQ ID NO: 215 - protein, 10 aa, synthetic construct
  source 1..10: note = Description of Artificial Sequence: Synthetic peptide
YVSCDYFLPS

SEQ ID NO: 216 - protein, 9 aa, synthetic construct
  source 1..9: note = Description of Artificial Sequence: Synthetic peptide
STYSNYCLG

SEQ ID NO: 217 - protein, 9 aa, synthetic construct
  source 1..9: note = Description of Artificial Sequence: Synthetic peptide
FTFSLSSMS

SEQ ID NO: 218 - protein, 17 aa, synthetic construct
  source 1..17: note = Description of Artificial Sequence: Synthetic peptide
TISAGGDTTLYADSVKG

SEQ ID NO: 219 - protein, 17 aa, synthetic construct
  source 1..17: note = Description of Artificial Sequence: Synthetic peptide
GINVAYGITSYADSVKG

SEQ ID NO: 220 - protein, 17 aa, synthetic construct
  source 1..17: note = Description of Artificial Sequence: Synthetic peptide
TISSGGSSTNYADSVKG

SEQ ID NO: 221 - protein, 17 aa, synthetic construct
  source 1..17: note = Description of Artificial Sequence: Synthetic peptide
AIYTVGGSIFYADSVRG

SEQ ID NO: 222 - protein, 16 aa, synthetic construct
  source 1..16: note = Description of Artificial Sequence: Synthetic peptide
IIDGTGSTSYAASVKG

SEQ ID NO: 223 - protein, 17 aa, synthetic construct
  source 1..17: note = Description of Artificial Sequence: Synthetic peptide
VINWVGGMLYFADSVKG

SEQ ID NO: 224 - protein, 17 aa, synthetic construct
  source 1..17: note = Description of Artificial Sequence: Synthetic peptide
AISSGGASTYYTDSVKG

SEQ ID NO: 225 - protein, 8 aa, synthetic construct
  source 1..8: note = Description of Artificial Sequence: Synthetic peptide
GYCYRRNY

SEQ ID NO: 226 - protein, 15 aa, synthetic construct
  source 1..15: note = Description of Artificial Sequence: Synthetic peptide
HSGTTIPRGFISYTK

SEQ ID NO: 227 - protein, 10 aa, synthetic construct
  source 1..10: note = Description of Artificial Sequence: Synthetic peptide
AIVPTGATME

SEQ ID NO: 228 - protein, 17 aa, synthetic construct
  source 1..17: note = Description of Artificial Sequence: Synthetic peptide
ASGRLRGKWFWPYEYNY

SEQ ID NO: 229 - protein, 11 aa, synthetic construct
  source 1..11: note = Description of Artificial Sequence: Synthetic peptide
SCVRGRAISEY

SEQ ID NO: 230 - protein, 20 aa, synthetic construct
  source 1..20: note = Description of Artificial Sequence: Synthetic peptide
ESVSSFSCGGWLTRPDRVPY

SEQ ID NO: 231 - protein, 14 aa, synthetic construct
  source 1..14: note = Description of Artificial Sequence: Synthetic peptide
GGSGYGDASRMTSP

SEQ ID NO: 232 - protein, 129 aa, synthetic construct
  source 1..129: note = Description of Artificial Sequence: Synthetic polypeptide
QVQLQESGGGSVQAGGSLRLSCTASGAIASGYIDSRWCMAWFRQAPGKEREGVAAIWPGGGLTVYADSVKGRFTISRDHAKNTLYLQMNNLKPEDTAMYYCAAGSPRMCPSLEFGFDYWGQGTQVTVSS

SEQ ID NO: 233 - protein, 123 aa, synthetic construct
  source 1..123: note = Description of Artificial Sequence: Synthetic polypeptide
QVQLQESGGGSVQAGGSLRLSCTAPGFTSNSCGMDWYRQAPGKEREFVSSISTDGTTGYADSVKGRFTISKDKAKDTVYLQMNSLKPEDTGMYSCKTKDGTIATMELCDFGYWGQGTQVTVSS

SEQ ID NO: 234 - protein, 128 aa, synthetic construct
  source 1..128: note = Description of Artificial Sequence: Synthetic polypeptide
QVQLQESGGGSVQAGGSLRLSCAASGYPYSNGYMGWFRQAPGKEREGVATIYTGDGRTYYADSVKGRFTISRDNAKNTVDLQMSSLKPEDTAMYYCAARAAPLYSSGSPLTRARYNVWGQGTQVTVSS

SEQ ID NO: 235 - protein, 119 aa, synthetic construct
  source 1..119: note = Description of Artificial Sequence: Synthetic polypeptide
QVQLQESGGGSVQAGGSLRLSCVASASTYCTYDMHWYRQAPGKGREFVSAIDSDGTTRYADSVKGRFTISQGTAKNTVYLQMNSLQPEDTAMYYCKTVCVVGSRWSDYWGQGTQVTVSS

SEQ ID NO: 236 - protein, 117 aa, synthetic construct
  source 1..117: note = Description of Artificial Sequence: Synthetic polypeptide
QVQLQESGGGSVQAGGSLTLSCAASEYAYSTCNMGWYRQAPGKERELVSAFISDGSTYYADSVKGRFTITRDNAKNTVYLQMNSLKPEDTAIYYCSANCYRRLRNYWGQGTQVTVSS

SEQ ID NO: 237 - protein, 124 aa, synthetic construct
  source 1..124: note = Description of Artificial Sequence: Synthetic polypeptide
QVQLQESGGGLVQPGGSLRLSCTASGLTFDDSVMGWFRQAPGKGREAVSCISSSGANAFYADSVKGRFTISRDNAKNTLYLQMNSLKPEDTATYYCKRGHACAGYYPIPYDDYWGQGTQVTVSS

SEQ ID NO: 238 - protein, 122 aa, synthetic construct
  source 1..122: note = Description of Artificial Sequence: Synthetic polypeptide
QVQLQESGGGLVQPGGSLRLSCAASGFTFSSYPMSWVRQAPGKGLEWISTISAGGDTTLYADSVKGRFTSSRDNAKNTLYLQLNSLKTEDAAIYYCAKRIDCNSGYCYRRNYWGQGTQVTVS

SEQ ID NO: 239 - protein, 123 aa, synthetic construct
  source 1..123: note = Description of Artificial Sequence: Synthetic polypeptide
QVQLQESGGGLVQPGESLRLSCTASGFTFSNYAMSWVRQAPGKGLEWVSGINVAYGITSYADSVKGRFTISRDNTKNTLYLQLNSLKTEDTAIYYCVKHSGTTIPRGFISYTKRGQGTQVTVS

SEQ ID NO: 240 - protein, 118 aa, synthetic construct
  source 1..118: note = Description of Artificial Sequence: Synthetic polypeptide
QVQLQESGGGLVQPGGSLRLSCAASGFSFSSYAMKWVRQAPGKGLEWVSTISSGGSSTNYADSVKGRFTISRDNAKNTLYLQLNSLKIEDTAMYYCAKAIVPTGATMERGQGTQVTVS

SEQ ID NO: 241 - protein, 127 aa, synthetic construct
  source 1..127: note = Description of Artificial Sequence: Synthetic polypeptide
QVQLQESGGGSVQSGGSLRLSCAASGFTYSTSNSWMAWFRQAPGKEREGVAAIYTVGGSIFYADSVRGRFTISQDATKNMFYLQMNTLKPEDTAMYYCAAASGRLRGKWFWPYEYNYWGQGTQVTVS

SEQ ID NO: 242 - protein, 119 aa, synthetic construct
  source 1..119: note = Description of Artificial Sequence: Synthetic polypeptide
QVQLQESGGGSVQAGGSLRLSCVASGYVSCDYFLPSWYRQAPGKEREFVSIIDGTGSTSYAASVKGRFTASQDKGKNIAYLQMNTLKPEDTAMYYCKASCVRGRAISEYWGQGTQVTVS

SEQ ID NO: 243 - protein, 128 aa, synthetic construct
  source 1..128: note = Description of Artificial Sequence: Synthetic polypeptide
QVQLQESGGGSVQAGGSLRLSCRASGSTYSNYCLGWFRQITGKEREGVAVINWVGGMLYFADSVKGRFTVSQDQAKNTVYLQMNSLKPEDTAMYYCAAESVSSFSCGGWLTRPDRVPYWGQGTQVTVS

SEQ ID NO: 244 - protein, 122 aa, synthetic construct
  source 1..122: note = Description of Artificial Sequence: Synthetic polypeptide
QVQLQESGGGLVQPGGSLRLSCAASGFTFSLSSMSWVRQAPGKGLEWVSAISSGGASTYYTDSVKGRFTISRDNAKNMLYLQLNSLKTEDTAMYYCAKGGSGYGDASRMTSPGSQGTQVTVS

SEQ ID NO: 245 - protein, 123 aa, synthetic construct
  source 1..123: note = Description of Artificial Sequence: Synthetic polypeptide
QVQLQESGGGLVQPGGSLRLSCAASGFTFSSYPMSWVRQAPGKGLEWISTISAGGDTTLYADSVKGRFTSSRDNAKNTLYLQLNSLKTEDAAIYYCAKRIDCNSGYCYRRNYWGQGTQVTVSS

SEQ ID NO: 246 - protein, 124 aa, synthetic construct
  source 1..124: note = Description of Artificial Sequence: Synthetic polypeptide
QVQLQESGGGLVQPGESLRLSCTASGFTFSNYAMSWVRQAPGKGLEWVSGINVAYGITSYADSVKGRFTISRDNTKNTLYLQLNSLKTEDTAIYYCVKHSGTTIPRGFISYTKRGQGTQVTVSS

SEQ ID NO: 247 - protein, 119 aa, synthetic construct
  source 1..119: note = Description of Artificial Sequence: Synthetic polypeptide
QVQLQESGGGLVQPGGSLRLSCAASGFSFSSYAMKWVRQAPGKGLEWVSTISSGGSSTNYADSVKGRFTISRDNAKNTLYLQLNSLKIEDTAMYYCAKAIVPTGATMERGQGTQVTVSS

SEQ ID NO: 248 - protein, 128 aa, synthetic construct
  source 1..128: note = Description of Artificial Sequence: Synthetic polypeptide
QVQLQESGGGSVQSGGSLRLSCAASGFTYSTSNSWMAWFRQAPGKEREGVAAIYTVGGSIFYADSVRGRFTISQDATKNMFYLQMNTLKPEDTAMYYCAAASGRLRGKWFWPYEYNYWGQGTQVTVSS

SEQ ID NO: 249 - protein, 120 aa, synthetic construct
  source 1..120: note = Description of Artificial Sequence: Synthetic polypeptide
QVQLQESGGGSVQAGGSLRLSCVASGYVSCDYFLPSWYRQAPGKEREFVSIIDGTGSTSYAASVKGRFTASQDKGKNIAYLQMNTLKPEDTAMYYCKASCVRGRAISEYWGQGTQVTVSS

SEQ ID NO: 250 - protein, 129 aa, synthetic construct
  source 1..129: note = Description of Artificial Sequence: Synthetic polypeptide
QVQLQESGGGSVQAGGSLRLSCRASGSTYSNYCLGWFRQITGKEREGVAVINWVGGMLYFADSVKGRFTVSQDQAKNTVYLQMNSLKPEDTAMYYCAAESVSSFSCGGWLTRPDRVPYWGQGTQVTVSS

SEQ ID NO: 251 - protein, 123 aa, synthetic construct
  source 1..123: note = Description of Artificial Sequence: Synthetic polypeptide
QVQLQESGGGLVQPGGSLRLSCAASGFTFSLSSMSWVRQAPGKGLEWVSAISSGGASTYYTDSVKGRFTISRDNAKNMLYLQLNSLKTEDTAMYYCAKGGSGYGDASRMTSPGSQGTQVTVSS

SEQ ID NO: 252 - protein, 128 aa, synthetic construct
  source 1..128: note = Description of Artificial Sequence: Synthetic polypeptide
QVQLQESGGGSVQAGGSLRLSCTASGAIASGYIDSRWCMAWFRQAPGKEREGVAAIWPGGGLTVYADSVKGRFTISRDHAKNTLYLQMNNLKPEDTAMYYCAAGSPRMCPSLEFGFDYWGQGTQVTVS

SEQ ID NO: 253 - protein, 122 aa, synthetic construct
  source 1..122: note = Description of Artificial Sequence: Synthetic polypeptide
QVQLQESGGGSVQAGGSLRLSCTAPGFTSNSCGMDWYRQAPGKEREFVSSISTDGTTGYADSVKGRFTISKDKAKDTVYLQMNSLKPEDTGMYSCKTKDGTIATMELCDFGYWGQGTQVTVS

SEQ ID NO: 254 - protein, 127 aa, synthetic construct
  source 1..127: note = Description of Artificial Sequence: Synthetic polypeptide
QVQLQESGGGSVQAGGSLRLSCAASGYPYSNGYMGWFRQAPGKEREGVATIYTGDGRTYYADSVKGRFTISRDNAKNTVDLQMSSLKPEDTAMYYCAARAAPLYSSGSPLTRARYNVWGQGTQVTVS

SEQ ID NO: 255 - protein, 118 aa, synthetic construct
  source 1..118: note = Description of Artificial Sequence: Synthetic polypeptide
QVQLQESGGGSVQAGGSLRLSCVASASTYCTYDMHWYRQAPGKGREFVSAIDSDGTTRYADSVKGRFTISQGTAKNTVYLQMNSLQPEDTAMYYCKTVCVVGSRWSDYWGQGTQVTVS

SEQ ID NO: 256 - protein, 116 aa, synthetic construct
  source 1..116: note = Description of Artificial Sequence: Synthetic polypeptide
QVQLQESGGGSVQAGGSLTLSCAASEYAYSTCNMGWYRQAPGKERELVSAFISDGSTYYADSVKGRFTITRDNAKNTVYLQMNSLKPEDTAIYYCSANCYRRLRNYWGQGTQVTVS

SEQ ID NO: 257 - protein, 123 aa, synthetic construct
  source 1..123: note = Description of Artificial Sequence: Synthetic polypeptide
QVQLQESGGGLVQPGGSLRLSCTASGLTFDDSVMGWFRQAPGKGREAVSCISSSGANAFYADSVKGRFTISRDNAKNTLYLQMNSLKPEDTATYYCKRGHACAGYYPIPYDDYWGQGTQVTVS

SEQ ID NO: 258 - protein, 123 aa, synthetic construct
  source 1..123: note = Description of Artificial Sequence: Synthetic polypeptide
QVQLQESGGGSVQVGGSLRLSCAASGFTFSSYPMSWVRQAPGKGLEWISTISAGGDTTLYADSVKGRFTSSRDNAKNTLYLQLNSLKTEDTAIYYCAKRIDCNSGYCYRRNYWGQGTQVTVSS

SEQ ID NO: 259 - protein, 129 aa, synthetic construct
  source 1..129: note = Description of Artificial Sequence: Synthetic polypeptide
QVQLQESGGGSVQAGGSLRLSCRASGSTYSNYCLGWFRQITGKEREGVAVINWVGGMLYFADSVKGRFTVSQDQAKNTLYLQMNSLKPEDTAMYYCAAESVSSFSCGGWLTRPDRVPYWGQGTQVTVSS

SEQ ID NO: 260 - protein, 120 aa, synthetic construct
  source 1..120: note = Description of Artificial Sequence: Synthetic polypeptide
QVQLQESGGGSVQAGGSLRLSCVASGYVSCDYFLPSWYRQAPGKEREFVSIIDGTGSTSYAASVKGRFTASQDKGKNIAYLQMNSLKPEDTAMYYCKASCVRGRGISEYWGQGTQVTVSS

SEQ ID NO: 261 - protein, 123 aa, synthetic construct
  source 1..123: note = Description of Artificial Sequence: Synthetic polypeptide
QVQLQESGGGLVQPGGSLRLSCAASGFTFSHSGMSWVRQAPGKGLEWVSTINSGGASTYYTDSVKGRFTISRDNAKNMLYLQLNSLKTEDTAMYYCAKGGSGYGDASRMTSPGSQGTQVTVSS

SEQ ID NO: 262 - protein, 123 aa, synthetic construct
  source 1..123: note = Description of Artificial Sequence: Synthetic polypeptide
QVQLQESGGGLVQPGGSLRLSCAASGFTFSLSGMSWVRQAPGKGLEWVSAISSGGASTYYTDSVKGRFTISRDNAKNILYLQLNSLKTEDTAMYYCAKGGSGYGDASRMTSPGSQGTQVTVSS

SEQ ID NO: 263 - protein, 120 aa, synthetic construct
  source 1..120: note = Description of Artificial Sequence: Synthetic polypeptide
QVQLQESGGGSVQAGGSLRLSCVASGYVSCDYFLPSWYRQAPGKEREFVSIIDGTGSTSYAASVKGRFTASEDKGKNIAYLQMNSLKPEDTAMYYCKASCVRGRAVSEYWGQGTQVTVSS

SEQ ID NO: 264 - protein, 120 aa, synthetic construct
  source 1..120: note = Description of Artificial Sequence: Synthetic polypeptide
QVQLQESGGGSVQAGGSLRLSCTASGYVSCDYFLPSWYRQAPGKEREFVSVIDGTGSTSYAASVKGRFTASQDKGKNIAYLQMNSLKPEDTAMYYCKASCVRGRAISEYWGQGTQVTVSS

SEQ ID NO: 265 - protein, 123 aa, synthetic construct
  source 1..123: note = Description of Artificial Sequence: Synthetic polypeptide
QVQLQESGGGLVQPGGSLRLSCAASGFTFSSYPMSWVRQAPGKGLEWISTISAGGDTTLYADSVKGRFTSSRDNAKNTLYLQLNSLKTEDTAIYYCAKRIDCNSGYCYRRNYWGQGTQVTVSS

SEQ ID NO: 266 - protein, 129 aa, synthetic construct
  source 1..129: note = Description of Artificial Sequence: Synthetic polypeptide
QVQLQESGGGSVQAGGSLRLSCRASGSTYSNYCLGWFRQSTGKEREGVAVINWVGGMLYFADSVKGRFTVSQDHAKNTVTLQMNSLKPEDTAMYYCAAESVSSFSCGGWLTRPGRVPYWGQGTQVTVSS

SEQ ID NO: 267 - protein, 129 aa, synthetic construct
  source 1..129: note = Description of Artificial Sequence: Synthetic polypeptide
QVQLQESGGGSVQAGESLRLSCRASGSTYSNYCLGWFRQITGKEREGVAVINWVGGMLYFADSVKGRFTVSQDQAKNTVYLEMNSLKPEDTAMYYCATESVSSFSCGGWLTRPDRVPYWGQGTQVTVSS

SEQ ID NO: 268 - protein, 120 aa, synthetic construct
  source 1..120: note = Description of Artificial Sequence: Synthetic polypeptide
QVQLQESGGGSVQAGGSLRLSCVASGYVSCDYFLPSWYRQAPGKEREFVSIIDGTGSTSYAASVKGRFTASQDRGKNIAYLQMNSLKPEDTAMYYCKASCVRGRTISEYWGQGTQVTVSS

SEQ ID NO: 269 - protein, 120 aa, synthetic construct
  source 1..120: note = Description of Artificial Sequence: Synthetic polypeptide
QVQLQESGGGSVQAGGSLRLSCVASGYVSCDYFLPSWYRQAPGKEREFVSIIDGTGSTSYAASVKGRFTASQDKGKNIAYLQMNSLKPEDTAMYYCKASCVRGRAISEYWGQGTQVTVSS

SEQ ID NO: 270 - protein, 129 aa, synthetic construct
  source 1..129: note = Description of Artificial Sequence: Synthetic polypeptide
QVQLQESGGGSVQAGGSLRLSCRASGSTYSNYCLGWFRQITGKEREGVAVINWVGGMLYFADSVKGRFTVSQDQAKNTVYLQMNSLKPEDTAMYYCAAESASSFSCGGWLTRPDRVPYWGQGTQVTVSS

SEQ ID NO: 271 - protein, 123 aa, synthetic construct
  source 1..123: note = Description of Artificial Sequence: Synthetic polypeptide
QVQLQESGGGLVQPGGSLRLSCAASGFTFSLSGMSWVRQAPGKGLEWVSAISSGGASTYYTDSVKGRFTISRDNAKNMLYLQLNSLKTEDTAMYYCAKGGSGYGDASRMTSPGSQGTQVTVSS

SEQ ID NO: 272 - protein, 123 aa, synthetic construct
  source 1..123: note = Description of Artificial Sequence: Synthetic polypeptide
QVQLQESGGGLVQPGGSLRLSCAASGFTFSSYPMSWVRQAPGKGLEWVSTISSGGDTTLYADSVKGRFTSSRDNAKNTLYLQLNSLKTEDTAMYYCAKRIDCNSGYCYKRSYWGQGTQVTVSS

SEQ ID NO: 273 - protein, 129 aa, synthetic construct
  source 1..129: note = Description of Artificial Sequence: Synthetic polypeptide
QVQLQESGGGSVQAGGSLRLSCRASGSTYSNYCLGWFRQTTGKEREGVAVINWVGGMLYFADSVKGRFTVSQDQAKNTVYLQMNSLKPEDTAMYYCAAESVSSFSCGGWLTRPDRVPYWGQGTQVTVSS

SEQ ID NO: 274 - protein, 129 aa, synthetic construct
  source 1..129: note = Description of Artificial Sequence: Synthetic polypeptide
QVQLQESGGGSVQAGGSLRLSCRASRSPYGNYCLGWFRQSTGKEREGVAVINWVGGMLYFADSVKGRFTVSQDHAKNTVTLQMNSLKPEDTAMYYCAAESVSSFSCGGWLTRPDRVPYWGQGTQVTVSS

SEQ ID NO: 275 - protein, 123 aa, synthetic construct
  source 1..123: note = Description of Artificial Sequence: Synthetic polypeptide
QVQLQESGGGSVQAGGSLRLSCAASKNSNFMGWFRQAPGKEREGVAAMMTKNNNTYYADSVKGRFTISHDNAKNTVYLQMDSLKPEDTAVYYCAAVYRTRRLRVLEAANFDYWGQGTQVTVSS

SEQ ID NO: 276 - protein, 121 aa, synthetic construct
  source 1..121: note = Description of Artificial Sequence: Synthetic polypeptide
QVQLQESGGGSVQAGGSLRLSCTASGYTSSRYCMGWFRQTPGKKREGVAAIYTGGGTTFYHGSVKGRFTISQDNTTNTVYLQMHNLKPEDTAMYYCAAGPVTRACDEYNYWGQGTQVTVSS

SEQ ID NO: 277 - protein, 126 aa, synthetic construct
  source 1..126: note = Description of Artificial Sequence: Synthetic polypeptide
QVQLQESGGGSVQAGGSLRLSCAGSGYSLSNYCMGWFRQAPGQGREGVASLRFVSGATFYADSVKGRFTIAQDNAKNTLYLQMNSLKPEDTAMYYCGIKSRGICGGRLVDVDFGNWGQGTQVTVSS

SEQ ID NO: 278 - protein, 123 aa, synthetic construct
  source 1..123: note = Description of Artificial Sequence: Synthetic polypeptide
QVQLQESGGGSVQAGGSLRLSCAASGYSINRMGWFRQAPGKEREGVAAISIGGGQTYYADSVKGRFTISQDNAKNTVDLQMNSLKPEDTAMYYCAAGLVYGEAWLDSRHYNKWGQGTQVTVSS

SEQ ID NO: 279 - protein, 121 aa, synthetic construct
  source 1..121: note = Description of Artificial Sequence: Synthetic polypeptide
QVQLQESGGGSVQAGGSLRLSCAVSGDSTYSMGWFRQPPGKEREGVAAIAKDGITIHADSVKGRFTISKDNAKNTLYLQMNSLKPEDTAMYYCAAHRPYGPPLNPRWYTYWGQGTQVTVSS

SEQ ID NO: 280 - protein, 122 aa, synthetic construct
  source 1..122: note = Description of Artificial Sequence: Synthetic polypeptide
QVQLQESGGGSVQAGGSLRLSCAASGYTYSSYCMAWFRQAPGKEREGVAAIDSDGSTSYADSVKGRFTISKDNAKNTLYLQMNSLKPEDTAMYYCAAASGRCLGPGIRSLIWGQGTQVTVSS

SEQ ID NO: 281 - protein, 120 aa, synthetic construct
  source 1..120: note = Description of Artificial Sequence: Synthetic polypeptide
QVQLQESGGGSVQAGGSLRLSCAVSGDSTYSMGWFRQPPGKEREGVAAITKDITIHADSVKGRFTISKDNAKNTLYLQMNSLKPEDTAMYYCAAHRPYGPPLNPRWYTYWGQGTQVTVSS

SEQ ID NO: 282 - protein, 121 aa, synthetic construct
  source 1..121: note = Description of Artificial Sequence: Synthetic polypeptide
QVQLQESGGGSVQAGGSLRLSCAVSGDSTYSMGWFRQPPGKEREGVAAIPTDGITIHADSVKGRFTISKDNAKNTLYLQMNSLKPEDTAMYYCAAHRPYGPPLNPRWYTYWGQGTQVTVSS

SEQ ID NO: 283 - protein, 121 aa, synthetic construct
  source 1..121: note = Description of Artificial Sequence: Synthetic polypeptide
QVQLQESGGGSVQAGGSLRLSCAVSGDSTYSMGWFRQPPGKEREGVAAIAKDGITIHADSVKGRFTISKDNAKNTLYLQMSSLKPEDTAMYYCAAHRPYGPPLNPRWYTYWGQGTQVTVSS

SEQ ID NO: 284 - protein, 121 aa, synthetic construct
  source 1..121: note = Description of Artificial Sequence: Synthetic polypeptide
QVQLQESGGGSVQAGGSLRLSCAVSGDSTYSMGWFRQPPGKEREGVAAIGKDGITIHADSVKGRFTISKDNAKNTLYLQMNSLKPEDTAMYYCAAHRPYGPPLNPRWYTYWGQGTQVTVSS

SEQ ID NO: 285 - protein, 120 aa, synthetic construct
  source 1..120: note = Description of Artificial Sequence: Synthetic polypeptide
QVQLQESGGGSVQAGGSLRLSCAVSGDSTYSMGWFRQPPGKEREGVAAITKDITIHADSVKGRFTISKDNAKNTLYLQMNSLRPEDTAMYYCAAHRPYGPPLNPRWYTYWGQGTQVTVSS

SEQ ID NO: 286 - protein, 123 aa, synthetic construct
  source 1..123: note = Description of Artificial Sequence: Synthetic polypeptide
QVQLQESGGGSVQTGGSLRLSCAASGYSINRMAWFRQAPGKEREGVAAISIGGDRTYYADSVKGRFTISQDNAKHTVDLQMNSLKPEDTAMYYCAAGLVYGEAWLDSRHYNKWGQGTQVTVSS

SEQ ID NO: 287 - protein, 123 aa, synthetic construct
  source 1..123: note = Description of Artificial Sequence: Synthetic polypeptide
QVQLQESGGGSVQAGGSLRLSCAASGYSINRMGWFRQAPGKEREGVAAISIGGGRTYYADSVKGRFTISQDNAKNTVDLQMNSLKPEDTAMYYCAAGLVYGEAWLDSRHYNKWGQGTQVTVSS

SEQ ID NO: 288 - protein, 121 aa, synthetic construct
  source 1..121: note = Description of Artificial Sequence: Synthetic polypeptide
QVQLQESGGGSVQAGGSLRLSCAVSGDSTYSMGWFRQPPGKEREGVAAITKDGITIHADSVKGRFTISGDNAKNTLYLQMNNLKPEDTAMYYCAAHRPYGPPLNPRWYTYWGQGTQVTVSS

SEQ ID NO: 289 - protein, 125 aa, synthetic construct
  source 1..125: note = Description of Artificial Sequence: Synthetic polypeptide
QVQLQESGGGSVQAGGSLRLSCVISGFTYRQTFMGWFRQVLGKEREGVAAISTGGGSTVYADSVKGRFTISQDSSKNTVYLEMNGLKLEDTGMYYCAASTVITSVSINRGLYQYWGQGTQVTVSS

SEQ ID NO: 290 - protein, 125 aa, synthetic construct
  source 1..125: note = Description of Artificial Sequence: Synthetic polypeptide
QVQLQESGGGSVQAGGSLRLSCAISGFTYRQTFMGWFRQVVGKEREGVAAISTGGGSTVYADSVKGRFTISQDSSKDTVYLEMNGLKLEDTGMYYCAASTVITSESINRNLYQYWGQGTQVTVSS

SEQ ID NO: 291 - protein, 124 aa, synthetic construct
  source 1..124: note = Description of Artificial Sequence: Synthetic polypeptide
QVQLQESGGGLVQPGGSLRLSCAASGFTLSTYWIYWVRQAPGKGPEWVSTVSRSGGTTYYADSVNGRFTISRDNAKNTVYLQMNNLKPEDAAVYYCLASVSNLGWPPVRAPSPTGQGTQVTVSS

SEQ ID NO: 292 - protein, 125 aa, synthetic construct
  source 1..125: note = Description of Artificial Sequence: Synthetic polypeptide
QVQLQESGGGLVQPGGSLRLSCAASGFTFSSYAMSWVRQAPGKGLEWVSAINSGGAGTYYTDSVKGRFTISRDNAKNTLYLQLNSLKTEDTAMYYCAKHVTGDYDPSLRHGYNVWSQGTQVTVSS

SEQ ID NO: 293 - protein, 125 aa, synthetic construct
  source 1..125: note = Description of Artificial Sequence: Synthetic polypeptide
QVQLQESGGGSVQAGGSLRLSCVISGFTYRQTFMGWFRQVVGKEREGVAAISTGGGSTIYADSVKGRFTISQDSSKDTVYLEMNGLKLEDTGMYYCAASTVITSESINRNLYQYWGQGTQVTVSS

SEQ ID NO: 294 - protein, 124 aa, synthetic construct
  source 1..124: note = Description of Artificial Sequence: Synthetic polypeptide
QVQLQESGGGLVQPGGSLRLSCAASGFTLSTYWMYWVRQAPGKGPEWVSAVSRGGFNTYYADSVKGRFTISRDNAKNTVYLQMNSLKPEDTAVYYCMSSVSFYGWPPDRVPSPTGQGTQVTVSS

SEQ ID NO: 295 - protein, 125 aa, synthetic construct
  source 1..125: note = Description of Artificial Sequence: Synthetic polypeptide
QVQLQESGGGLVQPGESLRLSCAASGFTFSSYAMSWVRQAPGKGLEWVSAINSGGAGTYYTDSVKGRFTISRDNAKNTLYLQLNSLKTEDTAMYYCAKHVTGDYDPSLRYGYNVWSQGTQVTVSS

SEQ ID NO: 296 - protein, 125 aa, synthetic construct
  source 1..125: note = Description of Artificial Sequence: Synthetic polypeptide
QVQLQESGGGSVQAGGSLRLSCVISGFTYRPTFMGWFRQVLGKEREGVAAITTGGGSTVYADSVKGRFTISQDSSKNTVYLEMNGLKLEDTGMYYCAATTVITSVSINRNLYQYWGQGTQVTVSS

SEQ ID NO: 297 - protein, 125 aa, synthetic construct
  source 1..125: note = Description of Artificial Sequence: Synthetic polypeptide
QVQLQESGGGSVQAGGSLRLSCGISGFTYRPTFMGWFRQVLGKEREGVAAISTGGGSSVYADSVKGRFTVSQDSSKNTVYLEMNGLKLEDTGMYYCAASTVITSVSINRGLYQYWGQGTQVTVSS

SEQ ID NO: 298 - protein, 125 aa, synthetic construct
  source 1..125: note = Description of Artificial Sequence: Synthetic polypeptide
QVQLQESGGGLVQPGGSLRLSCTASGFTFRNYAMSWVRQAPGKGLEWVSAINSGGGSTYYADSVKGRFTISRDNAKNTLYLRLHSLKTEDTAMYYCAKHVTGDYDPSLRYEYNYWSQGTQVTVSS

SEQ ID NO: 299 - protein, 125 aa, synthetic construct
  source 1..125: note = Description of Artificial Sequence: Synthetic polypeptide
QVQLQESGGGLVQPGGSLRLSCAASGFTFRNYAMSWVRQAPGKGLEWVSAINSGGGSTYYADSVKGRFTISRDNAKNTLYLQLNSLKTEDTAMYYCTKHVTGDYDPSLRYEYNYWSQGTQVTVSS

SEQ ID NO: 300 - protein, 125 aa, synthetic construct
  source 1..125: note = Description of Artificial Sequence: Synthetic polypeptide
QVQLQESGGGLVQPGGSLRLSCAASGFTFSSYAMSWVRQAPGKGLEWVSAINSGGGSTYYADSVKGRFTISRDNAKNTLYLQLNSLKTEDTAMYCCAKHVTGDYDPSLRYGYNCWGPGTQVTVSS

SEQ ID NO: 301 - protein, 124 aa, synthetic construct
  source 1..124: note = Description of Artificial Sequence: Synthetic polypeptide
QVQLQESGGGSVQPGGSLRLSCAASGFTFSTYDMSWVRQAPGKGLEWVSTINYSGSSTYYVDSVLGRFTIARDNAKNTLYLQMNNLQTEDTAVYYCASVKERRSNGHPIVFGDRGQGTQVTVSS

SEQ ID NO: 302 - protein, 125 aa, synthetic construct
  source 1..125: note = Description of Artificial Sequence: Synthetic polypeptide
QVQLQESGGGSVQAGGSLRLSCVISGFTYKQTFMGWFRQVPGKEREGVAAISTGGGSTVYADSVKGRFTISQDSSKNTVYLEMNGLKLEDTGMYYCAASTVITSVSINRGLYQYWGQGTQVTVSS

SEQ ID NO: 303 - protein, 125 aa, synthetic construct
  source 1..125: note = Description of Artificial Sequence: Synthetic polypeptide
QVQLQESGGGSVQAGGSLRLSCVISGFTYRQTFMGWFRQVVGKEREGVAAISTGGGSTVYADSVKGRFTISQDSSKDTVYLEMNGLKLEDTGMYYCAASTVITSESIYRNLYQYWGQGTQVTVSS

SEQ ID NO: 304 - protein, 125 aa, synthetic construct
  source 1..125: note = Description of Artificial Sequence: Synthetic polypeptide
QVQLQESGGGLVQPGGSLRLSCAASGFTFRNYAMSWVRQAPGKGLEWVSAINSGGGSTYYADSVKGRFTISRDNAKNTLYLQMNSLKPEDTAMYYCAKHVTGDYDPSLRYEYNYWSQGTQVTVSS

SEQ ID NO: 305 - protein, 125 aa, synthetic construct
  source 1..125: note = Description of Artificial Sequence: Synthetic polypeptide
QVQLQESGGGLVQPGGSLRLSCAASGFTFRNYAMSWVRQAPGKGLEWVSAINSGGGSTYYADSVKGRFTISRDNAKNTLYLQLNSLKTEDTAMYYCAKHVTGDYDPSLRYEYAYWSQGTQVTVSS

SEQ ID NO: 306 - protein, 125 aa, synthetic construct
  source 1..125: note = Description of Artificial Sequence: Synthetic polypeptide
QVQLQESGGGSVQAGGSLRLSCAASGFTFSSYAMSWVRQAPGKGLEWVSAINSGGGSTYYADSVKARFTISRDNAKNTLYLQLNSLKTEDTAMYYCAKHVTGDYDPSLRYDYNYWGQGTQVTVSS

SEQ ID NO: 307 - protein, 125 aa, synthetic construct
  source 1..125: note = Description of Artificial Sequence: Synthetic polypeptide
QVQLQESGGGSVQAGGSLRLSCGISGFTYRPTFMGWFRQVLGKEREGVAAISTGGGSSVYADSVKGRFTVSQDSSKNTVYLEMNGLKLEDTGMYYCAASTVITSVSINRALYQYWGQGTQVTVSS

SEQ ID NO: 308 - protein, 125 aa, synthetic construct
  source 1..125: note = Description of Artificial Sequence: Synthetic polypeptide
QVQLQESGGGLVQPGGSLRLSCAASGFTFSSYAVSWVRQAPGKGLEWVSTINSGGGSTYYADSVKGRFTISRDNAKNTLYLQLNSLKTEDTAMYYCTKHVTGDYDPSLRYEYNVWSQGTQVTVSS

SEQ ID NO: 309 - protein, 125 aa, synthetic construct
  source 1..125: note = Description of Artificial Sequence: Synthetic polypeptide
QVQLQESGGGSVQAGGSLRVSCQISGFTYRQTFMGWFRQVPGKEREGVAAISTGGGSTVYADSVKGRFTISQDSSKNTVYLEMNGLKLEDTGMYYCAASTVITSPSINRNLYQYWGQGTQVTVSS

SEQ ID NO: 310 - protein, 114 aa, synthetic construct
  source 1..114: note = Description of Artificial Sequence: Synthetic polypeptide
QVQLQESGGGLVQPGGSLRLSCAVSGFTFSNYAMKWVRQAPGKGLEWVSSISGGGGATYYADSVKGRFTISRDNTKNTLYLQMNSLKTEDTAVYYCAAQNLDYRGQGTQVTVSS

SEQ ID NO: 311 - protein, 112 aa, synthetic construct
  source 1..112: note = Description of Artificial Sequence: Synthetic polypeptide
QVQLQESGGGLVQPGGSLRLSCTASGFTFNSAHMKWERQPPGKGLEWVSFITPGGASTGYADSVKGRFTISRDNAKNTLYLQMNNLKTEDTAVYYCATGGLRGQGTQVTVSS

SEQ ID NO: 312 - protein, 125 aa, synthetic construct
  source 1..125: note = Description of Artificial Sequence: Synthetic polypeptide
QVQLQESGGGSVQAGGSLRLSCVISGFTYRPTFMGWFRQVLGKEREGVAAITTGGGSTLYADSVKGRFTISQDSSKNTVYLEMNGLKLEDTGMYYCAATTVITSVSINRNLYQYWGQGTQVTVSS

SEQ ID NO: 313 - protein, 125 aa, synthetic construct
  source 1..125: note = Description of Artificial Sequence: Synthetic polypeptide
QVQLQESGGGSVQAGGSLRLSCVISGFTYKQTFMGWFRQVPGKEREGVAAISTGGGSTVYADSVKGRFTISQDSSKNTVYLEMNGLKLEDTGMYYCAASTVITSVTINRGLYQYWGQGTQVTVSS

SEQ ID NO: 314 - protein, 125 aa, synthetic construct
  source 1..125: note = Description of Artificial Sequence: Synthetic polypeptide
QVQLQESGGGSVQAGGSLRLSCVISGFVYKQTFMGWFRQVPGKEREGVAAISTGGGSTVYADSVKGRFTISQDSSKNTVYLEMNGLKLEDTGMYYCAASTVITSVSINRGLYQYWGQGTQVTVSS

SEQ ID NO: 315 - protein, 125 aa, synthetic construct
  source 1..125: note = Description of Artificial Sequence: Synthetic polypeptide
QVQLQESGGGSVQAGGSLRVSCVISGFTYRQTFMGWFRQVPGKEREGVAAISTGGGSTVYADSVKGRFTISQDSSKNTVYLEMNGLKLEDTGMYYCAASTVITSVSINRGLYQYWGQGTQVTVSS

SEQ ID NO: 316 - protein, 125 aa, synthetic construct
  source 1..125: note = Description of Artificial Sequence: Synthetic polypeptide
QVQLQESGGGLVQPGGSLRLSCAASGFTFSSYAMSWVRQAPGKGLEWVSAINSGGGSTYYADSVKGRFTISRDNAKSTLYLQLNSLKTEDTAMYYCTKHVTGDYDPSLRYEYNYWSQGTQVTVSS

SEQ ID NO: 317 - protein, 125 aa, synthetic construct
  source 1..125: note = Description of Artificial Sequence: Synthetic polypeptide
QVQLQESGGGLVQPGGSLRLSCAASGFTFSSYAMSWVRQAPGKGLEWVSAINSGGASTYYADSVKGRFTISRDNAKNTLYLQLNSLKTEDTAMYCCAKHVTGDYDPSLRYEYNCWGPGTQVTVSS

SEQ ID NO: 318 - protein, 125 aa, synthetic construct
  source 1..125: note = Description of Artificial Sequence: Synthetic polypeptide
QVQLQESGGGLVQPGGSLRLSCAASGFTFSSYAMSWVRQAPGKGLEWVSAINSGGGSTYYADSVKGRFTISRDNAKNTLYLQLNSLKTEDTAMYYCAKHVTGDYDPSLRYEYNYWSQGTQVTVSS

SEQ ID NO: 319 - protein, 125 aa, synthetic construct
  source 1..125: note = Description of Artificial Sequence: Synthetic polypeptide
QVQLQESGGGSVQAGGSLRLSCVISGFTYRQTFMGWFRQVVGKEREGVAAISTGGGSTVYADSVKGRFTISQDSSKDTVYLEMNGLKLEDTGMYYCAASTVITSESINRNLYQYWGQGTQVTVSS

SEQ ID NO: 320 - protein, 125 aa, synthetic construct
  source 1..125: note = Description of Artificial Sequence: Synthetic polypeptide
QVQLQESGGGSVQAGGSLRVSCVVSGFTYRQTFMGWFRQVPGKEREGVAAISTGGGSTVYADSVKGRFTISQDSSKNTVYLEMNGLKLEDTGMYYCAASTVITSVSINRNLYQYWGQGTQVTVSS

SEQ ID NO: 321 - protein, 125 aa, synthetic construct
  source 1..125: note = Description of Artificial Sequence: Synthetic polypeptide
QVQLQESGGGLVQPGGSLRLSCAASGFTFSSYAMSWVRQAPGKGLEWVSAINSGGGSTYYADSVKGRFTISRDNAKNTMYLQLNSLKTEDTAMYYCAKHVAGDYDPSLRYEWHVWGQGTQVTVSS

SEQ ID NO: 322 - protein, 125 aa, synthetic construct
  source 1..125: note = Description of Artificial Sequence: Synthetic polypeptide
QVQLQESGGGLVQPGGSLRLSCAASGFTFRSYAMSWVRQAPGKGLEWVSAINSGGGSTYYADSVKARFTISRDNAKNTLYLQLNSLKTEDTAMYYCAKHVTGDYDPSLRYEYNYWGQGTQVTVSS

SEQ ID NO: 323 - protein, 125 aa, synthetic construct
  source 1..125: note = Description of Artificial Sequence: Synthetic polypeptide
QVQLQESGGGLVQPGGSLRLSCAASGFTFSSYAMSWVRQAPGKGLEWVSAINSGGGSTYYADSVKGRFTISRDNAKNTLYLQLNSLKTEDTAMYYCAKHITGDYDPSLRYEYNYWGQGTQVTVSS

SEQ ID NO: 324 - protein, 125 aa, synthetic construct
  source 1..125: note = Description of Artificial Sequence: Synthetic polypeptide
QVQLQESGGGSVQAGGSLRLSCVISGFTYRQTFMGWFRQVVGKEREGVAAISTGGGSMVYADSVKGRFTISQDSSKDTVYLEMNGLKLEDTGMYYCAASTVITSESINRNLYQYWGQGTQVTVSS

SEQ ID NO: 325 - protein, 125 aa, synthetic construct
  source 1..125: note = Description of Artificial Sequence: Synthetic polypeptide
QVQLQESGGGPVQAGGSLRLSCVISGFTYRQTFMGWFRQVPGKEREGVAAISTGGGSTVYADSVKGRFTISQDSSKNTVYLEMNGLKLEDTGMYYCAASTVITSESINRGLYQYWGQGTQVTVSS

SEQ ID NO: 326 - protein, 122 aa, synthetic construct
  source 1..122: note = Description of Artificial Sequence: Synthetic polypeptide
QVQLQESGGGSVQAGGFLRLSCAFSGYTGCMGWFRQGPGQEREGVASINDGGSLTYADSVKGRFTISKDNAKKTLDLQMNTLKPEDTAMYYCAASLSYCLNPTLRVDGYNYWGQGTQVTVSS

SEQ ID NO: 327 - protein, 125 aa, synthetic construct
  source 1..125: note = Description of Artificial Sequence: Synthetic polypeptide
QVQLQESGGGSVQAGGSLRLSCVISGLTYKQTFMGWFRQVPGKEREGVAAISTGGGSTVYADSVKGRFTISQDNSKNTVYLEMNGLKLEDTGMYYCAASTVITSVSINRYLYQWWGQGTQVTVSS

SEQ ID NO: 328 - protein, 124 aa, synthetic construct
  source 1..124: note = Description of Artificial Sequence: Synthetic polypeptide
QVQLQESGGGLVQPGGSLRLSCAASGFTFSNYAMSWVRQAPGKGVEWVSAINSGGSVFYADSVKGRFTISRDNAKNTLYLQLSSLKTEDTAMYYCAKHVTGDYDPSLRYGYNVWSQGTQVTVSS

SEQ ID NO: 329 - protein, 125 aa, synthetic construct
  source 1..125: note = Description of Artificial Sequence: Synthetic polypeptide
QVQLQESGGGSVQAGGSLRLSCGISGFTYRPTFMGWFRQVLGKEREGVAAISTGGGSTVYADSVKGRFTISQDSSKDTVYLEMNGLKLEDTGMYYCAASTVITSESINRNLYQYWGQGTQVTVSS

SEQ ID NO: 330 - protein, 125 aa, synthetic construct
  source 1..125: note = Description of Artificial Sequence: Synthetic polypeptide
QVQLQESGGGLVQPGGSLRLSCAASGFTFSSYAMSWVRQAPGKGLEWVSAINSGGGSTYYADSVKGRFTISRDNAKNTLYLQLNSLKTEDTAMYYCAKHVTGDYDPSLRYGYNVWSQGTQVTVSS

SEQ ID NO: 331 - protein, 125 aa, synthetic construct
  source 1..125: note = Description of Artificial Sequence: Synthetic polypeptide
QVQLQESGGGLVQPGGSLRLSCAASGFTFSSYAMSWVRQAPGKGLEWVSAINLGGDTTYYTDSVKGRFTISRDNAKNTLYLQLNSLKTEDTAMYYCAKHVTGDYDPSLRYEYGYWSQGTQVTVSS

SEQ ID NO: 332 - protein, 112 aa, synthetic construct
  source 1..112: note = Description of Artificial Sequence: Synthetic polypeptide
QVQLQESGGGLVQPGGSLRLSCTASGFTFNSAHLKWERQPPGKGLEWVSFITNGGASTGYADSVKGRFTISRDDAKNTLYLQMNNLKTEDTAVYYCATGGLRGQGTQVTVSS

SEQ ID NO: 333 - protein, 125 aa, synthetic construct
  source 1..125: note = Description of Artificial Sequence: Synthetic polypeptide
QVQLQESGGGSVQAGGSLRVSCVISGFTYRQTFMGWFRQVPGKEREGVAAISTGGGSTIYANSVKGRFTISQDSSKNTVYLEMNGLKLEDTGMYYCAASTVITSVSINRGLYQYWGQGTQVTVSS

SEQ ID NO: 334 - protein, 125 aa, synthetic construct
  source 1..125: note = Description of Artificial Sequence: Synthetic polypeptide
QVQLQESGGGLVQPGGSLRLSCAASGFTFSSYAMSWVRQAPGKGLEWVSAINSGGGSTYYADSVKGRFTISRDNAKNTLYLQLNSLKTEDTAMYCCAKHITGDYDPSLRYEYNCWGQGTQVTVSS

SEQ ID NO: 335 - protein, 125 aa, synthetic construct
  source 1..125: note = Description of Artificial Sequence: Synthetic polypeptide
QVQLQESGGGSVQAGGSLRLSCVISGFTYKQTFMGWFRQVPGKEREGVAAISTGGGNTVYADSVKGRFTISQDSSKNTVYLEMNGLKLEDTGMYYCAASTVITSVTVNRGLYQYWGQGTQVTVSS

SEQ ID NO: 336 - protein, 114 aa, synthetic construct
  source 1..114: note = Description of Artificial Sequence: Synthetic polypeptide
QVQLQESGGALVQPGGSLRLSCAASGFTFSYYAMKWVRQAPGKGLEWVSSISGGGGATYYADSVKGRFTISRDNTNDTLYLQMNSLKTEDTAVYYCAAQNLDYRGQGTQVTVSS

SEQ ID NO: 337 - protein, 125 aa, synthetic construct
  source 1..125: note = Description of Artificial Sequence: Synthetic polypeptide
QVQLQESGGGSVQAGGSLRLSCVISGFTYKQTFMGWFRQVPGKEREGVAAISTGGGSTVYADSVKGRFTISQESSKNTVYLEMNGLKLEDTGMYYCAASTVITSVTINRGLYQYWGQGTQVTVSS

SEQ ID NO: 338-399 - skipped (62 entries)

SEQ ID NO: 400 - protein, 215 aa, Homo sapiens
FPRPPGRPQLSLQELRREFTVSLHLARKLLSEVRGQAHRFAESHLPGVNLYLLPLGEQLPDVSLTFQAWRRLSDPERLCFISTTLQPFHALLGGLGTQGRWTNMERMQLWAMRLDLRDLQRHLRFQVLAAGFNLPEEEEEEEEEEEEERKGLLPGALGSALQGPAQVSWPQLLSTYRLLHSLELVLSRAVRELLLLSKAGHSVWPLGFPTLSPQP

SEQ ID NO: 401 - protein, 209 aa, Homo sapiens
RKGPPAALTLPRVQCRASRYPIAVDCSWTLPPAPNSTSPVSFIATYRLGMAARGHSWPCLQQTPTSTSCTITDVQLFSMAPYVLNVTAVHPWGSSSSFVPFITEHIIKPDPPEGVRLSPLAERQLQVQWEPPGSWPFPEIFSLKYWIRYKRQGAARFHRVGPIEATSFILRAVRPRARYYVQVAAQDLTDYGELSDWSLPATATMSLGK

SEQ ID NO: 402 - protein, 604 aa, Homo sapiens
QGSAGPLQCYGVGPLGDLNCSWEPLGDLGAPSELHLQSQKYRSNKTQTVAVAAGRSWVAIPREQLTMSDKLLVWGTKAGQPLWPPVFVNLETQMKPNAPRLGPDVDFSEDDPLEATVHWAPPTWPSHKVLICQFHYRRCQEAAWTLLEPELKTIPLTPVEIQDLELATGYKVYGRCRMEKEEDLWGEWSPILSFQTPPSAPKDVWVSGNLCGTPGGEEPLLLWKAPGPCVQVSYKVWFWVGGRELSPEGITCCCSLIPSGAEWARVSAVNATSWEPLTNLSLVCLDSASAPRSVAVSSIAGSTELLVTWQPGPGEPLEHVVDWARDGDPLEKLNWVRLPPGNLSALLPGNFTVGVPYRITVTAVSASGLASASSVWGFREELAPLVGPTLWRLQDAPPGTPAIAWGEVPRHQLRGHLTHYTLCAQSGTSPSVCMNVSGNTQSVTLPDLPWGPCELWVTASTIAGQGPPGPILRLHLPDNTLRWKVLPGILFLWGLFLLGCGLSLATSGRCYHLRHKVLPRWVWEKVPDPANSSSGQPHMEQVPEAQPLGDLPILEVEEMEPPPVMESSQPAQATAPLDSGYEKHFLPTPEELGLLGPPRPQVLA

SEQ ID NO: 403 - protein, 484 aa, Homo sapiens
QGSAGPLQCYGVGPLGDLNCSWEPLGDLGAPSELHLQSQKYRSNKTQTVAVAAGRSWVAIPREQLTMSDKLLVWGTKAGQPLWPPVFVNLETQMKPNAPRLGPDVDFSEDDPLEATVHWAPPTWPSHKVLICQFHYRRCQEAAWTLLEPELKTIPLTPVEIQDLELATGYKVYGRCRMEKEEDLWGEWSPILSFQTPPSAPKDVWVSGNLCGTPGGEEPLLLWKAPGPCVQVSYKVWFWVGGRELSPEGITCCCSLIPSGAEWARVSAVNATSWEPLTNLSLVCLDSASAPRSVAVSSIAGSTELLVTWQPGPGEPLEHVVDWARDGDPLEKLNWVRLPPGNLSALLPGNFTVGVPYRITVTAVSASGLASASSVWGFREELAPLVGPTLWRLQDAPPGTPAIAWGEVPRHQLRGHLTHYTLCAQSGTSPSVCMNVSGNTQSVTLPDLPWGPCELWVTASTIAGQGPPGPILRLHLPDNTLRWK

SEQ ID NO: 404 - protein, 896 aa, Homo sapiens
ELLDPCGYISPESPVVQLHSNFTAVCVLKEKCMDYFHVNANYIVWKTNHFTIPKEQYTIINRTASSVTFTDIASLNIQLTCNILTFGQLEQNVYGITIISGLPPEKPKNLSCIVNEGKKMRCEWDGGRETHLETNFTLKSEWATHKFADCKAKRDTPTSCTVDYSTVYFVNIEVWVEAENALGKVTSDHINFDPVYKVKPNPPHNLSVINSEELSSILKLTWTNPSIKSVIILKYNIQYRTKDASTWSQIPPEDTASTRSSFTVQDLKPFTEYVFRIRCMKEDGKGYWSDWSEEASGITYEDRPSKAPSFWYKIDPSHTQGYRTVQLVWKTLPPFEANGKILDYEVTLTRWKSHLQNYTVNATKLTVNLTNDRYLATLTVRNLVGKSDAAVLTIPACDFQATHPVMDLKAFPKDNMLWVEWTTPRESVKKYILEWCVLSDKAPCITDWQQEDGTVHRTYLRGNLAESKCYLITVTPVYADGPGSPESIKAYLKQAPPSKGPTVRTKKVGKNEAVLEWDQLPVDVQNGFIRNYTIFYRTIIGNETAVNVDSSHTEYTLSSLTSDTLYMVRMAAYTDEGGKDGPEFTFTTPKFAQGEIEAIVVPVCLAFLLTTLLGVLFCFNKRDLIKKHIWPNVPDPSKSHIAQWSPHTPPRHNFNSKDQMYSDGNFTDVSVVEIEANDKKPFPEDLKSLDLFKKEKINTEGHSSGIGGSSCMSSSRPSISSSDENESSQNTSSTVQYSTVVHSGYRHQVPSVQVFSRSESTQPLLDSEERPEDLQLVDHVDGGDGILPRQQYFKQNCSQHESSPDISHFERSKQVSSVNEEDFVRLKQQISDHISQSCGSGQMKMFQEVSAADAFGPGTEGQVERFETVGMEAATDEGMPKSYLPQTVRQGGYMPQ

SEQ ID NO: 405 - protein, 597 aa, Homo sapiens
ELLDPCGYISPESPVVQLHSNFTAVCVLKEKCMDYFHVNANYIVWKTNHFTIPKEQYTIINRTASSVTFTDIASLNIQLTCNILTFGQLEQNVYGITIISGLPPEKPKNLSCIVNEGKKMRCEWDGGRETHLETNFTLKSEWATHKFADCKAKRDTPTSCTVDYSTVYFVNIEVWVEAENALGKVTSDHINFDPVYKVKPNPPHNLSVINSEELSSILKLTWTNPSIKSVIILKYNIQYRTKDASTWSQIPPEDTASTRSSFTVQDLKPFTEYVFRIRCMKEDGKGYWSDWSEEASGITYEDRPSKAPSFWYKIDPSHTQGYRTVQLVWKTLPPFEANGKILDYEVTLTRWKSHLQNYTVNATKLTVNLTNDRYLATLTVRNLVGKSDAAVLTIPACDFQATHPVMDLKAFPKDNMLWVEWTTPRESVKKYILEWCVLSDKAPCITDWQQEDGTVHRTYLRGNLAESKCYLITVTPVYADGPGSPESIKAYLKQAPPSKGPTVRTKKVGKNEAVLEWDQLPVDVQNGFIRNYTIFYRTIIGNETAVNVDSSHTEYTLSSLTSDTLYMVRMAAYTDEGGKDGPEFTFTTPKFAQGEIE

SEQ ID NO: 406 - protein, 256 aa, synthetic construct
  source 1..256: note = Description of Artificial Sequence: Synthetic polypeptide
QVQLQESGGGLVQPGGSLRLSCAASGFTFSSYPMSWVRQAPGKGLEWISTISAGGDTTLYADSVKGRFTSSRDNAKNTLYLQLNSLKTEDAAIYYCAKRIDCNSGYCYRRNYWGQGTQVTVSSGGGSQVQLQESGGGSVQAGGSLRLSCTASGAIASGYIDSRWCMAWFRQAPGKEREGVAAIWPGGGLTVYADSVKGRFTISRDHAKNTLYLQMNNLKPEDTAMYYCAAGSPRMCPSLEFGFDYWGQGTQVTVSS

SEQ ID NO: 407 - protein, 256 aa, synthetic construct
  source 1..256: note = Description of Artificial Sequence: Synthetic polypeptide
QVQLQESGGGLVQPGGSLRLSCAASGFTFSLSGMSWVRQAPGKGLEWVSAISSGGASTYYTDSVKGRFTISRDNAKNILYLQLNSLKTEDTAMYYCAKGGSGYGDASRMTSPGSQGTQVTVSSGGGSQVQLQESGGGSVQAGGSLRLSCTASGAIASGYIDSRWCMAWFRQAPGKEREGVAAIWPGGGLTVYADSVKGRFTISRDHAKNTLYLQMNNLKPEDTAMYYCAAGSPRMCPSLEFGFDYWGQGTQVTVSS

SEQ ID NO: 408 - protein, 253 aa, synthetic construct
  source 1..253: note = Description of Artificial Sequence: Synthetic polypeptide
QVQLQESGGGSVQAGGSLRLSCVASGYVSCDYFLPSWYRQAPGKEREFVSIIDGTGSTSYAASVKGRFTASEDKGKNIAYLQMNSLKPEDTAMYYCKASCVRGRAVSEYWGQGTQVTVSSGGGSQVQLQESGGGSVQAGGSLRLSCTASGAIASGYIDSRWCMAWFRQAPGKEREGVAAIWPGGGLTVYADSVKGRFTISRDHAKNTLYLQMNNLKPEDTAMYYCAAGSPRMCPSLEFGFDYWGQGTQVTVSS

SEQ ID NO: 409 - protein, 257 aa, synthetic construct
  source 1..257: note = Description of Artificial Sequence: Synthetic polypeptide
QVQLQESGGGLVQPGESLRLSCTASGFTFSNYAMSWVRQAPGKGLEWVSGINVAYGITSYADSVKGRFTISRDNTKNTLYLQLNSLKTEDTAIYYCVKHSGTTIPRGFISYTKRGQGTQVTVSSGGGSQVQLQESGGGSVQAGGSLRLSCTASGAIASGYIDSRWCMAWFRQAPGKEREGVAAIWPGGGLTVYADSVKGRFTISRDHAKNTLYLQMNNLKPEDTAMYYCAAGSPRMCPSLEFGFDYWGQGTQVTVSS

SEQ ID NO: 410 - protein, 253 aa, synthetic construct
  source 1..253: note = Description of Artificial Sequence: Synthetic polypeptide
QVQLQESGGGSVQAGGSLRLSCTASGYVSCDYFLPSWYRQAPGKEREFVSVIDGTGSTSYAASVKGRFTASQDKGKNIAYLQMNSLKPEDTAMYYCKASCVRGRAISEYWGQGTQVTVSSGGGSQVQLQESGGGSVQAGGSLRLSCTASGAIASGYIDSRWCMAWFRQAPGKEREGVAAIWPGGGLTVYADSVKGRFTISRDHAKNTLYLQMNNLKPEDTAMYYCAAGSPRMCPSLEFGFDYWGQGTQVTVSS

SEQ ID NO: 411 - protein, 252 aa, synthetic construct
  source 1..252: note = Description of Artificial Sequence: Synthetic polypeptide
QVQLQESGGGLVQPGGSLRLSCAASGFSFSSYAMKWVRQAPGKGLEWVSTISSGGSSTNYADSVKGRFTISRDNAKNTLYLQLNSLKIEDTAMYYCAKAIVPTGATMERGQGTQVTVSSGGGSQVQLQESGGGSVQAGGSLRLSCTASGAIASGYIDSRWCMAWFRQAPGKEREGVAAIWPGGGLTVYADSVKGRFTISRDHAKNTLYLQMNNLKPEDTAMYYCAAGSPRMCPSLEFGFDYWGQGTQVTVSS

SEQ ID NO: 412 - protein, 256 aa, synthetic construct
  source 1..256: note = Description of Artificial Sequence: Synthetic polypeptide
QVQLQESGGGLVQPGGSLRLSCAASGFTFSSYPMSWVRQAPGKGLEWISTISAGGDTTLYADSVKGRFTSSRDNAKNTLYLQLNSLKTEDTAIYYCAKRIDCNSGYCYRRNYWGQGTQVTVSSGGGSQVQLQESGGGSVQAGGSLRLSCTASGAIASGYIDSRWCMAWFRQAPGKEREGVAAIWPGGGLTVYADSVKGRFTISRDHAKNTLYLQMNNLKPEDTAMYYCAAGSPRMCPSLEFGFDYWGQGTQVTVSS

SEQ ID NO: 413 - protein, 256 aa, synthetic construct
  source 1..256: note = Description of Artificial Sequence: Synthetic polypeptide
QVQLQESGGGSVQVGGSLRLSCAASGFTFSSYPMSWVRQAPGKGLEWISTISAGGDTTLYADSVKGRFTSSRDNAKNTLYLQLNSLKTEDTAIYYCAKRIDCNSGYCYRRNYWGQGTQVTVSSGGGSQVQLQESGGGSVQAGGSLRLSCTASGAIASGYIDSRWCMAWFRQAPGKEREGVAAIWPGGGLTVYADSVKGRFTISRDHAKNTLYLQMNNLKPEDTAMYYCAAGSPRMCPSLEFGFDYWGQGTQVTVSS

SEQ ID NO: 414 - protein, 261 aa, synthetic construct
  source 1..261: note = Description of Artificial Sequence: Synthetic polypeptide
QVQLQESGGGSVQSGGSLRLSCAASGFTYSTSNSWMAWFRQAPGKEREGVAAIYTVGGSIFYADSVRGRFTISQDATKNMFYLQMNTLKPEDTAMYYCAAASGRLRGKWFWPYEYNYWGQGTQVTVSSGGGSQVQLQESGGGSVQAGGSLRLSCTASGAIASGYIDSRWCMAWFRQAPGKEREGVAAIWPGGGLTVYADSVKGRFTISRDHAKNTLYLQMNNLKPEDTAMYYCAAGSPRMCPSLEFGFDYWGQGTQVTVSS

SEQ ID NO: 415 - protein, 262 aa, synthetic construct
  source 1..262: note = Description of Artificial Sequence: Synthetic polypeptide
QVQLQESGGGSVQAGGSLRLSCRASGSTYSNYCLGWFRQITGKEREGVAVINWVGGMLYFADSVKGRFTVSQDQAKNTLYLQMNSLKPEDTAMYYCAAESVSSFSCGGWLTRPDRVPYWGQGTQVTVSSGGGSQVQLQESGGGSVQAGGSLRLSCTASGAIASGYIDSRWCMAWFRQAPGKEREGVAAIWPGGGLTVYADSVKGRFTISRDHAKNTLYLQMNNLKPEDTAMYYCAAGSPRMCPSLEFGFDYWGQGTQVTVSS

SEQ ID NO: 416 - protein, 262 aa, synthetic construct
  source 1..262: note = Description of Artificial Sequence: Synthetic polypeptide
QVQLQESGGGSVQAGGSLRLSCRASGSTYSNYCLGWFRQSTGKEREGVAVINWVGGMLYFADSVKGRFTVSQDHAKNTVTLQMNSLKPEDTAMYYCAAESVSSFSCGGWLTRPGRVPYWGQGTQVTVSSGGGSQVQLQESGGGSVQAGGSLRLSCTASGAIASGYIDSRWCMAWFRQAPGKEREGVAAIWPGGGLTVYADSVKGRFTISRDHAKNTLYLQMNNLKPEDTAMYYCAAGSPRMCPSLEFGFDYWGQGTQVTVSS

SEQ ID NO: 417 - protein, 262 aa, synthetic construct
  source 1..262: note = Description of Artificial Sequence: Synthetic polypeptide
QVQLQESGGGSVQAGESLRLSCRASGSTYSNYCLGWFRQITGKEREGVAVINWVGGMLYFADSVKGRFTVSQDQAKNTVYLEMNSLKPEDTAMYYCATESVSSFSCGGWLTRPDRVPYWGQGTQVTVSSGGGSQVQLQESGGGSVQAGGSLRLSCTASGAIASGYIDSRWCMAWFRQAPGKEREGVAAIWPGGGLTVYADSVKGRFTISRDHAKNTLYLQMNNLKPEDTAMYYCAAGSPRMCPSLEFGFDYWGQGTQVTVSS

SEQ ID NO: 418 - protein, 253 aa, synthetic construct
  source 1..253: note = Description of Artificial Sequence: Synthetic polypeptide
QVQLQESGGGSVQAGGSLRLSCVASGYVSCDYFLPSWYRQAPGKEREFVSIIDGTGSTSYAASVKGRFTASQDRGKNIAYLQMNSLKPEDTAMYYCKASCVRGRTISEYWGQGTQVTVSSGGGSQVQLQESGGGSVQAGGSLRLSCTASGAIASGYIDSRWCMAWFRQAPGKEREGVAAIWPGGGLTVYADSVKGRFTISRDHAKNTLYLQMNNLKPEDTAMYYCAAGSPRMCPSLEFGFDYWGQGTQVTVSS

SEQ ID NO: 419 - protein, 253 aa, synthetic construct
  source 1..253: note = Description of Artificial Sequence: Synthetic polypeptide
QVQLQESGGGSVQAGGSLRLSCVASGYVSCDYFLPSWYRQAPGKEREFVSIIDGTGSTSYAASVKGRFTASQDKGKNIAYLQMNSLKPEDTAMYYCKASCVRGRAISEYWGQGTQVTVSSGGGSQVQLQESGGGSVQAGGSLRLSCTASGAIASGYIDSRWCMAWFRQAPGKEREGVAAIWPGGGLTVYADSVKGRFTISRDHAKNTLYLQMNNLKPEDTAMYYCAAGSPRMCPSLEFGFDYWGQGTQVTVSS

SEQ ID NO: 420 - protein, 253 aa, synthetic construct
  source 1..253: note = Description of Artificial Sequence: Synthetic polypeptide
QVQLQESGGGSVQAGGSLRLSCVASGYVSCDYFLPSWYRQAPGKEREFVSIIDGTGSTSYAASVKGRFTASQDKGKNIAYLQMNTLKPEDTAMYYCKASCVRGRAISEYWGQGTQVTVSSGGGSQVQLQESGGGSVQAGGSLRLSCTASGAIASGYIDSRWCMAWFRQAPGKEREGVAAIWPGGGLTVYADSVKGRFTISRDHAKNTLYLQMNNLKPEDTAMYYCAAGSPRMCPSLEFGFDYWGQGTQVTVSS

SEQ ID NO: 421 - protein, 262 aa, synthetic construct
  source 1..262: note = Description of Artificial Sequence: Synthetic polypeptide
QVQLQESGGGSVQAGGSLRLSCRASGSTYSNYCLGWFRQITGKEREGVAVINWVGGMLYFADSVKGRFTVSQDQAKNTVYLQMNSLKPEDTAMYYCAAESASSFSCGGWLTRPDRVPYWGQGTQVTVSSGGGSQVQLQESGGGSVQAGGSLRLSCTASGAIASGYIDSRWCMAWFRQAPGKEREGVAAIWPGGGLTVYADSVKGRFTISRDHAKNTLYLQMNNLKPEDTAMYYCAAGSPRMCPSLEFGFDYWGQGTQVTVSS

SEQ ID NO: 422 - protein, 256 aa, synthetic construct
  source 1..256: note = Description of Artificial Sequence: Synthetic polypeptide
QVQLQESGGGLVQPGGSLRLSCAASGFTFSLSGMSWVRQAPGKGLEWVSAISSGGASTYYTDSVKGRFTISRDNAKNMLYLQLNSLKTEDTAMYYCAKGGSGYGDASRMTSPGSQGTQVTVSSGGGSQVQLQESGGGSVQAGGSLRLSCTASGAIASGYIDSRWCMAWFRQAPGKEREGVAAIWPGGGLTVYADSVKGRFTISRDHAKNTLYLQMNNLKPEDTAMYYCAAGSPRMCPSLEFGFDYWGQGTQVTVSS

SEQ ID NO: 423 - protein, 253 aa, synthetic construct
  source 1..253: note = Description of Artificial Sequence: Synthetic polypeptide
QVQLQESGGGSVQAGGSLRLSCVASGYVSCDYFLPSWYRQAPGKEREFVSIIDGTGSTSYAASVKGRFTASQDKGKNIAYLQMNSLKPEDTAMYYCKASCVRGRGISEYWGQGTQVTVSSGGGSQVQLQESGGGSVQAGGSLRLSCTASGAIASGYIDSRWCMAWFRQAPGKEREGVAAIWPGGGLTVYADSVKGRFTISRDHAKNTLYLQMNNLKPEDTAMYYCAAGSPRMCPSLEFGFDYWGQGTQVTVSS

SEQ ID NO: 424 - protein, 262 aa, synthetic construct
  source 1..262: note = Description of Artificial Sequence: Synthetic polypeptide
QVQLQESGGGSVQAGGSLRLSCRASGSTYSNYCLGWFRQITGKEREGVAVINWVGGMLYFADSVKGRFTVSQDQAKNTVYLQMNSLKPEDTAMYYCAAESVSSFSCGGWLTRPDRVPYWGQGTQVTVSSGGGSQVQLQESGGGSVQAGGSLRLSCTASGAIASGYIDSRWCMAWFRQAPGKEREGVAAIWPGGGLTVYADSVKGRFTISRDHAKNTLYLQMNNLKPEDTAMYYCAAGSPRMCPSLEFGFDYWGQGTQVTVSS

SEQ ID NO: 425 - protein, 256 aa, synthetic construct
  source 1..256: note = Description of Artificial Sequence: Synthetic polypeptide
QVQLQESGGGLVQPGGSLRLSCAASGFTFSSYPMSWVRQAPGKGLEWVSTISSGGDTTLYADSVKGRFTSSRDNAKNTLYLQLNSLKTEDTAMYYCAKRIDCNSGYCYKRSYWGQGTQVTVSSGGGSQVQLQESGGGSVQAGGSLRLSCTASGAIASGYIDSRWCMAWFRQAPGKEREGVAAIWPGGGLTVYADSVKGRFTISRDHAKNTLYLQMNNLKPEDTAMYYCAAGSPRMCPSLEFGFDYWGQGTQVTVSS

SEQ ID NO: 426 - protein, 256 aa, synthetic construct
  source 1..256: note = Description of Artificial Sequence: Synthetic polypeptide
QVQLQESGGGLVQPGGSLRLSCAASGFTFSLSSMSWVRQAPGKGLEWVSAISSGGASTYYTDSVKGRFTISRDNAKNMLYLQLNSLKTEDTAMYYCAKGGSGYGDASRMTSPGSQGTQVTVSSGGGSQVQLQESGGGSVQAGGSLRLSCTASGAIASGYIDSRWCMAWFRQAPGKEREGVAAIWPGGGLTVYADSVKGRFTISRDHAKNTLYLQMNNLKPEDTAMYYCAAGSPRMCPSLEFGFDYWGQGTQVTVSS

SEQ ID NO: 427 - protein, 262 aa, synthetic construct
  source 1..262: note = Description of Artificial Sequence: Synthetic polypeptide
QVQLQESGGGSVQAGGSLRLSCRASGSTYSNYCLGWFRQTTGKEREGVAVINWVGGMLYFADSVKGRFTVSQDQAKNTVYLQMNSLKPEDTAMYYCAAESVSSFSCGGWLTRPDRVPYWGQGTQVTVSSGGGSQVQLQESGGGSVQAGGSLRLSCTASGAIASGYIDSRWCMAWFRQAPGKEREGVAAIWPGGGLTVYADSVKGRFTISRDHAKNTLYLQMNNLKPEDTAMYYCAAGSPRMCPSLEFGFDYWGQGTQVTVSS

SEQ ID NO: 428 - protein, 262 aa, synthetic construct
  source 1..262: note = Description of Artificial Sequence: Synthetic polypeptide
QVQLQESGGGSVQAGGSLRLSCRASRSPYGNYCLGWFRQSTGKEREGVAVINWVGGMLYFADSVKGRFTVSQDHAKNTVTLQMNSLKPEDTAMYYCAAESVSSFSCGGWLTRPDRVPYWGQGTQVTVSSGGGSQVQLQESGGGSVQAGGSLRLSCTASGAIASGYIDSRWCMAWFRQAPGKEREGVAAIWPGGGLTVYADSVKGRFTISRDHAKNTLYLQMNNLKPEDTAMYYCAAGSPRMCPSLEFGFDYWGQGTQVTVSS

SEQ ID NO: 429 - protein, 256 aa, synthetic construct
  source 1..256: note = Description of Artificial Sequence: Synthetic polypeptide
QVQLQESGGGLVQPGGSLRLSCAASGFTFSHSGMSWVRQAPGKGLEWVSTINSGGASTYYTDSVKGRFTISRDNAKNMLYLQLNSLKTEDTAMYYCAKGGSGYGDASRMTSPGSQGTQVTVSSGGGSQVQLQESGGGSVQAGGSLRLSCTASGAIASGYIDSRWCMAWFRQAPGKEREGVAAIWPGGGLTVYADSVKGRFTISRDHAKNTLYLQMNNLKPEDTAMYYCAAGSPRMCPSLEFGFDYWGQGTQVTVSS

SEQ ID NO: 430 - protein, 250 aa, synthetic construct
  source 1..250: note = Description of Artificial Sequence: Synthetic polypeptide
QVQLQESGGGLVQPGGSLRLSCAASGFTFSSYPMSWVRQAPGKGLEWISTISAGGDTTLYADSVKGRFTSSRDNAKNTLYLQLNSLKTEDAAIYYCAKRIDCNSGYCYRRNYWGQGTQVTVSSGGGSQVQLQESGGGSVQAGGSLRLSCTAPGFTSNSCGMDWYRQAPGKEREFVSSISTDGTTGYADSVKGRFTISKDKAKDTVYLQMNSLKPEDTGMYSCKTKDGTIATMELCDFGYWGQGTQVTVSS

SEQ ID NO: 431 - protein, 250 aa, synthetic construct
  source 1..250: note = Description of Artificial Sequence: Synthetic polypeptide
QVQLQESGGGLVQPGGSLRLSCAASGFTFSLSGMSWVRQAPGKGLEWVSAISSGGASTYYTDSVKGRFTISRDNAKNILYLQLNSLKTEDTAMYYCAKGGSGYGDASRMTSPGSQGTQVTVSSGGGSQVQLQESGGGSVQAGGSLRLSCTAPGFTSNSCGMDWYRQAPGKEREFVSSISTDGTTGYADSVKGRFTISKDKAKDTVYLQMNSLKPEDTGMYSCKTKDGTIATMELCDFGYWGQGTQVTVSS

SEQ ID NO: 432 - protein, 247 aa, synthetic construct
  source 1..247: note = Description of Artificial Sequence: Synthetic polypeptide
QVQLQESGGGSVQAGGSLRLSCVASGYVSCDYFLPSWYRQAPGKEREFVSIIDGTGSTSYAASVKGRFTASEDKGKNIAYLQMNSLKPEDTAMYYCKASCVRGRAVSEYWGQGTQVTVSSGGGSQVQLQESGGGSVQAGGSLRLSCTAPGFTSNSCGMDWYRQAPGKEREFVSSISTDGTTGYADSVKGRFTISKDKAKDTVYLQMNSLKPEDTGMYSCKTKDGTIATMELCDFGYWGQGTQVTVSS

SEQ ID NO: 433 - protein, 251 aa, synthetic construct
  source 1..251: note = Description of Artificial Sequence: Synthetic polypeptide
QVQLQESGGGLVQPGESLRLSCTASGFTFSNYAMSWVRQAPGKGLEWVSGINVAYGITSYADSVKGRFTISRDNTKNTLYLQLNSLKTEDTAIYYCVKHSGTTIPRGFISYTKRGQGTQVTVSSGGGSQVQLQESGGGSVQAGGSLRLSCTAPGFTSNSCGMDWYRQAPGKEREFVSSISTDGTTGYADSVKGRFTISKDKAKDTVYLQMNSLKPEDTGMYSCKTKDGTIATMELCDFGYWGQGTQVTVSS

SEQ ID NO: 434 - protein, 247 aa, synthetic construct
  source 1..247: note = Description of Artificial Sequence: Synthetic polypeptide
QVQLQESGGGSVQAGGSLRLSCTASGYVSCDYFLPSWYRQAPGKEREFVSVIDGTGSTSYAASVKGRFTASQDKGKNIAYLQMNSLKPEDTAMYYCKASCVRGRAISEYWGQGTQVTVSSGGGSQVQLQESGGGSVQAGGSLRLSCTAPGFTSNSCGMDWYRQAPGKEREFVSSISTDGTTGYADSVKGRFTISKDKAKDTVYLQMNSLKPEDTGMYSCKTKDGTIATMELCDFGYWGQGTQVTVSS

SEQ ID NO: 435 - protein, 246 aa, synthetic construct
  source 1..246: note = Description of Artificial Sequence: Synthetic polypeptide
QVQLQESGGGLVQPGGSLRLSCAASGFSFSSYAMKWVRQAPGKGLEWVSTISSGGSSTNYADSVKGRFTISRDNAKNTLYLQLNSLKIEDTAMYYCAKAIVPTGATMERGQGTQVTVSSGGGSQVQLQESGGGSVQAGGSLRLSCTAPGFTSNSCGMDWYRQAPGKEREFVSSISTDGTTGYADSVKGRFTISKDKAKDTVYLQMNSLKPEDTGMYSCKTKDGTIATMELCDFGYWGQGTQVTVSS

SEQ ID NO: 436 - protein, 250 aa, synthetic construct
  source 1..250: note = Description of Artificial Sequence: Synthetic polypeptide
QVQLQESGGGLVQPGGSLRLSCAASGFTFSSYPMSWVRQAPGKGLEWISTISAGGDTTLYADSVKGRFTSSRDNAKNTLYLQLNSLKTEDTAIYYCAKRIDCNSGYCYRRNYWGQGTQVTVSSGGGSQVQLQESGGGSVQAGGSLRLSCTAPGFTSNSCGMDWYRQAPGKEREFVSSISTDGTTGYADSVKGRFTISKDKAKDTVYLQMNSLKPEDTGMYSCKTKDGTIATMELCDFGYWGQGTQVTVSS

SEQ ID NO: 437 - protein, 250 aa, synthetic construct
  source 1..250: note = Description of Artificial Sequence: Synthetic polypeptide
QVQLQESGGGSVQVGGSLRLSCAASGFTFSSYPMSWVRQAPGKGLEWISTISAGGDTTLYADSVKGRFTSSRDNAKNTLYLQLNSLKTEDTAIYYCAKRIDCNSGYCYRRNYWGQGTQVTVSSGGGSQVQLQESGGGSVQAGGSLRLSCTAPGFTSNSCGMDWYRQAPGKEREFVSSISTDGTTGYADSVKGRFTISKDKAKDTVYLQMNSLKPEDTGMYSCKTKDGTIATMELCDFGYWGQGTQVTVSS

SEQ ID NO: 438 - protein, 255 aa, synthetic construct
  source 1..255: note = Description of Artificial Sequence: Synthetic polypeptide
QVQLQESGGGSVQSGGSLRLSCAASGFTYSTSNSWMAWFRQAPGKEREGVAAIYTVGGSIFYADSVRGRFTISQDATKNMFYLQMNTLKPEDTAMYYCAAASGRLRGKWFWPYEYNYWGQGTQVTVSSGGGSQVQLQESGGGSVQAGGSLRLSCTAPGFTSNSCGMDWYRQAPGKEREFVSSISTDGTTGYADSVKGRFTISKDKAKDTVYLQMNSLKPEDTGMYSCKTKDGTIATMELCDFGYWGQGTQVTVSS

SEQ ID NO: 439 - protein, 256 aa, synthetic construct
  source 1..256: note = Description of Artificial Sequence: Synthetic polypeptide
QVQLQESGGGSVQAGGSLRLSCRASGSTYSNYCLGWFRQITGKEREGVAVINWVGGMLYFADSVKGRFTVSQDQAKNTLYLQMNSLKPEDTAMYYCAAESVSSFSCGGWLTRPDRVPYWGQGTQVTVSSGGGSQVQLQESGGGSVQAGGSLRLSCTAPGFTSNSCGMDWYRQAPGKEREFVSSISTDGTTGYADSVKGRFTISKDKAKDTVYLQMNSLKPEDTGMYSCKTKDGTIATMELCDFGYWGQGTQVTVSS

SEQ ID NO: 440 - protein, 256 aa, synthetic construct
  source 1..256: note = Description of Artificial Sequence: Synthetic polypeptide
QVQLQESGGGSVQAGGSLRLSCRASGSTYSNYCLGWFRQSTGKEREGVAVINWVGGMLYFADSVKGRFTVSQDHAKNTVTLQMNSLKPEDTAMYYCAAESVSSFSCGGWLTRPGRVPYWGQGTQVTVSSGGGSQVQLQESGGGSVQAGGSLRLSCTAPGFTSNSCGMDWYRQAPGKEREFVSSISTDGTTGYADSVKGRFTISKDKAKDTVYLQMNSLKPEDTGMYSCKTKDGTIATMELCDFGYWGQGTQVTVSS

SEQ ID NO: 441 - protein, 256 aa, synthetic construct
  source 1..256: note = Description of Artificial Sequence: Synthetic polypeptide
QVQLQESGGGSVQAGESLRLSCRASGSTYSNYCLGWFRQITGKEREGVAVINWVGGMLYFADSVKGRFTVSQDQAKNTVYLEMNSLKPEDTAMYYCATESVSSFSCGGWLTRPDRVPYWGQGTQVTVSSGGGSQVQLQESGGGSVQAGGSLRLSCTAPGFTSNSCGMDWYRQAPGKEREFVSSISTDGTTGYADSVKGRFTISKDKAKDTVYLQMNSLKPEDTGMYSCKTKDGTIATMELCDFGYWGQGTQVTVSS

SEQ ID NO: 442 - protein, 247 aa, synthetic construct
  source 1..247: note = Description of Artificial Sequence: Synthetic polypeptide
QVQLQESGGGSVQAGGSLRLSCVASGYVSCDYFLPSWYRQAPGKEREFVSIIDGTGSTSYAASVKGRFTASQDRGKNIAYLQMNSLKPEDTAMYYCKASCVRGRTISEYWGQGTQVTVSSGGGSQVQLQESGGGSVQAGGSLRLSCTAPGFTSNSCGMDWYRQAPGKEREFVSSISTDGTTGYADSVKGRFTISKDKAKDTVYLQMNSLKPEDTGMYSCKTKDGTIATMELCDFGYWGQGTQVTVSS

SEQ ID NO: 443 - protein, 247 aa, synthetic construct
  source 1..247: note = Description of Artificial Sequence: Synthetic polypeptide
QVQLQESGGGSVQAGGSLRLSCVASGYVSCDYFLPSWYRQAPGKEREFVSIIDGTGSTSYAASVKGRFTASQDKGKNIAYLQMNSLKPEDTAMYYCKASCVRGRAISEYWGQGTQVTVSSGGGSQVQLQESGGGSVQAGGSLRLSCTAPGFTSNSCGMDWYRQAPGKEREFVSSISTDGTTGYADSVKGRFTISKDKAKDTVYLQMNSLKPEDTGMYSCKTKDGTIATMELCDFGYWGQGTQVTVSS

SEQ ID NO: 444 - protein, 247 aa, synthetic construct
  source 1..247: note = Description of Artificial Sequence: Synthetic polypeptide
QVQLQESGGGSVQAGGSLRLSCVASGYVSCDYFLPSWYRQAPGKEREFVSIIDGTGSTSYAASVKGRFTASQDKGKNIAYLQMNTLKPEDTAMYYCKASCVRGRAISEYWGQGTQVTVSSGGGSQVQLQESGGGSVQAGGSLRLSCTAPGFTSNSCGMDWYRQAPGKEREFVSSISTDGTTGYADSVKGRFTISKDKAKDTVYLQMNSLKPEDTGMYSCKTKDGTIATMELCDFGYWGQGTQVTVSS

SEQ ID NO: 445 - protein, 256 aa, synthetic construct
  source 1..256: note = Description of Artificial Sequence: Synthetic polypeptide
QVQLQESGGGSVQAGGSLRLSCRASGSTYSNYCLGWFRQITGKEREGVAVINWVGGMLYFADSVKGRFTVSQDQAKNTVYLQMNSLKPEDTAMYYCAAESASSFSCGGWLTRPDRVPYWGQGTQVTVSSGGGSQVQLQESGGGSVQAGGSLRLSCTAPGFTSNSCGMDWYRQAPGKEREFVSSISTDGTTGYADSVKGRFTISKDKAKDTVYLQMNSLKPEDTGMYSCKTKDGTIATMELCDFGYWGQGTQVTVSS

SEQ ID NO: 446 - protein, 250 aa, synthetic construct
  source 1..250: note = Description of Artificial Sequence: Synthetic polypeptide
QVQLQESGGGLVQPGGSLRLSCAASGFTFSLSGMSWVRQAPGKGLEWVSAISSGGASTYYTDSVKGRFTISRDNAKNMLYLQLNSLKTEDTAMYYCAKGGSGYGDASRMTSPGSQGTQVTVSSGGGSQVQLQESGGGSVQAGGSLRLSCTAPGFTSNSCGMDWYRQAPGKEREFVSSISTDGTTGYADSVKGRFTISKDKAKDTVYLQMNSLKPEDTGMYSCKTKDGTIATMELCDFGYWGQGTQVTVSS

SEQ ID NO: 447 - protein, 247 aa, synthetic construct
  source 1..247: note = Description of Artificial Sequence: Synthetic polypeptide
QVQLQESGGGSVQAGGSLRLSCVASGYVSCDYFLPSWYRQAPGKEREFVSIIDGTGSTSYAASVKGRFTASQDKGKNIAYLQMNSLKPEDTAMYYCKASCVRGRGISEYWGQGTQVTVSSGGGSQVQLQESGGGSVQAGGSLRLSCTAPGFTSNSCGMDWYRQAPGKEREFVSSISTDGTTGYADSVKGRFTISKDKAKDTVYLQMNSLKPEDTGMYSCKTKDGTIATMELCDFGYWGQGTQVTVSS

SEQ ID NO: 448 - protein, 256 aa, synthetic construct
  source 1..256: note = Description of Artificial Sequence: Synthetic polypeptide
QVQLQESGGGSVQAGGSLRLSCRASGSTYSNYCLGWFRQITGKEREGVAVINWVGGMLYFADSVKGRFTVSQDQAKNTVYLQMNSLKPEDTAMYYCAAESVSSFSCGGWLTRPDRVPYWGQGTQVTVSSGGGSQVQLQESGGGSVQAGGSLRLSCTAPGFTSNSCGMDWYRQAPGKEREFVSSISTDGTTGYADSVKGRFTISKDKAKDTVYLQMNSLKPEDTGMYSCKTKDGTIATMELCDFGYWGQGTQVTVSS

SEQ ID NO: 449 - protein, 250 aa, synthetic construct
  source 1..250: note = Description of Artificial Sequence: Synthetic polypeptide
QVQLQESGGGLVQPGGSLRLSCAASGFTFSSYPMSWVRQAPGKGLEWVSTISSGGDTTLYADSVKGRFTSSRDNAKNTLYLQLNSLKTEDTAMYYCAKRIDCNSGYCYKRSYWGQGTQVTVSSGGGSQVQLQESGGGSVQAGGSLRLSCTAPGFTSNSCGMDWYRQAPGKEREFVSSISTDGTTGYADSVKGRFTISKDKAKDTVYLQMNSLKPEDTGMYSCKTKDGTIATMELCDFGYWGQGTQVTVSS

SEQ ID NO: 450 - protein, 250 aa, synthetic construct
  source 1..250: note = Description of Artificial Sequence: Synthetic polypeptide
QVQLQESGGGLVQPGGSLRLSCAASGFTFSLSSMSWVRQAPGKGLEWVSAISSGGASTYYTDSVKGRFTISRDNAKNMLYLQLNSLKTEDTAMYYCAKGGSGYGDASRMTSPGSQGTQVTVSSGGGSQVQLQESGGGSVQAGGSLRLSCTAPGFTSNSCGMDWYRQAPGKEREFVSSISTDGTTGYADSVKGRFTISKDKAKDTVYLQMNSLKPEDTGMYSCKTKDGTIATMELCDFGYWGQGTQVTVSS

SEQ ID NO: 451 - protein, 256 aa, synthetic construct
  source 1..256: note = Description of Artificial Sequence: Synthetic polypeptide
QVQLQESGGGSVQAGGSLRLSCRASGSTYSNYCLGWFRQTTGKEREGVAVINWVGGMLYFADSVKGRFTVSQDQAKNTVYLQMNSLKPEDTAMYYCAAESVSSFSCGGWLTRPDRVPYWGQGTQVTVSSGGGSQVQLQESGGGSVQAGGSLRLSCTAPGFTSNSCGMDWYRQAPGKEREFVSSISTDGTTGYADSVKGRFTISKDKAKDTVYLQMNSLKPEDTGMYSCKTKDGTIATMELCDFGYWGQGTQVTVSS

SEQ ID NO: 452 - protein, 256 aa, synthetic construct
  source 1..256: note = Description of Artificial Sequence: Synthetic polypeptide
QVQLQESGGGSVQAGGSLRLSCRASRSPYGNYCLGWFRQSTGKEREGVAVINWVGGMLYFADSVKGRFTVSQDHAKNTVTLQMNSLKPEDTAMYYCAAESVSSFSCGGWLTRPDRVPYWGQGTQVTVSSGGGSQVQLQESGGGSVQAGGSLRLSCTAPGFTSNSCGMDWYRQAPGKEREFVSSISTDGTTGYADSVKGRFTISKDKAKDTVYLQMNSLKPEDTGMYSCKTKDGTIATMELCDFGYWGQGTQVTVSS

SEQ ID NO: 453 - protein, 250 aa, synthetic construct
  source 1..250: note = Description of Artificial Sequence: Synthetic polypeptide
QVQLQESGGGLVQPGGSLRLSCAASGFTFSHSGMSWVRQAPGKGLEWVSTINSGGASTYYTDSVKGRFTISRDNAKNMLYLQLNSLKTEDTAMYYCAKGGSGYGDASRMTSPGSQGTQVTVSSGGGSQVQLQESGGGSVQAGGSLRLSCTAPGFTSNSCGMDWYRQAPGKEREFVSSISTDGTTGYADSVKGRFTISKDKAKDTVYLQMNSLKPEDTGMYSCKTKDGTIATMELCDFGYWGQGTQVTVSS

SEQ ID NO: 454 - protein, 255 aa, synthetic construct
  source 1..255: note = Description of Artificial Sequence: Synthetic polypeptide
QVQLQESGGGLVQPGGSLRLSCAASGFTFSSYPMSWVRQAPGKGLEWISTISAGGDTTLYADSVKGRFTSSRDNAKNTLYLQLNSLKTEDAAIYYCAKRIDCNSGYCYRRNYWGQGTQVTVSSGGGSQVQLQESGGGSVQAGGSLRLSCAASGYPYSNGYMGWFRQAPGKEREGVATIYTGDGRTYYADSVKGRFTISRDNAKNTVDLQMSSLKPEDTAMYYCAARAAPLYSSGSPLTRARYNVWGQGTQVTVSS

SEQ ID NO: 455 - protein, 255 aa, synthetic construct
  source 1..255: note = Description of Artificial Sequence: Synthetic polypeptide
QVQLQESGGGLVQPGGSLRLSCAASGFTFSLSGMSWVRQAPGKGLEWVSAISSGGASTYYTDSVKGRFTISRDNAKNILYLQLNSLKTEDTAMYYCAKGGSGYGDASRMTSPGSQGTQVTVSSGGGSQVQLQESGGGSVQAGGSLRLSCAASGYPYSNGYMGWFRQAPGKEREGVATIYTGDGRTYYADSVKGRFTISRDNAKNTVDLQMSSLKPEDTAMYYCAARAAPLYSSGSPLTRARYNVWGQGTQVTVSS

SEQ ID NO: 456 - protein, 252 aa, synthetic construct
  source 1..252: note = Description of Artificial Sequence: Synthetic polypeptide
QVQLQESGGGSVQAGGSLRLSCVASGYVSCDYFLPSWYRQAPGKEREFVSIIDGTGSTSYAASVKGRFTASEDKGKNIAYLQMNSLKPEDTAMYYCKASCVRGRAVSEYWGQGTQVTVSSGGGSQVQLQESGGGSVQAGGSLRLSCAASGYPYSNGYMGWFRQAPGKEREGVATIYTGDGRTYYADSVKGRFTISRDNAKNTVDLQMSSLKPEDTAMYYCAARAAPLYSSGSPLTRARYNVWGQGTQVTVSS

SEQ ID NO: 457 - protein, 256 aa, synthetic construct
  source 1..256: note = Description of Artificial Sequence: Synthetic polypeptide
QVQLQESGGGLVQPGESLRLSCTASGFTFSNYAMSWVRQAPGKGLEWVSGINVAYGITSYADSVKGRFTISRDNTKNTLYLQLNSLKTEDTAIYYCVKHSGTTIPRGFISYTKRGQGTQVTVSSGGGSQVQLQESGGGSVQAGGSLRLSCAASGYPYSNGYMGWFRQAPGKEREGVATIYTGDGRTYYADSVKGRFTISRDNAKNTVDLQMSSLKPEDTAMYYCAARAAPLYSSGSPLTRARYNVWGQGTQVTVSS

SEQ ID NO: 458 - protein, 252 aa, synthetic construct
  source 1..252: note = Description of Artificial Sequence: Synthetic polypeptide
QVQLQESGGGSVQAGGSLRLSCTASGYVSCDYFLPSWYRQAPGKEREFVSVIDGTGSTSYAASVKGRFTASQDKGKNIAYLQMNSLKPEDTAMYYCKASCVRGRAISEYWGQGTQVTVSSGGGSQVQLQESGGGSVQAGGSLRLSCAASGYPYSNGYMGWFRQAPGKEREGVATIYTGDGRTYYADSVKGRFTISRDNAKNTVDLQMSSLKPEDTAMYYCAARAAPLYSSGSPLTRARYNVWGQGTQVTVSS

SEQ ID NO: 459 - protein, 251 aa, synthetic construct
  source 1..251: note = Description of Artificial Sequence: Synthetic polypeptide
QVQLQESGGGLVQPGGSLRLSCAASGFSFSSYAMKWVRQAPGKGLEWVSTISSGGSSTNYADSVKGRFTISRDNAKNTLYLQLNSLKIEDTAMYYCAKAIVPTGATMERGQGTQVTVSSGGGSQVQLQESGGGSVQAGGSLRLSCAASGYPYSNGYMGWFRQAPGKEREGVATIYTGDGRTYYADSVKGRFTISRDNAKNTVDLQMSSLKPEDTAMYYCAARAAPLYSSGSPLTRARYNVWGQGTQVTVSS

SEQ ID NO: 460 - protein, 255 aa, synthetic construct
  source 1..255: note = Description of Artificial Sequence: Synthetic polypeptide
QVQLQESGGGLVQPGGSLRLSCAASGFTFSSYPMSWVRQAPGKGLEWISTISAGGDTTLYADSVKGRFTSSRDNAKNTLYLQLNSLKTEDTAIYYCAKRIDCNSGYCYRRNYWGQGTQVTVSSGGGSQVQLQESGGGSVQAGGSLRLSCAASGYPYSNGYMGWFRQAPGKEREGVATIYTGDGRTYYADSVKGRFTISRDNAKNTVDLQMSSLKPEDTAMYYCAARAAPLYSSGSPLTRARYNVWGQGTQVTVSS

SEQ ID NO: 461 - protein, 255 aa, synthetic construct
  source 1..255: note = Description of Artificial Sequence: Synthetic polypeptide
QVQLQESGGGSVQVGGSLRLSCAASGFTFSSYPMSWVRQAPGKGLEWISTISAGGDTTLYADSVKGRFTSSRDNAKNTLYLQLNSLKTEDTAIYYCAKRIDCNSGYCYRRNYWGQGTQVTVSSGGGSQVQLQESGGGSVQAGGSLRLSCAASGYPYSNGYMGWFRQAPGKEREGVATIYTGDGRTYYADSVKGRFTISRDNAKNTVDLQMSSLKPEDTAMYYCAARAAPLYSSGSPLTRARYNVWGQGTQVTVSS

SEQ ID NO: 462 - protein, 260 aa, synthetic construct
  source 1..260: note = Description of Artificial Sequence: Synthetic polypeptide
QVQLQESGGGSVQSGGSLRLSCAASGFTYSTSNSWMAWFRQAPGKEREGVAAIYTVGGSIFYADSVRGRFTISQDATKNMFYLQMNTLKPEDTAMYYCAAASGRLRGKWFWPYEYNYWGQGTQVTVSSGGGSQVQLQESGGGSVQAGGSLRLSCAASGYPYSNGYMGWFRQAPGKEREGVATIYTGDGRTYYADSVKGRFTISRDNAKNTVDLQMSSLKPEDTAMYYCAARAAPLYSSGSPLTRARYNVWGQGTQVTVSS

SEQ ID NO: 463 - protein, 261 aa, synthetic construct
  source 1..261: note = Description of Artificial Sequence: Synthetic polypeptide
QVQLQESGGGSVQAGGSLRLSCRASGSTYSNYCLGWFRQITGKEREGVAVINWVGGMLYFADSVKGRFTVSQDQAKNTLYLQMNSLKPEDTAMYYCAAESVSSFSCGGWLTRPDRVPYWGQGTQVTVSSGGGSQVQLQESGGGSVQAGGSLRLSCAASGYPYSNGYMGWFRQAPGKEREGVATIYTGDGRTYYADSVKGRFTISRDNAKNTVDLQMSSLKPEDTAMYYCAARAAPLYSSGSPLTRARYNVWGQGTQVTVSS

SEQ ID NO: 464 - protein, 261 aa, synthetic construct
  source 1..261: note = Description of Artificial Sequence: Synthetic polypeptide
QVQLQESGGGSVQAGGSLRLSCRASGSTYSNYCLGWFRQSTGKEREGVAVINWVGGMLYFADSVKGRFTVSQDHAKNTVTLQMNSLKPEDTAMYYCAAESVSSFSCGGWLTRPGRVPYWGQGTQVTVSSGGGSQVQLQESGGGSVQAGGSLRLSCAASGYPYSNGYMGWFRQAPGKEREGVATIYTGDGRTYYADSVKGRFTISRDNAKNTVDLQMSSLKPEDTAMYYCAARAAPLYSSGSPLTRARYNVWGQGTQVTVSS

SEQ ID NO: 465 - protein, 261 aa, synthetic construct
  source 1..261: note = Description of Artificial Sequence: Synthetic polypeptide
QVQLQESGGGSVQAGESLRLSCRASGSTYSNYCLGWFRQITGKEREGVAVINWVGGMLYFADSVKGRFTVSQDQAKNTVYLEMNSLKPEDTAMYYCATESVSSFSCGGWLTRPDRVPYWGQGTQVTVSSGGGSQVQLQESGGGSVQAGGSLRLSCAASGYPYSNGYMGWFRQAPGKEREGVATIYTGDGRTYYADSVKGRFTISRDNAKNTVDLQMSSLKPEDTAMYYCAARAAPLYSSGSPLTRARYNVWGQGTQVTVSS

SEQ ID NO: 466 - protein, 252 aa, synthetic construct
  source 1..252: note = Description of Artificial Sequence: Synthetic polypeptide
QVQLQESGGGSVQAGGSLRLSCVASGYVSCDYFLPSWYRQAPGKEREFVSIIDGTGSTSYAASVKGRFTASQDRGKNIAYLQMNSLKPEDTAMYYCKASCVRGRTISEYWGQGTQVTVSSGGGSQVQLQESGGGSVQAGGSLRLSCAASGYPYSNGYMGWFRQAPGKEREGVATIYTGDGRTYYADSVKGRFTISRDNAKNTVDLQMSSLKPEDTAMYYCAARAAPLYSSGSPLTRARYNVWGQGTQVTVSS

SEQ ID NO: 467 - protein, 252 aa, synthetic construct
  source 1..252: note = Description of Artificial Sequence: Synthetic polypeptide
QVQLQESGGGSVQAGGSLRLSCVASGYVSCDYFLPSWYRQAPGKEREFVSIIDGTGSTSYAASVKGRFTASQDKGKNIAYLQMNSLKPEDTAMYYCKASCVRGRAISEYWGQGTQVTVSSGGGSQVQLQESGGGSVQAGGSLRLSCAASGYPYSNGYMGWFRQAPGKEREGVATIYTGDGRTYYADSVKGRFTISRDNAKNTVDLQMSSLKPEDTAMYYCAARAAPLYSSGSPLTRARYNVWGQGTQVTVSS

SEQ ID NO: 468 - protein, 252 aa, synthetic construct
  source 1..252: note = Description of Artificial Sequence: Synthetic polypeptide
QVQLQESGGGSVQAGGSLRLSCVASGYVSCDYFLPSWYRQAPGKEREFVSIIDGTGSTSYAASVKGRFTASQDKGKNIAYLQMNTLKPEDTAMYYCKASCVRGRAISEYWGQGTQVTVSSGGGSQVQLQESGGGSVQAGGSLRLSCAASGYPYSNGYMGWFRQAPGKEREGVATIYTGDGRTYYADSVKGRFTISRDNAKNTVDLQMSSLKPEDTAMYYCAARAAPLYSSGSPLTRARYNVWGQGTQVTVSS

SEQ ID NO: 469 - protein, 261 aa, synthetic construct
  source 1..261: note = Description of Artificial Sequence: Synthetic polypeptide
QVQLQESGGGSVQAGGSLRLSCRASGSTYSNYCLGWFRQITGKEREGVAVINWVGGMLYFADSVKGRFTVSQDQAKNTVYLQMNSLKPEDTAMYYCAAESASSFSCGGWLTRPDRVPYWGQGTQVTVSSGGGSQVQLQESGGGSVQAGGSLRLSCAASGYPYSNGYMGWFRQAPGKEREGVATIYTGDGRTYYADSVKGRFTISRDNAKNTVDLQMSSLKPEDTAMYYCAARAAPLYSSGSPLTRARYNVWGQGTQVTVSS

SEQ ID NO: 470 - protein, 255 aa, synthetic construct
  source 1..255: note = Description of Artificial Sequence: Synthetic polypeptide
QVQLQESGGGLVQPGGSLRLSCAASGFTFSLSGMSWVRQAPGKGLEWVSAISSGGASTYYTDSVKGRFTISRDNAKNMLYLQLNSLKTEDTAMYYCAKGGSGYGDASRMTSPGSQGTQVTVSSGGGSQVQLQESGGGSVQAGGSLRLSCAASGYPYSNGYMGWFRQAPGKEREGVATIYTGDGRTYYADSVKGRFTISRDNAKNTVDLQMSSLKPEDTAMYYCAARAAPLYSSGSPLTRARYNVWGQGTQVTVSS

SEQ ID NO: 471 - protein, 252 aa, synthetic construct
  source 1..252: note = Description of Artificial Sequence: Synthetic polypeptide
QVQLQESGGGSVQAGGSLRLSCVASGYVSCDYFLPSWYRQAPGKEREFVSIIDGTGSTSYAASVKGRFTASQDKGKNIAYLQMNSLKPEDTAMYYCKASCVRGRGISEYWGQGTQVTVSSGGGSQVQLQESGGGSVQAGGSLRLSCAASGYPYSNGYMGWFRQAPGKEREGVATIYTGDGRTYYADSVKGRFTISRDNAKNTVDLQMSSLKPEDTAMYYCAARAAPLYSSGSPLTRARYNVWGQGTQVTVSS

SEQ ID NO: 472 - protein, 261 aa, synthetic construct
  source 1..261: note = Description of Artificial Sequence: Synthetic polypeptide
QVQLQESGGGSVQAGGSLRLSCRASGSTYSNYCLGWFRQITGKEREGVAVINWVGGMLYFADSVKGRFTVSQDQAKNTVYLQMNSLKPEDTAMYYCAAESVSSFSCGGWLTRPDRVPYWGQGTQVTVSSGGGSQVQLQESGGGSVQAGGSLRLSCAASGYPYSNGYMGWFRQAPGKEREGVATIYTGDGRTYYADSVKGRFTISRDNAKNTVDLQMSSLKPEDTAMYYCAARAAPLYSSGSPLTRARYNVWGQGTQVTVSS

SEQ ID NO: 473 - protein, 255 aa, synthetic construct
  source 1..255: note = Description of Artificial Sequence: Synthetic polypeptide
QVQLQESGGGLVQPGGSLRLSCAASGFTFSSYPMSWVRQAPGKGLEWVSTISSGGDTTLYADSVKGRFTSSRDNAKNTLYLQLNSLKTEDTAMYYCAKRIDCNSGYCYKRSYWGQGTQVTVSSGGGSQVQLQESGGGSVQAGGSLRLSCAASGYPYSNGYMGWFRQAPGKEREGVATIYTGDGRTYYADSVKGRFTISRDNAKNTVDLQMSSLKPEDTAMYYCAARAAPLYSSGSPLTRARYNVWGQGTQVTVSS

SEQ ID NO: 474 - protein, 255 aa, synthetic construct
  source 1..255: note = Description of Artificial Sequence: Synthetic polypeptide
QVQLQESGGGLVQPGGSLRLSCAASGFTFSLSSMSWVRQAPGKGLEWVSAISSGGASTYYTDSVKGRFTISRDNAKNMLYLQLNSLKTEDTAMYYCAKGGSGYGDASRMTSPGSQGTQVTVSSGGGSQVQLQESGGGSVQAGGSLRLSCAASGYPYSNGYMGWFRQAPGKEREGVATIYTGDGRTYYADSVKGRFTISRDNAKNTVDLQMSSLKPEDTAMYYCAARAAPLYSSGSPLTRARYNVWGQGTQVTVSS

SEQ ID NO: 475 - protein, 261 aa, synthetic construct
  source 1..261: note = Description of Artificial Sequence: Synthetic polypeptide
QVQLQESGGGSVQAGGSLRLSCRASGSTYSNYCLGWFRQTTGKEREGVAVINWVGGMLYFADSVKGRFTVSQDQAKNTVYLQMNSLKPEDTAMYYCAAESVSSFSCGGWLTRPDRVPYWGQGTQVTVSSGGGSQVQLQESGGGSVQAGGSLRLSCAASGYPYSNGYMGWFRQAPGKEREGVATIYTGDGRTYYADSVKGRFTISRDNAKNTVDLQMSSLKPEDTAMYYCAARAAPLYSSGSPLTRARYNVWGQGTQVTVSS

SEQ ID NO: 476 - protein, 261 aa, synthetic construct
  source 1..261: note = Description of Artificial Sequence: Synthetic polypeptide
QVQLQESGGGSVQAGGSLRLSCRASRSPYGNYCLGWFRQSTGKEREGVAVINWVGGMLYFADSVKGRFTVSQDHAKNTVTLQMNSLKPEDTAMYYCAAESVSSFSCGGWLTRPDRVPYWGQGTQVTVSSGGGSQVQLQESGGGSVQAGGSLRLSCAASGYPYSNGYMGWFRQAPGKEREGVATIYTGDGRTYYADSVKGRFTISRDNAKNTVDLQMSSLKPEDTAMYYCAARAAPLYSSGSPLTRARYNVWGQGTQVTVSS

SEQ ID NO: 477 - protein, 255 aa, synthetic construct
  source 1..255: note = Description of Artificial Sequence: Synthetic polypeptide
QVQLQESGGGLVQPGGSLRLSCAASGFTFSHSGMSWVRQAPGKGLEWVSTINSGGASTYYTDSVKGRFTISRDNAKNMLYLQLNSLKTEDTAMYYCAKGGSGYGDASRMTSPGSQGTQVTVSSGGGSQVQLQESGGGSVQAGGSLRLSCAASGYPYSNGYMGWFRQAPGKEREGVATIYTGDGRTYYADSVKGRFTISRDNAKNTVDLQMSSLKPEDTAMYYCAARAAPLYSSGSPLTRARYNVWGQGTQVTVSS

SEQ ID NO: 478 - protein, 246 aa, synthetic construct
  source 1..246: note = Description of Artificial Sequence: Synthetic polypeptide
QVQLQESGGGLVQPGGSLRLSCAASGFTFSSYPMSWVRQAPGKGLEWISTISAGGDTTLYADSVKGRFTSSRDNAKNTLYLQLNSLKTEDAAIYYCAKRIDCNSGYCYRRNYWGQGTQVTVSSGGGSQVQLQESGGGSVQAGGSLRLSCVASASTYCTYDMHWYRQAPGKGREFVSAIDSDGTTRYADSVKGRFTISQGTAKNTVYLQMNSLQPEDTAMYYCKTVCVVGSRWSDYWGQGTQVTVSS

SEQ ID NO: 479 - protein, 246 aa, synthetic construct
  source 1..246: note = Description of Artificial Sequence: Synthetic polypeptide
QVQLQESGGGLVQPGGSLRLSCAASGFTFSLSGMSWVRQAPGKGLEWVSAISSGGASTYYTDSVKGRFTISRDNAKNILYLQLNSLKTEDTAMYYCAKGGSGYGDASRMTSPGSQGTQVTVSSGGGSQVQLQESGGGSVQAGGSLRLSCVASASTYCTYDMHWYRQAPGKGREFVSAIDSDGTTRYADSVKGRFTISQGTAKNTVYLQMNSLQPEDTAMYYCKTVCVVGSRWSDYWGQGTQVTVSS

SEQ ID NO: 480 - protein, 243 aa, synthetic construct
  source 1..243: note = Description of Artificial Sequence: Synthetic polypeptide
QVQLQESGGGSVQAGGSLRLSCVASGYVSCDYFLPSWYRQAPGKEREFVSIIDGTGSTSYAASVKGRFTASEDKGKNIAYLQMNSLKPEDTAMYYCKASCVRGRAVSEYWGQGTQVTVSSGGGSQVQLQESGGGSVQAGGSLRLSCVASASTYCTYDMHWYRQAPGKGREFVSAIDSDGTTRYADSVKGRFTISQGTAKNTVYLQMNSLQPEDTAMYYCKTVCVVGSRWSDYWGQGTQVTVSS

SEQ ID NO: 481 - protein, 247 aa, synthetic construct
  source 1..247: note = Description of Artificial Sequence: Synthetic polypeptide
QVQLQESGGGLVQPGESLRLSCTASGFTFSNYAMSWVRQAPGKGLEWVSGINVAYGITSYADSVKGRFTISRDNTKNTLYLQLNSLKTEDTAIYYCVKHSGTTIPRGFISYTKRGQGTQVTVSSGGGSQVQLQESGGGSVQAGGSLRLSCVASASTYCTYDMHWYRQAPGKGREFVSAIDSDGTTRYADSVKGRFTISQGTAKNTVYLQMNSLQPEDTAMYYCKTVCVVGSRWSDYWGQGTQVTVSS

SEQ ID NO: 482 - protein, 243 aa, synthetic construct
  source 1..243: note = Description of Artificial Sequence: Synthetic polypeptide
QVQLQESGGGSVQAGGSLRLSCTASGYVSCDYFLPSWYRQAPGKEREFVSVIDGTGSTSYAASVKGRFTASQDKGKNIAYLQMNSLKPEDTAMYYCKASCVRGRAISEYWGQGTQVTVSSGGGSQVQLQESGGGSVQAGGSLRLSCVASASTYCTYDMHWYRQAPGKGREFVSAIDSDGTTRYADSVKGRFTISQGTAKNTVYLQMNSLQPEDTAMYYCKTVCVVGSRWSDYWGQGTQVTVSS

SEQ ID NO: 483 - protein, 242 aa, synthetic construct
  source 1..242: note = Description of Artificial Sequence: Synthetic polypeptide
QVQLQESGGGLVQPGGSLRLSCAASGFSFSSYAMKWVRQAPGKGLEWVSTISSGGSSTNYADSVKGRFTISRDNAKNTLYLQLNSLKIEDTAMYYCAKAIVPTGATMERGQGTQVTVSSGGGSQVQLQESGGGSVQAGGSLRLSCVASASTYCTYDMHWYRQAPGKGREFVSAIDSDGTTRYADSVKGRFTISQGTAKNTVYLQMNSLQPEDTAMYYCKTVCVVGSRWSDYWGQGTQVTVSS

SEQ ID NO: 484 - protein, 246 aa, synthetic construct
  source 1..246: note = Description of Artificial Sequence: Synthetic polypeptide
QVQLQESGGGLVQPGGSLRLSCAASGFTFSSYPMSWVRQAPGKGLEWISTISAGGDTTLYADSVKGRFTSSRDNAKNTLYLQLNSLKTEDTAIYYCAKRIDCNSGYCYRRNYWGQGTQVTVSSGGGSQVQLQESGGGSVQAGGSLRLSCVASASTYCTYDMHWYRQAPGKGREFVSAIDSDGTTRYADSVKGRFTISQGTAKNTVYLQMNSLQPEDTAMYYCKTVCVVGSRWSDYWGQGTQVTVSS

SEQ ID NO: 485 - protein, 246 aa, synthetic construct
  source 1..246: note = Description of Artificial Sequence: Synthetic polypeptide
QVQLQESGGGSVQVGGSLRLSCAASGFTFSSYPMSWVRQAPGKGLEWISTISAGGDTTLYADSVKGRFTSSRDNAKNTLYLQLNSLKTEDTAIYYCAKRIDCNSGYCYRRNYWGQGTQVTVSSGGGSQVQLQESGGGSVQAGGSLRLSCVASASTYCTYDMHWYRQAPGKGREFVSAIDSDGTTRYADSVKGRFTISQGTAKNTVYLQMNSLQPEDTAMYYCKTVCVVGSRWSDYWGQGTQVTVSS

SEQ ID NO: 486 - protein, 251 aa, synthetic construct
  source 1..251: note = Description of Artificial Sequence: Synthetic polypeptide
QVQLQESGGGSVQSGGSLRLSCAASGFTYSTSNSWMAWFRQAPGKEREGVAAIYTVGGSIFYADSVRGRFTISQDATKNMFYLQMNTLKPEDTAMYYCAAASGRLRGKWFWPYEYNYWGQGTQVTVSSGGGSQVQLQESGGGSVQAGGSLRLSCVASASTYCTYDMHWYRQAPGKGREFVSAIDSDGTTRYADSVKGRFTISQGTAKNTVYLQMNSLQPEDTAMYYCKTVCVVGSRWSDYWGQGTQVTVSS

SEQ ID NO: 487 - protein, 252 aa, synthetic construct
  source 1..252: note = Description of Artificial Sequence: Synthetic polypeptide
QVQLQESGGGSVQAGGSLRLSCRASGSTYSNYCLGWFRQITGKEREGVAVINWVGGMLYFADSVKGRFTVSQDQAKNTLYLQMNSLKPEDTAMYYCAAESVSSFSCGGWLTRPDRVPYWGQGTQVTVSSGGGSQVQLQESGGGSVQAGGSLRLSCVASASTYCTYDMHWYRQAPGKGREFVSAIDSDGTTRYADSVKGRFTISQGTAKNTVYLQMNSLQPEDTAMYYCKTVCVVGSRWSDYWGQGTQVTVSS

SEQ ID NO: 488 - protein, 252 aa, synthetic construct
  source 1..252: note = Description of Artificial Sequence: Synthetic polypeptide
QVQLQESGGGSVQAGGSLRLSCRASGSTYSNYCLGWFRQSTGKEREGVAVINWVGGMLYFADSVKGRFTVSQDHAKNTVTLQMNSLKPEDTAMYYCAAESVSSFSCGGWLTRPGRVPYWGQGTQVTVSSGGGSQVQLQESGGGSVQAGGSLRLSCVASASTYCTYDMHWYRQAPGKGREFVSAIDSDGTTRYADSVKGRFTISQGTAKNTVYLQMNSLQPEDTAMYYCKTVCVVGSRWSDYWGQGTQVTVSS

SEQ ID NO: 489 - protein, 252 aa, synthetic construct
  source 1..252: note = Description of Artificial Sequence: Synthetic polypeptide
QVQLQESGGGSVQAGESLRLSCRASGSTYSNYCLGWFRQITGKEREGVAVINWVGGMLYFADSVKGRFTVSQDQAKNTVYLEMNSLKPEDTAMYYCATESVSSFSCGGWLTRPDRVPYWGQGTQVTVSSGGGSQVQLQESGGGSVQAGGSLRLSCVASASTYCTYDMHWYRQAPGKGREFVSAIDSDGTTRYADSVKGRFTISQGTAKNTVYLQMNSLQPEDTAMYYCKTVCVVGSRWSDYWGQGTQVTVSS

SEQ ID NO: 490 - protein, 243 aa, synthetic construct
  source 1..243: note = Description of Artificial Sequence: Synthetic polypeptide
QVQLQESGGGSVQAGGSLRLSCVASGYVSCDYFLPSWYRQAPGKEREFVSIIDGTGSTSYAASVKGRFTASQDRGKNIAYLQMNSLKPEDTAMYYCKASCVRGRTISEYWGQGTQVTVSSGGGSQVQLQESGGGSVQAGGSLRLSCVASASTYCTYDMHWYRQAPGKGREFVSAIDSDGTTRYADSVKGRFTISQGTAKNTVYLQMNSLQPEDTAMYYCKTVCVVGSRWSDYWGQGTQVTVSS

SEQ ID NO: 491 - protein, 243 aa, synthetic construct
  source 1..243: note = Description of Artificial Sequence: Synthetic polypeptide
QVQLQESGGGSVQAGGSLRLSCVASGYVSCDYFLPSWYRQAPGKEREFVSIIDGTGSTSYAASVKGRFTASQDKGKNIAYLQMNSLKPEDTAMYYCKASCVRGRAISEYWGQGTQVTVSSGGGSQVQLQESGGGSVQAGGSLRLSCVASASTYCTYDMHWYRQAPGKGREFVSAIDSDGTTRYADSVKGRFTISQGTAKNTVYLQMNSLQPEDTAMYYCKTVCVVGSRWSDYWGQGTQVTVSS

SEQ ID NO: 492 - protein, 243 aa, synthetic construct
  source 1..243: note = Description of Artificial Sequence: Synthetic polypeptide
QVQLQESGGGSVQAGGSLRLSCVASGYVSCDYFLPSWYRQAPGKEREFVSIIDGTGSTSYAASVKGRFTASQDKGKNIAYLQMNTLKPEDTAMYYCKASCVRGRAISEYWGQGTQVTVSSGGGSQVQLQESGGGSVQAGGSLRLSCVASASTYCTYDMHWYRQAPGKGREFVSAIDSDGTTRYADSVKGRFTISQGTAKNTVYLQMNSLQPEDTAMYYCKTVCVVGSRWSDYWGQGTQVTVSS

SEQ ID NO: 493 - protein, 252 aa, synthetic construct
  source 1..252: note = Description of Artificial Sequence: Synthetic polypeptide
QVQLQESGGGSVQAGGSLRLSCRASGSTYSNYCLGWFRQITGKEREGVAVINWVGGMLYFADSVKGRFTVSQDQAKNTVYLQMNSLKPEDTAMYYCAAESASSFSCGGWLTRPDRVPYWGQGTQVTVSSGGGSQVQLQESGGGSVQAGGSLRLSCVASASTYCTYDMHWYRQAPGKGREFVSAIDSDGTTRYADSVKGRFTISQGTAKNTVYLQMNSLQPEDTAMYYCKTVCVVGSRWSDYWGQGTQVTVSS

SEQ ID NO: 494 - protein, 246 aa, synthetic construct
  source 1..246: note = Description of Artificial Sequence: Synthetic polypeptide
QVQLQESGGGLVQPGGSLRLSCAASGFTFSLSGMSWVRQAPGKGLEWVSAISSGGASTYYTDSVKGRFTISRDNAKNMLYLQLNSLKTEDTAMYYCAKGGSGYGDASRMTSPGSQGTQVTVSSGGGSQVQLQESGGGSVQAGGSLRLSCVASASTYCTYDMHWYRQAPGKGREFVSAIDSDGTTRYADSVKGRFTISQGTAKNTVYLQMNSLQPEDTAMYYCKTVCVVGSRWSDYWGQGTQVTVSS

SEQ ID NO: 495 - protein, 243 aa, synthetic construct
  source 1..243: note = Description of Artificial Sequence: Synthetic polypeptide
QVQLQESGGGSVQAGGSLRLSCVASGYVSCDYFLPSWYRQAPGKEREFVSIIDGTGSTSYAASVKGRFTASQDKGKNIAYLQMNSLKPEDTAMYYCKASCVRGRGISEYWGQGTQVTVSSGGGSQVQLQESGGGSVQAGGSLRLSCVASASTYCTYDMHWYRQAPGKGREFVSAIDSDGTTRYADSVKGRFTISQGTAKNTVYLQMNSLQPEDTAMYYCKTVCVVGSRWSDYWGQGTQVTVSS

SEQ ID NO: 496 - protein, 252 aa, synthetic construct
  source 1..252: note = Description of Artificial Sequence: Synthetic polypeptide
QVQLQESGGGSVQAGGSLRLSCRASGSTYSNYCLGWFRQITGKEREGVAVINWVGGMLYFADSVKGRFTVSQDQAKNTVYLQMNSLKPEDTAMYYCAAESVSSFSCGGWLTRPDRVPYWGQGTQVTVSSGGGSQVQLQESGGGSVQAGGSLRLSCVASASTYCTYDMHWYRQAPGKGREFVSAIDSDGTTRYADSVKGRFTISQGTAKNTVYLQMNSLQPEDTAMYYCKTVCVVGSRWSDYWGQGTQVTVSS

SEQ ID NO: 497 - protein, 246 aa, synthetic construct
  source 1..246: note = Description of Artificial Sequence: Synthetic polypeptide
QVQLQESGGGLVQPGGSLRLSCAASGFTFSSYPMSWVRQAPGKGLEWVSTISSGGDTTLYADSVKGRFTSSRDNAKNTLYLQLNSLKTEDTAMYYCAKRIDCNSGYCYKRSYWGQGTQVTVSSGGGSQVQLQESGGGSVQAGGSLRLSCVASASTYCTYDMHWYRQAPGKGREFVSAIDSDGTTRYADSVKGRFTISQGTAKNTVYLQMNSLQPEDTAMYYCKTVCVVGSRWSDYWGQGTQVTVSS

SEQ ID NO: 498 - protein, 246 aa, synthetic construct
  source 1..246: note = Description of Artificial Sequence: Synthetic polypeptide
QVQLQESGGGLVQPGGSLRLSCAASGFTFSLSSMSWVRQAPGKGLEWVSAISSGGASTYYTDSVKGRFTISRDNAKNMLYLQLNSLKTEDTAMYYCAKGGSGYGDASRMTSPGSQGTQVTVSSGGGSQVQLQESGGGSVQAGGSLRLSCVASASTYCTYDMHWYRQAPGKGREFVSAIDSDGTTRYADSVKGRFTISQGTAKNTVYLQMNSLQPEDTAMYYCKTVCVVGSRWSDYWGQGTQVTVSS

SEQ ID NO: 499 - protein, 252 aa, synthetic construct
  source 1..252: note = Description of Artificial Sequence: Synthetic polypeptide
QVQLQESGGGSVQAGGSLRLSCRASGSTYSNYCLGWFRQTTGKEREGVAVINWVGGMLYFADSVKGRFTVSQDQAKNTVYLQMNSLKPEDTAMYYCAAESVSSFSCGGWLTRPDRVPYWGQGTQVTVSSGGGSQVQLQESGGGSVQAGGSLRLSCVASASTYCTYDMHWYRQAPGKGREFVSAIDSDGTTRYADSVKGRFTISQGTAKNTVYLQMNSLQPEDTAMYYCKTVCVVGSRWSDYWGQGTQVTVSS

SEQ ID NO: 500 - protein, 252 aa, synthetic construct
  source 1..252: note = Description of Artificial Sequence: Synthetic polypeptide
QVQLQESGGGSVQAGGSLRLSCRASRSPYGNYCLGWFRQSTGKEREGVAVINWVGGMLYFADSVKGRFTVSQDHAKNTVTLQMNSLKPEDTAMYYCAAESVSSFSCGGWLTRPDRVPYWGQGTQVTVSSGGGSQVQLQESGGGSVQAGGSLRLSCVASASTYCTYDMHWYRQAPGKGREFVSAIDSDGTTRYADSVKGRFTISQGTAKNTVYLQMNSLQPEDTAMYYCKTVCVVGSRWSDYWGQGTQVTVSS

SEQ ID NO: 501 - protein, 246 aa, synthetic construct
  source 1..246: note = Description of Artificial Sequence: Synthetic polypeptide
QVQLQESGGGLVQPGGSLRLSCAASGFTFSHSGMSWVRQAPGKGLEWVSTINSGGASTYYTDSVKGRFTISRDNAKNMLYLQLNSLKTEDTAMYYCAKGGSGYGDASRMTSPGSQGTQVTVSSGGGSQVQLQESGGGSVQAGGSLRLSCVASASTYCTYDMHWYRQAPGKGREFVSAIDSDGTTRYADSVKGRFTISQGTAKNTVYLQMNSLQPEDTAMYYCKTVCVVGSRWSDYWGQGTQVTVSS

SEQ ID NO: 502 - protein, 244 aa, synthetic construct
  source 1..244: note = Description of Artificial Sequence: Synthetic polypeptide
QVQLQESGGGLVQPGGSLRLSCAASGFTFSSYPMSWVRQAPGKGLEWISTISAGGDTTLYADSVKGRFTSSRDNAKNTLYLQLNSLKTEDAAIYYCAKRIDCNSGYCYRRNYWGQGTQVTVSSGGGSQVQLQESGGGSVQAGGSLTLSCAASEYAYSTCNMGWYRQAPGKERELVSAFISDGSTYYADSVKGRFTITRDNAKNTVYLQMNSLKPEDTAIYYCSANCYRRLRNYWGQGTQVTVSS

SEQ ID NO: 503 - protein, 244 aa, synthetic construct
  source 1..244: note = Description of Artificial Sequence: Synthetic polypeptide
QVQLQESGGGLVQPGGSLRLSCAASGFTFSLSGMSWVRQAPGKGLEWVSAISSGGASTYYTDSVKGRFTISRDNAKNILYLQLNSLKTEDTAMYYCAKGGSGYGDASRMTSPGSQGTQVTVSSGGGSQVQLQESGGGSVQAGGSLTLSCAASEYAYSTCNMGWYRQAPGKERELVSAFISDGSTYYADSVKGRFTITRDNAKNTVYLQMNSLKPEDTAIYYCSANCYRRLRNYWGQGTQVTVSS

SEQ ID NO: 504 - protein, 241 aa, synthetic construct
  source 1..241: note = Description of Artificial Sequence: Synthetic polypeptide
QVQLQESGGGSVQAGGSLRLSCVASGYVSCDYFLPSWYRQAPGKEREFVSIIDGTGSTSYAASVKGRFTASEDKGKNIAYLQMNSLKPEDTAMYYCKASCVRGRAVSEYWGQGTQVTVSSGGGSQVQLQESGGGSVQAGGSLTLSCAASEYAYSTCNMGWYRQAPGKERELVSAFISDGSTYYADSVKGRFTITRDNAKNTVYLQMNSLKPEDTAIYYCSANCYRRLRNYWGQGTQVTVSS

SEQ ID NO: 505 - protein, 245 aa, synthetic construct
  source 1..245: note = Description of Artificial Sequence: Synthetic polypeptide
QVQLQESGGGLVQPGESLRLSCTASGFTFSNYAMSWVRQAPGKGLEWVSGINVAYGITSYADSVKGRFTISRDNTKNTLYLQLNSLKTEDTAIYYCVKHSGTTIPRGFISYTKRGQGTQVTVSSGGGSQVQLQESGGGSVQAGGSLTLSCAASEYAYSTCNMGWYRQAPGKERELVSAFISDGSTYYADSVKGRFTITRDNAKNTVYLQMNSLKPEDTAIYYCSANCYRRLRNYWGQGTQVTVSS

SEQ ID NO: 506 - protein, 241 aa, synthetic construct
  source 1..241: note = Description of Artificial Sequence: Synthetic polypeptide
QVQLQESGGGSVQAGGSLRLSCTASGYVSCDYFLPSWYRQAPGKEREFVSVIDGTGSTSYAASVKGRFTASQDKGKNIAYLQMNSLKPEDTAMYYCKASCVRGRAISEYWGQGTQVTVSSGGGSQVQLQESGGGSVQAGGSLTLSCAASEYAYSTCNMGWYRQAPGKERELVSAFISDGSTYYADSVKGRFTITRDNAKNTVYLQMNSLKPEDTAIYYCSANCYRRLRNYWGQGTQVTVSS

SEQ ID NO: 507 - protein, 240 aa, synthetic construct
  source 1..240: note = Description of Artificial Sequence: Synthetic polypeptide
QVQLQESGGGLVQPGGSLRLSCAASGFSFSSYAMKWVRQAPGKGLEWVSTISSGGSSTNYADSVKGRFTISRDNAKNTLYLQLNSLKIEDTAMYYCAKAIVPTGATMERGQGTQVTVSSGGGSQVQLQESGGGSVQAGGSLTLSCAASEYAYSTCNMGWYRQAPGKERELVSAFISDGSTYYADSVKGRFTITRDNAKNTVYLQMNSLKPEDTAIYYCSANCYRRLRNYWGQGTQVTVSS

SEQ ID NO: 508 - protein, 244 aa, synthetic construct
  source 1..244: note = Description of Artificial Sequence: Synthetic polypeptide
QVQLQESGGGLVQPGGSLRLSCAASGFTFSSYPMSWVRQAPGKGLEWISTISAGGDTTLYADSVKGRFTSSRDNAKNTLYLQLNSLKTEDTAIYYCAKRIDCNSGYCYRRNYWGQGTQVTVSSGGGSQVQLQESGGGSVQAGGSLTLSCAASEYAYSTCNMGWYRQAPGKERELVSAFISDGSTYYADSVKGRFTITRDNAKNTVYLQMNSLKPEDTAIYYCSANCYRRLRNYWGQGTQVTVSS

SEQ ID NO: 509 - protein, 244 aa, synthetic construct
  source 1..244: note = Description of Artificial Sequence: Synthetic polypeptide
QVQLQESGGGSVQVGGSLRLSCAASGFTFSSYPMSWVRQAPGKGLEWISTISAGGDTTLYADSVKGRFTSSRDNAKNTLYLQLNSLKTEDTAIYYCAKRIDCNSGYCYRRNYWGQGTQVTVSSGGGSQVQLQESGGGSVQAGGSLTLSCAASEYAYSTCNMGWYRQAPGKERELVSAFISDGSTYYADSVKGRFTITRDNAKNTVYLQMNSLKPEDTAIYYCSANCYRRLRNYWGQGTQVTVSS

SEQ ID NO: 510 - protein, 249 aa, synthetic construct
  source 1..249: note = Description of Artificial Sequence: Synthetic polypeptide
QVQLQESGGGSVQSGGSLRLSCAASGFTYSTSNSWMAWFRQAPGKEREGVAAIYTVGGSIFYADSVRGRFTISQDATKNMFYLQMNTLKPEDTAMYYCAAASGRLRGKWFWPYEYNYWGQGTQVTVSSGGGSQVQLQESGGGSVQAGGSLTLSCAASEYAYSTCNMGWYRQAPGKERELVSAFISDGSTYYADSVKGRFTITRDNAKNTVYLQMNSLKPEDTAIYYCSANCYRRLRNYWGQGTQVTVSS

SEQ ID NO: 511 - protein, 250 aa, synthetic construct
  source 1..250: note = Description of Artificial Sequence: Synthetic polypeptide
QVQLQESGGGSVQAGGSLRLSCRASGSTYSNYCLGWFRQITGKEREGVAVINWVGGMLYFADSVKGRFTVSQDQAKNTLYLQMNSLKPEDTAMYYCAAESVSSFSCGGWLTRPDRVPYWGQGTQVTVSSGGGSQVQLQESGGGSVQAGGSLTLSCAASEYAYSTCNMGWYRQAPGKERELVSAFISDGSTYYADSVKGRFTITRDNAKNTVYLQMNSLKPEDTAIYYCSANCYRRLRNYWGQGTQVTVSS

SEQ ID NO: 512 - protein, 250 aa, synthetic construct
  source 1..250: note = Description of Artificial Sequence: Synthetic polypeptide
QVQLQESGGGSVQAGGSLRLSCRASGSTYSNYCLGWFRQSTGKEREGVAVINWVGGMLYFADSVKGRFTVSQDHAKNTVTLQMNSLKPEDTAMYYCAAESVSSFSCGGWLTRPGRVPYWGQGTQVTVSSGGGSQVQLQESGGGSVQAGGSLTLSCAASEYAYSTCNMGWYRQAPGKERELVSAFISDGSTYYADSVKGRFTITRDNAKNTVYLQMNSLKPEDTAIYYCSANCYRRLRNYWGQGTQVTVSS

SEQ ID NO: 513 - protein, 250 aa, synthetic construct
  source 1..250: note = Description of Artificial Sequence: Synthetic polypeptide
QVQLQESGGGSVQAGESLRLSCRASGSTYSNYCLGWFRQITGKEREGVAVINWVGGMLYFADSVKGRFTVSQDQAKNTVYLEMNSLKPEDTAMYYCATESVSSFSCGGWLTRPDRVPYWGQGTQVTVSSGGGSQVQLQESGGGSVQAGGSLTLSCAASEYAYSTCNMGWYRQAPGKERELVSAFISDGSTYYADSVKGRFTITRDNAKNTVYLQMNSLKPEDTAIYYCSANCYRRLRNYWGQGTQVTVSS

SEQ ID NO: 514 - protein, 241 aa, synthetic construct
  source 1..241: note = Description of Artificial Sequence: Synthetic polypeptide
QVQLQESGGGSVQAGGSLRLSCVASGYVSCDYFLPSWYRQAPGKEREFVSIIDGTGSTSYAASVKGRFTASQDRGKNIAYLQMNSLKPEDTAMYYCKASCVRGRTISEYWGQGTQVTVSSGGGSQVQLQESGGGSVQAGGSLTLSCAASEYAYSTCNMGWYRQAPGKERELVSAFISDGSTYYADSVKGRFTITRDNAKNTVYLQMNSLKPEDTAIYYCSANCYRRLRNYWGQGTQVTVSS

SEQ ID NO: 515 - protein, 241 aa, synthetic construct
  source 1..241: note = Description of Artificial Sequence: Synthetic polypeptide
QVQLQESGGGSVQAGGSLRLSCVASGYVSCDYFLPSWYRQAPGKEREFVSIIDGTGSTSYAASVKGRFTASQDKGKNIAYLQMNSLKPEDTAMYYCKASCVRGRAISEYWGQGTQVTVSSGGGSQVQLQESGGGSVQAGGSLTLSCAASEYAYSTCNMGWYRQAPGKERELVSAFISDGSTYYADSVKGRFTITRDNAKNTVYLQMNSLKPEDTAIYYCSANCYRRLRNYWGQGTQVTVSS

SEQ ID NO: 516 - protein, 241 aa, synthetic construct
  source 1..241: note = Description of Artificial Sequence: Synthetic polypeptide
QVQLQESGGGSVQAGGSLRLSCVASGYVSCDYFLPSWYRQAPGKEREFVSIIDGTGSTSYAASVKGRFTASQDKGKNIAYLQMNTLKPEDTAMYYCKASCVRGRAISEYWGQGTQVTVSSGGGSQVQLQESGGGSVQAGGSLTLSCAASEYAYSTCNMGWYRQAPGKERELVSAFISDGSTYYADSVKGRFTITRDNAKNTVYLQMNSLKPEDTAIYYCSANCYRRLRNYWGQGTQVTVSS

SEQ ID NO: 517 - protein, 250 aa, synthetic construct
  source 1..250: note = Description of Artificial Sequence: Synthetic polypeptide
QVQLQESGGGSVQAGGSLRLSCRASGSTYSNYCLGWFRQITGKEREGVAVINWVGGMLYFADSVKGRFTVSQDQAKNTVYLQMNSLKPEDTAMYYCAAESASSFSCGGWLTRPDRVPYWGQGTQVTVSSGGGSQVQLQESGGGSVQAGGSLTLSCAASEYAYSTCNMGWYRQAPGKERELVSAFISDGSTYYADSVKGRFTITRDNAKNTVYLQMNSLKPEDTAIYYCSANCYRRLRNYWGQGTQVTVSS

SEQ ID NO: 518 - protein, 244 aa, synthetic construct
  source 1..244: note = Description of Artificial Sequence: Synthetic polypeptide
QVQLQESGGGLVQPGGSLRLSCAASGFTFSLSGMSWVRQAPGKGLEWVSAISSGGASTYYTDSVKGRFTISRDNAKNMLYLQLNSLKTEDTAMYYCAKGGSGYGDASRMTSPGSQGTQVTVSSGGGSQVQLQESGGGSVQAGGSLTLSCAASEYAYSTCNMGWYRQAPGKERELVSAFISDGSTYYADSVKGRFTITRDNAKNTVYLQMNSLKPEDTAIYYCSANCYRRLRNYWGQGTQVTVSS

SEQ ID NO: 519 - protein, 241 aa, synthetic construct
  source 1..241: note = Description of Artificial Sequence: Synthetic polypeptide
QVQLQESGGGSVQAGGSLRLSCVASGYVSCDYFLPSWYRQAPGKEREFVSIIDGTGSTSYAASVKGRFTASQDKGKNIAYLQMNSLKPEDTAMYYCKASCVRGRGISEYWGQGTQVTVSSGGGSQVQLQESGGGSVQAGGSLTLSCAASEYAYSTCNMGWYRQAPGKERELVSAFISDGSTYYADSVKGRFTITRDNAKNTVYLQMNSLKPEDTAIYYCSANCYRRLRNYWGQGTQVTVSS

SEQ ID NO: 520 - protein, 250 aa, synthetic construct
  source 1..250: note = Description of Artificial Sequence: Synthetic polypeptide
QVQLQESGGGSVQAGGSLRLSCRASGSTYSNYCLGWFRQITGKEREGVAVINWVGGMLYFADSVKGRFTVSQDQAKNTVYLQMNSLKPEDTAMYYCAAESVSSFSCGGWLTRPDRVPYWGQGTQVTVSSGGGSQVQLQESGGGSVQAGGSLTLSCAASEYAYSTCNMGWYRQAPGKERELVSAFISDGSTYYADSVKGRFTITRDNAKNTVYLQMNSLKPEDTAIYYCSANCYRRLRNYWGQGTQVTVSS

SEQ ID NO: 521 - protein, 244 aa, synthetic construct
  source 1..244: note = Description of Artificial Sequence: Synthetic polypeptide
QVQLQESGGGLVQPGGSLRLSCAASGFTFSSYPMSWVRQAPGKGLEWVSTISSGGDTTLYADSVKGRFTSSRDNAKNTLYLQLNSLKTEDTAMYYCAKRIDCNSGYCYKRSYWGQGTQVTVSSGGGSQVQLQESGGGSVQAGGSLTLSCAASEYAYSTCNMGWYRQAPGKERELVSAFISDGSTYYADSVKGRFTITRDNAKNTVYLQMNSLKPEDTAIYYCSANCYRRLRNYWGQGTQVTVSS

SEQ ID NO: 522 - protein, 244 aa, synthetic construct
  source 1..244: note = Description of Artificial Sequence: Synthetic polypeptide
QVQLQESGGGLVQPGGSLRLSCAASGFTFSLSSMSWVRQAPGKGLEWVSAISSGGASTYYTDSVKGRFTISRDNAKNMLYLQLNSLKTEDTAMYYCAKGGSGYGDASRMTSPGSQGTQVTVSSGGGSQVQLQESGGGSVQAGGSLTLSCAASEYAYSTCNMGWYRQAPGKERELVSAFISDGSTYYADSVKGRFTITRDNAKNTVYLQMNSLKPEDTAIYYCSANCYRRLRNYWGQGTQVTVSS

SEQ ID NO: 523 - protein, 250 aa, synthetic construct
  source 1..250: note = Description of Artificial Sequence: Synthetic polypeptide
QVQLQESGGGSVQAGGSLRLSCRASGSTYSNYCLGWFRQTTGKEREGVAVINWVGGMLYFADSVKGRFTVSQDQAKNTVYLQMNSLKPEDTAMYYCAAESVSSFSCGGWLTRPDRVPYWGQGTQVTVSSGGGSQVQLQESGGGSVQAGGSLTLSCAASEYAYSTCNMGWYRQAPGKERELVSAFISDGSTYYADSVKGRFTITRDNAKNTVYLQMNSLKPEDTAIYYCSANCYRRLRNYWGQGTQVTVSS

SEQ ID NO: 524 - protein, 250 aa, synthetic construct
  source 1..250: note = Description of Artificial Sequence: Synthetic polypeptide
QVQLQESGGGSVQAGGSLRLSCRASRSPYGNYCLGWFRQSTGKEREGVAVINWVGGMLYFADSVKGRFTVSQDHAKNTVTLQMNSLKPEDTAMYYCAAESVSSFSCGGWLTRPDRVPYWGQGTQVTVSSGGGSQVQLQESGGGSVQAGGSLTLSCAASEYAYSTCNMGWYRQAPGKERELVSAFISDGSTYYADSVKGRFTITRDNAKNTVYLQMNSLKPEDTAIYYCSANCYRRLRNYWGQGTQVTVSS

SEQ ID NO: 525 - protein, 244 aa, synthetic construct
  source 1..244: note = Description of Artificial Sequence: Synthetic polypeptide
QVQLQESGGGLVQPGGSLRLSCAASGFTFSHSGMSWVRQAPGKGLEWVSTINSGGASTYYTDSVKGRFTISRDNAKNMLYLQLNSLKTEDTAMYYCAKGGSGYGDASRMTSPGSQGTQVTVSSGGGSQVQLQESGGGSVQAGGSLTLSCAASEYAYSTCNMGWYRQAPGKERELVSAFISDGSTYYADSVKGRFTITRDNAKNTVYLQMNSLKPEDTAIYYCSANCYRRLRNYWGQGTQVTVSS

SEQ ID NO: 526 - protein, 251 aa, synthetic construct
  source 1..251: note = Description of Artificial Sequence: Synthetic polypeptide
QVQLQESGGGLVQPGGSLRLSCAASGFTFSSYPMSWVRQAPGKGLEWISTISAGGDTTLYADSVKGRFTSSRDNAKNTLYLQLNSLKTEDAAIYYCAKRIDCNSGYCYRRNYWGQGTQVTVSSGGGSQVQLQESGGGLVQPGGSLRLSCTASGLTFDDSVMGWFRQAPGKGREAVSCISSSGANAFYADSVKGRFTISRDNAKNTLYLQMNSLKPEDTATYYCKRGHACAGYYPIPYDDYWGQGTQVTVSS

SEQ ID NO: 527 - protein, 251 aa, synthetic construct
  source 1..251: note = Description of Artificial Sequence: Synthetic polypeptide
QVQLQESGGGLVQPGGSLRLSCAASGFTFSLSGMSWVRQAPGKGLEWVSAISSGGASTYYTDSVKGRFTISRDNAKNILYLQLNSLKTEDTAMYYCAKGGSGYGDASRMTSPGSQGTQVTVSSGGGSQVQLQESGGGLVQPGGSLRLSCTASGLTFDDSVMGWFRQAPGKGREAVSCISSSGANAFYADSVKGRFTISRDNAKNTLYLQMNSLKPEDTATYYCKRGHACAGYYPIPYDDYWGQGTQVTVSS

SEQ ID NO: 528 - protein, 248 aa, synthetic construct
  source 1..248: note = Description of Artificial Sequence: Synthetic polypeptide
QVQLQESGGGSVQAGGSLRLSCVASGYVSCDYFLPSWYRQAPGKEREFVSIIDGTGSTSYAASVKGRFTASEDKGKNIAYLQMNSLKPEDTAMYYCKASCVRGRAVSEYWGQGTQVTVSSGGGSQVQLQESGGGLVQPGGSLRLSCTASGLTFDDSVMGWFRQAPGKGREAVSCISSSGANAFYADSVKGRFTISRDNAKNTLYLQMNSLKPEDTATYYCKRGHACAGYYPIPYDDYWGQGTQVTVSS

SEQ ID NO: 529 - protein, 252 aa, synthetic construct
  source 1..252: note = Description of Artificial Sequence: Synthetic polypeptide
QVQLQESGGGLVQPGESLRLSCTASGFTFSNYAMSWVRQAPGKGLEWVSGINVAYGITSYADSVKGRFTISRDNTKNTLYLQLNSLKTEDTAIYYCVKHSGTTIPRGFISYTKRGQGTQVTVSSGGGSQVQLQESGGGLVQPGGSLRLSCTASGLTFDDSVMGWFRQAPGKGREAVSCISSSGANAFYADSVKGRFTISRDNAKNTLYLQMNSLKPEDTATYYCKRGHACAGYYPIPYDDYWGQGTQVTVSS

SEQ ID NO: 530 - protein, 248 aa, synthetic construct
  source 1..248: note = Description of Artificial Sequence: Synthetic polypeptide
QVQLQESGGGSVQAGGSLRLSCTASGYVSCDYFLPSWYRQAPGKEREFVSVIDGTGSTSYAASVKGRFTASQDKGKNIAYLQMNSLKPEDTAMYYCKASCVRGRAISEYWGQGTQVTVSSGGGSQVQLQESGGGLVQPGGSLRLSCTASGLTFDDSVMGWFRQAPGKGREAVSCISSSGANAFYADSVKGRFTISRDNAKNTLYLQMNSLKPEDTATYYCKRGHACAGYYPIPYDDYWGQGTQVTVSS

SEQ ID NO: 531 - protein, 247 aa, synthetic construct
  source 1..247: note = Description of Artificial Sequence: Synthetic polypeptide
QVQLQESGGGLVQPGGSLRLSCAASGFSFSSYAMKWVRQAPGKGLEWVSTISSGGSSTNYADSVKGRFTISRDNAKNTLYLQLNSLKIEDTAMYYCAKAIVPTGATMERGQGTQVTVSSGGGSQVQLQESGGGLVQPGGSLRLSCTASGLTFDDSVMGWFRQAPGKGREAVSCISSSGANAFYADSVKGRFTISRDNAKNTLYLQMNSLKPEDTATYYCKRGHACAGYYPIPYDDYWGQGTQVTVSS

SEQ ID NO: 532 - protein, 251 aa, synthetic construct
  source 1..251: note = Description of Artificial Sequence: Synthetic polypeptide
QVQLQESGGGLVQPGGSLRLSCAASGFTFSSYPMSWVRQAPGKGLEWISTISAGGDTTLYADSVKGRFTSSRDNAKNTLYLQLNSLKTEDTAIYYCAKRIDCNSGYCYRRNYWGQGTQVTVSSGGGSQVQLQESGGGLVQPGGSLRLSCTASGLTFDDSVMGWFRQAPGKGREAVSCISSSGANAFYADSVKGRFTISRDNAKNTLYLQMNSLKPEDTATYYCKRGHACAGYYPIPYDDYWGQGTQVTVSS

SEQ ID NO: 533 - protein, 251 aa, synthetic construct
  source 1..251: note = Description of Artificial Sequence: Synthetic polypeptide
QVQLQESGGGSVQVGGSLRLSCAASGFTFSSYPMSWVRQAPGKGLEWISTISAGGDTTLYADSVKGRFTSSRDNAKNTLYLQLNSLKTEDTAIYYCAKRIDCNSGYCYRRNYWGQGTQVTVSSGGGSQVQLQESGGGLVQPGGSLRLSCTASGLTFDDSVMGWFRQAPGKGREAVSCISSSGANAFYADSVKGRFTISRDNAKNTLYLQMNSLKPEDTATYYCKRGHACAGYYPIPYDDYWGQGTQVTVSS

SEQ ID NO: 534 - protein, 256 aa, synthetic construct
  source 1..256: note = Description of Artificial Sequence: Synthetic polypeptide
QVQLQESGGGSVQSGGSLRLSCAASGFTYSTSNSWMAWFRQAPGKEREGVAAIYTVGGSIFYADSVRGRFTISQDATKNMFYLQMNTLKPEDTAMYYCAAASGRLRGKWFWPYEYNYWGQGTQVTVSSGGGSQVQLQESGGGLVQPGGSLRLSCTASGLTFDDSVMGWFRQAPGKGREAVSCISSSGANAFYADSVKGRFTISRDNAKNTLYLQMNSLKPEDTATYYCKRGHACAGYYPIPYDDYWGQGTQVTVSS

SEQ ID NO: 535 - protein, 257 aa, synthetic construct
  source 1..257: note = Description of Artificial Sequence: Synthetic polypeptide
QVQLQESGGGSVQAGGSLRLSCRASGSTYSNYCLGWFRQITGKEREGVAVINWVGGMLYFADSVKGRFTVSQDQAKNTLYLQMNSLKPEDTAMYYCAAESVSSFSCGGWLTRPDRVPYWGQGTQVTVSSGGGSQVQLQESGGGLVQPGGSLRLSCTASGLTFDDSVMGWFRQAPGKGREAVSCISSSGANAFYADSVKGRFTISRDNAKNTLYLQMNSLKPEDTATYYCKRGHACAGYYPIPYDDYWGQGTQVTVSS

SEQ ID NO: 536 - protein, 257 aa, synthetic construct
  source 1..257: note = Description of Artificial Sequence: Synthetic polypeptide
QVQLQESGGGSVQAGGSLRLSCRASGSTYSNYCLGWFRQSTGKEREGVAVINWVGGMLYFADSVKGRFTVSQDHAKNTVTLQMNSLKPEDTAMYYCAAESVSSFSCGGWLTRPGRVPYWGQGTQVTVSSGGGSQVQLQESGGGLVQPGGSLRLSCTASGLTFDDSVMGWFRQAPGKGREAVSCISSSGANAFYADSVKGRFTISRDNAKNTLYLQMNSLKPEDTATYYCKRGHACAGYYPIPYDDYWGQGTQVTVSS

SEQ ID NO: 537 - protein, 257 aa, synthetic construct
  source 1..257: note = Description of Artificial Sequence: Synthetic polypeptide
QVQLQESGGGSVQAGESLRLSCRASGSTYSNYCLGWFRQITGKEREGVAVINWVGGMLYFADSVKGRFTVSQDQAKNTVYLEMNSLKPEDTAMYYCATESVSSFSCGGWLTRPDRVPYWGQGTQVTVSSGGGSQVQLQESGGGLVQPGGSLRLSCTASGLTFDDSVMGWFRQAPGKGREAVSCISSSGANAFYADSVKGRFTISRDNAKNTLYLQMNSLKPEDTATYYCKRGHACAGYYPIPYDDYWGQGTQVTVSS

SEQ ID NO: 538 - protein, 248 aa, synthetic construct
  source 1..248: note = Description of Artificial Sequence: Synthetic polypeptide
QVQLQESGGGSVQAGGSLRLSCVASGYVSCDYFLPSWYRQAPGKEREFVSIIDGTGSTSYAASVKGRFTASQDRGKNIAYLQMNSLKPEDTAMYYCKASCVRGRTISEYWGQGTQVTVSSGGGSQVQLQESGGGLVQPGGSLRLSCTASGLTFDDSVMGWFRQAPGKGREAVSCISSSGANAFYADSVKGRFTISRDNAKNTLYLQMNSLKPEDTATYYCKRGHACAGYYPIPYDDYWGQGTQVTVSS

SEQ ID NO: 539 - protein, 248 aa, synthetic construct
  source 1..248: note = Description of Artificial Sequence: Synthetic polypeptide
QVQLQESGGGSVQAGGSLRLSCVASGYVSCDYFLPSWYRQAPGKEREFVSIIDGTGSTSYAASVKGRFTASQDKGKNIAYLQMNSLKPEDTAMYYCKASCVRGRAISEYWGQGTQVTVSSGGGSQVQLQESGGGLVQPGGSLRLSCTASGLTFDDSVMGWFRQAPGKGREAVSCISSSGANAFYADSVKGRFTISRDNAKNTLYLQMNSLKPEDTATYYCKRGHACAGYYPIPYDDYWGQGTQVTVSS

SEQ ID NO: 540 - protein, 248 aa, synthetic construct
  source 1..248: note = Description of Artificial Sequence: Synthetic polypeptide
QVQLQESGGGSVQAGGSLRLSCVASGYVSCDYFLPSWYRQAPGKEREFVSIIDGTGSTSYAASVKGRFTASQDKGKNIAYLQMNTLKPEDTAMYYCKASCVRGRAISEYWGQGTQVTVSSGGGSQVQLQESGGGLVQPGGSLRLSCTASGLTFDDSVMGWFRQAPGKGREAVSCISSSGANAFYADSVKGRFTISRDNAKNTLYLQMNSLKPEDTATYYCKRGHACAGYYPIPYDDYWGQGTQVTVSS

SEQ ID NO: 541 - protein, 257 aa, synthetic construct
  source 1..257: note = Description of Artificial Sequence: Synthetic polypeptide
QVQLQESGGGSVQAGGSLRLSCRASGSTYSNYCLGWFRQITGKEREGVAVINWVGGMLYFADSVKGRFTVSQDQAKNTVYLQMNSLKPEDTAMYYCAAESASSFSCGGWLTRPDRVPYWGQGTQVTVSSGGGSQVQLQESGGGLVQPGGSLRLSCTASGLTFDDSVMGWFRQAPGKGREAVSCISSSGANAFYADSVKGRFTISRDNAKNTLYLQMNSLKPEDTATYYCKRGHACAGYYPIPYDDYWGQGTQVTVSS

SEQ ID NO: 542 - protein, 251 aa, synthetic construct
  source 1..251: note = Description of Artificial Sequence: Synthetic polypeptide
QVQLQESGGGLVQPGGSLRLSCAASGFTFSLSGMSWVRQAPGKGLEWVSAISSGGASTYYTDSVKGRFTISRDNAKNMLYLQLNSLKTEDTAMYYCAKGGSGYGDASRMTSPGSQGTQVTVSSGGGSQVQLQESGGGLVQPGGSLRLSCTASGLTFDDSVMGWFRQAPGKGREAVSCISSSGANAFYADSVKGRFTISRDNAKNTLYLQMNSLKPEDTATYYCKRGHACAGYYPIPYDDYWGQGTQVTVSS

SEQ ID NO: 543 - protein, 248 aa, synthetic construct
  source 1..248: note = Description of Artificial Sequence: Synthetic polypeptide
QVQLQESGGGSVQAGGSLRLSCVASGYVSCDYFLPSWYRQAPGKEREFVSIIDGTGSTSYAASVKGRFTASQDKGKNIAYLQMNSLKPEDTAMYYCKASCVRGRGISEYWGQGTQVTVSSGGGSQVQLQESGGGLVQPGGSLRLSCTASGLTFDDSVMGWFRQAPGKGREAVSCISSSGANAFYADSVKGRFTISRDNAKNTLYLQMNSLKPEDTATYYCKRGHACAGYYPIPYDDYWGQGTQVTVSS

SEQ ID NO: 544 - protein, 257 aa, synthetic construct
  source 1..257: note = Description of Artificial Sequence: Synthetic polypeptide
QVQLQESGGGSVQAGGSLRLSCRASGSTYSNYCLGWFRQITGKEREGVAVINWVGGMLYFADSVKGRFTVSQDQAKNTVYLQMNSLKPEDTAMYYCAAESVSSFSCGGWLTRPDRVPYWGQGTQVTVSSGGGSQVQLQESGGGLVQPGGSLRLSCTASGLTFDDSVMGWFRQAPGKGREAVSCISSSGANAFYADSVKGRFTISRDNAKNTLYLQMNSLKPEDTATYYCKRGHACAGYYPIPYDDYWGQGTQVTVSS

SEQ ID NO: 545 - protein, 251 aa, synthetic construct
  source 1..251: note = Description of Artificial Sequence: Synthetic polypeptide
QVQLQESGGGLVQPGGSLRLSCAASGFTFSSYPMSWVRQAPGKGLEWVSTISSGGDTTLYADSVKGRFTSSRDNAKNTLYLQLNSLKTEDTAMYYCAKRIDCNSGYCYKRSYWGQGTQVTVSSGGGSQVQLQESGGGLVQPGGSLRLSCTASGLTFDDSVMGWFRQAPGKGREAVSCISSSGANAFYADSVKGRFTISRDNAKNTLYLQMNSLKPEDTATYYCKRGHACAGYYPIPYDDYWGQGTQVTVSS

SEQ ID NO: 546 - protein, 251 aa, synthetic construct
  source 1..251: note = Description of Artificial Sequence: Synthetic polypeptide
QVQLQESGGGLVQPGGSLRLSCAASGFTFSLSSMSWVRQAPGKGLEWVSAISSGGASTYYTDSVKGRFTISRDNAKNMLYLQLNSLKTEDTAMYYCAKGGSGYGDASRMTSPGSQGTQVTVSSGGGSQVQLQESGGGLVQPGGSLRLSCTASGLTFDDSVMGWFRQAPGKGREAVSCISSSGANAFYADSVKGRFTISRDNAKNTLYLQMNSLKPEDTATYYCKRGHACAGYYPIPYDDYWGQGTQVTVSS

SEQ ID NO: 547 - protein, 257 aa, synthetic construct
  source 1..257: note = Description of Artificial Sequence: Synthetic polypeptide
QVQLQESGGGSVQAGGSLRLSCRASGSTYSNYCLGWFRQTTGKEREGVAVINWVGGMLYFADSVKGRFTVSQDQAKNTVYLQMNSLKPEDTAMYYCAAESVSSFSCGGWLTRPDRVPYWGQGTQVTVSSGGGSQVQLQESGGGLVQPGGSLRLSCTASGLTFDDSVMGWFRQAPGKGREAVSCISSSGANAFYADSVKGRFTISRDNAKNTLYLQMNSLKPEDTATYYCKRGHACAGYYPIPYDDYWGQGTQVTVSS

SEQ ID NO: 548 - protein, 257 aa, synthetic construct
  source 1..257: note = Description of Artificial Sequence: Synthetic polypeptide
QVQLQESGGGSVQAGGSLRLSCRASRSPYGNYCLGWFRQSTGKEREGVAVINWVGGMLYFADSVKGRFTVSQDHAKNTVTLQMNSLKPEDTAMYYCAAESVSSFSCGGWLTRPDRVPYWGQGTQVTVSSGGGSQVQLQESGGGLVQPGGSLRLSCTASGLTFDDSVMGWFRQAPGKGREAVSCISSSGANAFYADSVKGRFTISRDNAKNTLYLQMNSLKPEDTATYYCKRGHACAGYYPIPYDDYWGQGTQVTVSS

SEQ ID NO: 549 - protein, 251 aa, synthetic construct
  source 1..251: note = Description of Artificial Sequence: Synthetic polypeptide
QVQLQESGGGLVQPGGSLRLSCAASGFTFSHSGMSWVRQAPGKGLEWVSTINSGGASTYYTDSVKGRFTISRDNAKNMLYLQLNSLKTEDTAMYYCAKGGSGYGDASRMTSPGSQGTQVTVSSGGGSQVQLQESGGGLVQPGGSLRLSCTASGLTFDDSVMGWFRQAPGKGREAVSCISSSGANAFYADSVKGRFTISRDNAKNTLYLQMNSLKPEDTATYYCKRGHACAGYYPIPYDDYWGQGTQVTVSS

SEQ ID NO: 550 - protein, 256 aa, synthetic construct
  source 1..256: note = Description of Artificial Sequence: Synthetic polypeptide
QVQLQESGGGSVQAGGSLRLSCTASGAIASGYIDSRWCMAWFRQAPGKEREGVAAIWPGGGLTVYADSVKGRFTISRDHAKNTLYLQMNNLKPEDTAMYYCAAGSPRMCPSLEFGFDYWGQGTQVTVSSGGGSQVQLQESGGGLVQPGGSLRLSCAASGFTFSLSGMSWVRQAPGKGLEWVSAISSGGASTYYTDSVKGRFTISRDNAKNILYLQLNSLKTEDTAMYYCAKGGSGYGDASRMTSPGSQGTQVTVSS

SEQ ID NO: 551 - protein, 253 aa, synthetic construct
  source 1..253: note = Description of Artificial Sequence: Synthetic polypeptide
QVQLQESGGGSVQAGGSLRLSCTASGAIASGYIDSRWCMAWFRQAPGKEREGVAAIWPGGGLTVYADSVKGRFTISRDHAKNTLYLQMNNLKPEDTAMYYCAAGSPRMCPSLEFGFDYWGQGTQVTVSSGGGSQVQLQESGGGSVQAGGSLRLSCVASGYVSCDYFLPSWYRQAPGKEREFVSIIDGTGSTSYAASVKGRFTASEDKGKNIAYLQMNSLKPEDTAMYYCKASCVRGRAVSEYWGQGTQVTVSS

SEQ ID NO: 552 - protein, 253 aa, synthetic construct
  source 1..253: note = Description of Artificial Sequence: Synthetic polypeptide
QVQLQESGGGSVQAGGSLRLSCTASGAIASGYIDSRWCMAWFRQAPGKEREGVAAIWPGGGLTVYADSVKGRFTISRDHAKNTLYLQMNNLKPEDTAMYYCAAGSPRMCPSLEFGFDYWGQGTQVTVSSGGGSQVQLQESGGGSVQAGGSLRLSCTASGYVSCDYFLPSWYRQAPGKEREFVSVIDGTGSTSYAASVKGRFTASQDKGKNIAYLQMNSLKPEDTAMYYCKASCVRGRAISEYWGQGTQVTVSS

SEQ ID NO: 553 - protein, 256 aa, synthetic construct
  source 1..256: note = Description of Artificial Sequence: Synthetic polypeptide
QVQLQESGGGSVQAGGSLRLSCTASGAIASGYIDSRWCMAWFRQAPGKEREGVAAIWPGGGLTVYADSVKGRFTISRDHAKNTLYLQMNNLKPEDTAMYYCAAGSPRMCPSLEFGFDYWGQGTQVTVSSGGGSQVQLQESGGGLVQPGGSLRLSCAASGFTFSSYPMSWVRQAPGKGLEWISTISAGGDTTLYADSVKGRFTSSRDNAKNTLYLQLNSLKTEDTAIYYCAKRIDCNSGYCYRRNYWGQGTQVTVSS

SEQ ID NO: 554 - protein, 256 aa, synthetic construct
  source 1..256: note = Description of Artificial Sequence: Synthetic polypeptide
QVQLQESGGGSVQAGGSLRLSCTASGAIASGYIDSRWCMAWFRQAPGKEREGVAAIWPGGGLTVYADSVKGRFTISRDHAKNTLYLQMNNLKPEDTAMYYCAAGSPRMCPSLEFGFDYWGQGTQVTVSSGGGSQVQLQESGGGSVQVGGSLRLSCAASGFTFSSYPMSWVRQAPGKGLEWISTISAGGDTTLYADSVKGRFTSSRDNAKNTLYLQLNSLKTEDTAIYYCAKRIDCNSGYCYRRNYWGQGTQVTVSS

SEQ ID NO: 555 - protein, 262 aa, synthetic construct
  source 1..262: note = Description of Artificial Sequence: Synthetic polypeptide
QVQLQESGGGSVQAGGSLRLSCTASGAIASGYIDSRWCMAWFRQAPGKEREGVAAIWPGGGLTVYADSVKGRFTISRDHAKNTLYLQMNNLKPEDTAMYYCAAGSPRMCPSLEFGFDYWGQGTQVTVSSGGGSQVQLQESGGGSVQAGGSLRLSCRASGSTYSNYCLGWFRQITGKEREGVAVINWVGGMLYFADSVKGRFTVSQDQAKNTLYLQMNSLKPEDTAMYYCAAESVSSFSCGGWLTRPDRVPYWGQGTQVTVSS

SEQ ID NO: 556 - protein, 262 aa, synthetic construct
  source 1..262: note = Description of Artificial Sequence: Synthetic polypeptide
QVQLQESGGGSVQAGGSLRLSCTASGAIASGYIDSRWCMAWFRQAPGKEREGVAAIWPGGGLTVYADSVKGRFTISRDHAKNTLYLQMNNLKPEDTAMYYCAAGSPRMCPSLEFGFDYWGQGTQVTVSSGGGSQVQLQESGGGSVQAGGSLRLSCRASGSTYSNYCLGWFRQSTGKEREGVAVINWVGGMLYFADSVKGRFTVSQDHAKNTVTLQMNSLKPEDTAMYYCAAESVSSFSCGGWLTRPGRVPYWGQGTQVTVSS

SEQ ID NO: 557 - protein, 262 aa, synthetic construct
  source 1..262: note = Description of Artificial Sequence: Synthetic polypeptide
QVQLQESGGGSVQAGGSLRLSCTASGAIASGYIDSRWCMAWFRQAPGKEREGVAAIWPGGGLTVYADSVKGRFTISRDHAKNTLYLQMNNLKPEDTAMYYCAAGSPRMCPSLEFGFDYWGQGTQVTVSSGGGSQVQLQESGGGSVQAGESLRLSCRASGSTYSNYCLGWFRQITGKEREGVAVINWVGGMLYFADSVKGRFTVSQDQAKNTVYLEMNSLKPEDTAMYYCATESVSSFSCGGWLTRPDRVPYWGQGTQVTVSS

SEQ ID NO: 558 - protein, 253 aa, synthetic construct
  source 1..253: note = Description of Artificial Sequence: Synthetic polypeptide
QVQLQESGGGSVQAGGSLRLSCTASGAIASGYIDSRWCMAWFRQAPGKEREGVAAIWPGGGLTVYADSVKGRFTISRDHAKNTLYLQMNNLKPEDTAMYYCAAGSPRMCPSLEFGFDYWGQGTQVTVSSGGGSQVQLQESGGGSVQAGGSLRLSCVASGYVSCDYFLPSWYRQAPGKEREFVSIIDGTGSTSYAASVKGRFTASQDRGKNIAYLQMNSLKPEDTAMYYCKASCVRGRTISEYWGQGTQVTVSS

SEQ ID NO: 559 - protein, 253 aa, synthetic construct
  source 1..253: note = Description of Artificial Sequence: Synthetic polypeptide
QVQLQESGGGSVQAGGSLRLSCTASGAIASGYIDSRWCMAWFRQAPGKEREGVAAIWPGGGLTVYADSVKGRFTISRDHAKNTLYLQMNNLKPEDTAMYYCAAGSPRMCPSLEFGFDYWGQGTQVTVSSGGGSQVQLQESGGGSVQAGGSLRLSCVASGYVSCDYFLPSWYRQAPGKEREFVSIIDGTGSTSYAASVKGRFTASQDKGKNIAYLQMNSLKPEDTAMYYCKASCVRGRAISEYWGQGTQVTVSS

SEQ ID NO: 560 - protein, 262 aa, synthetic construct
  source 1..262: note = Description of Artificial Sequence: Synthetic polypeptide
QVQLQESGGGSVQAGGSLRLSCTASGAIASGYIDSRWCMAWFRQAPGKEREGVAAIWPGGGLTVYADSVKGRFTISRDHAKNTLYLQMNNLKPEDTAMYYCAAGSPRMCPSLEFGFDYWGQGTQVTVSSGGGSQVQLQESGGGSVQAGGSLRLSCRASGSTYSNYCLGWFRQITGKEREGVAVINWVGGMLYFADSVKGRFTVSQDQAKNTVYLQMNSLKPEDTAMYYCAAESASSFSCGGWLTRPDRVPYWGQGTQVTVSS

SEQ ID NO: 561 - protein, 256 aa, synthetic construct
  source 1..256: note = Description of Artificial Sequence: Synthetic polypeptide
QVQLQESGGGSVQAGGSLRLSCTASGAIASGYIDSRWCMAWFRQAPGKEREGVAAIWPGGGLTVYADSVKGRFTISRDHAKNTLYLQMNNLKPEDTAMYYCAAGSPRMCPSLEFGFDYWGQGTQVTVSSGGGSQVQLQESGGGLVQPGGSLRLSCAASGFTFSLSGMSWVRQAPGKGLEWVSAISSGGASTYYTDSVKGRFTISRDNAKNMLYLQLNSLKTEDTAMYYCAKGGSGYGDASRMTSPGSQGTQVTVSS

SEQ ID NO: 562 - protein, 253 aa, synthetic construct
  source 1..253: note = Description of Artificial Sequence: Synthetic polypeptide
QVQLQESGGGSVQAGGSLRLSCTASGAIASGYIDSRWCMAWFRQAPGKEREGVAAIWPGGGLTVYADSVKGRFTISRDHAKNTLYLQMNNLKPEDTAMYYCAAGSPRMCPSLEFGFDYWGQGTQVTVSSGGGSQVQLQESGGGSVQAGGSLRLSCVASGYVSCDYFLPSWYRQAPGKEREFVSIIDGTGSTSYAASVKGRFTASQDKGKNIAYLQMNSLKPEDTAMYYCKASCVRGRGISEYWGQGTQVTVSS

SEQ ID NO: 563 - protein, 256 aa, synthetic construct
  source 1..256: note = Description of Artificial Sequence: Synthetic polypeptide
QVQLQESGGGSVQAGGSLRLSCTASGAIASGYIDSRWCMAWFRQAPGKEREGVAAIWPGGGLTVYADSVKGRFTISRDHAKNTLYLQMNNLKPEDTAMYYCAAGSPRMCPSLEFGFDYWGQGTQVTVSSGGGSQVQLQESGGGLVQPGGSLRLSCAASGFTFSSYPMSWVRQAPGKGLEWVSTISSGGDTTLYADSVKGRFTSSRDNAKNTLYLQLNSLKTEDTAMYYCAKRIDCNSGYCYKRSYWGQGTQVTVSS

SEQ ID NO: 564 - protein, 262 aa, synthetic construct
  source 1..262: note = Description of Artificial Sequence: Synthetic polypeptide
QVQLQESGGGSVQAGGSLRLSCTASGAIASGYIDSRWCMAWFRQAPGKEREGVAAIWPGGGLTVYADSVKGRFTISRDHAKNTLYLQMNNLKPEDTAMYYCAAGSPRMCPSLEFGFDYWGQGTQVTVSSGGGSQVQLQESGGGSVQAGGSLRLSCRASGSTYSNYCLGWFRQTTGKEREGVAVINWVGGMLYFADSVKGRFTVSQDQAKNTVYLQMNSLKPEDTAMYYCAAESVSSFSCGGWLTRPDRVPYWGQGTQVTVSS

SEQ ID NO: 565 - protein, 262 aa, synthetic construct
  source 1..262: note = Description of Artificial Sequence: Synthetic polypeptide
QVQLQESGGGSVQAGGSLRLSCTASGAIASGYIDSRWCMAWFRQAPGKEREGVAAIWPGGGLTVYADSVKGRFTISRDHAKNTLYLQMNNLKPEDTAMYYCAAGSPRMCPSLEFGFDYWGQGTQVTVSSGGGSQVQLQESGGGSVQAGGSLRLSCRASRSPYGNYCLGWFRQSTGKEREGVAVINWVGGMLYFADSVKGRFTVSQDHAKNTVTLQMNSLKPEDTAMYYCAAESVSSFSCGGWLTRPDRVPYWGQGTQVTVSS

SEQ ID NO: 566 - protein, 256 aa, synthetic construct
  source 1..256: note = Description of Artificial Sequence: Synthetic polypeptide
QVQLQESGGGSVQAGGSLRLSCTASGAIASGYIDSRWCMAWFRQAPGKEREGVAAIWPGGGLTVYADSVKGRFTISRDHAKNTLYLQMNNLKPEDTAMYYCAAGSPRMCPSLEFGFDYWGQGTQVTVSSGGGSQVQLQESGGGLVQPGGSLRLSCAASGFTFSHSGMSWVRQAPGKGLEWVSTINSGGASTYYTDSVKGRFTISRDNAKNMLYLQLNSLKTEDTAMYYCAKGGSGYGDASRMTSPGSQGTQVTVSS

SEQ ID NO: 567 - protein, 250 aa, synthetic construct
  source 1..250: note = Description of Artificial Sequence: Synthetic polypeptide
QVQLQESGGGSVQAGGSLRLSCTAPGFTSNSCGMDWYRQAPGKEREFVSSISTDGTTGYADSVKGRFTISKDKAKDTVYLQMNSLKPEDTGMYSCKTKDGTIATMELCDFGYWGQGTQVTVSSGGGSQVQLQESGGGLVQPGGSLRLSCAASGFTFSLSGMSWVRQAPGKGLEWVSAISSGGASTYYTDSVKGRFTISRDNAKNILYLQLNSLKTEDTAMYYCAKGGSGYGDASRMTSPGSQGTQVTVSS

SEQ ID NO: 568 - protein, 247 aa, synthetic construct
  source 1..247: note = Description of Artificial Sequence: Synthetic polypeptide
QVQLQESGGGSVQAGGSLRLSCTAPGFTSNSCGMDWYRQAPGKEREFVSSISTDGTTGYADSVKGRFTISKDKAKDTVYLQMNSLKPEDTGMYSCKTKDGTIATMELCDFGYWGQGTQVTVSSGGGSQVQLQESGGGSVQAGGSLRLSCVASGYVSCDYFLPSWYRQAPGKEREFVSIIDGTGSTSYAASVKGRFTASEDKGKNIAYLQMNSLKPEDTAMYYCKASCVRGRAVSEYWGQGTQVTVSS

SEQ ID NO: 569 - protein, 247 aa, synthetic construct
  source 1..247: note = Description of Artificial Sequence: Synthetic polypeptide
QVQLQESGGGSVQAGGSLRLSCTAPGFTSNSCGMDWYRQAPGKEREFVSSISTDGTTGYADSVKGRFTISKDKAKDTVYLQMNSLKPEDTGMYSCKTKDGTIATMELCDFGYWGQGTQVTVSSGGGSQVQLQESGGGSVQAGGSLRLSCTASGYVSCDYFLPSWYRQAPGKEREFVSVIDGTGSTSYAASVKGRFTASQDKGKNIAYLQMNSLKPEDTAMYYCKASCVRGRAISEYWGQGTQVTVSS

SEQ ID NO: 570 - protein, 250 aa, synthetic construct
  source 1..250: note = Description of Artificial Sequence: Synthetic polypeptide
QVQLQESGGGSVQAGGSLRLSCTAPGFTSNSCGMDWYRQAPGKEREFVSSISTDGTTGYADSVKGRFTISKDKAKDTVYLQMNSLKPEDTGMYSCKTKDGTIATMELCDFGYWGQGTQVTVSSGGGSQVQLQESGGGLVQPGGSLRLSCAASGFTFSSYPMSWVRQAPGKGLEWISTISAGGDTTLYADSVKGRFTSSRDNAKNTLYLQLNSLKTEDTAIYYCAKRIDCNSGYCYRRNYWGQGTQVTVSS

SEQ ID NO: 571 - protein, 250 aa, synthetic construct
  source 1..250: note = Description of Artificial Sequence: Synthetic polypeptide
QVQLQESGGGSVQAGGSLRLSCTAPGFTSNSCGMDWYRQAPGKEREFVSSISTDGTTGYADSVKGRFTISKDKAKDTVYLQMNSLKPEDTGMYSCKTKDGTIATMELCDFGYWGQGTQVTVSSGGGSQVQLQESGGGSVQVGGSLRLSCAASGFTFSSYPMSWVRQAPGKGLEWISTISAGGDTTLYADSVKGRFTSSRDNAKNTLYLQLNSLKTEDTAIYYCAKRIDCNSGYCYRRNYWGQGTQVTVSS

SEQ ID NO: 572 - protein, 256 aa, synthetic construct
  source 1..256: note = Description of Artificial Sequence: Synthetic polypeptide
QVQLQESGGGSVQAGGSLRLSCTAPGFTSNSCGMDWYRQAPGKEREFVSSISTDGTTGYADSVKGRFTISKDKAKDTVYLQMNSLKPEDTGMYSCKTKDGTIATMELCDFGYWGQGTQVTVSSGGGSQVQLQESGGGSVQAGGSLRLSCRASGSTYSNYCLGWFRQITGKEREGVAVINWVGGMLYFADSVKGRFTVSQDQAKNTLYLQMNSLKPEDTAMYYCAAESVSSFSCGGWLTRPDRVPYWGQGTQVTVSS

SEQ ID NO: 573 - protein, 256 aa, synthetic construct
  source 1..256: note = Description of Artificial Sequence: Synthetic polypeptide
QVQLQESGGGSVQAGGSLRLSCTAPGFTSNSCGMDWYRQAPGKEREFVSSISTDGTTGYADSVKGRFTISKDKAKDTVYLQMNSLKPEDTGMYSCKTKDGTIATMELCDFGYWGQGTQVTVSSGGGSQVQLQESGGGSVQAGGSLRLSCRASGSTYSNYCLGWFRQSTGKEREGVAVINWVGGMLYFADSVKGRFTVSQDHAKNTVTLQMNSLKPEDTAMYYCAAESVSSFSCGGWLTRPGRVPYWGQGTQVTVSS

SEQ ID NO: 574 - protein, 256 aa, synthetic construct
  source 1..256: note = Description of Artificial Sequence: Synthetic polypeptide
QVQLQESGGGSVQAGGSLRLSCTAPGFTSNSCGMDWYRQAPGKEREFVSSISTDGTTGYADSVKGRFTISKDKAKDTVYLQMNSLKPEDTGMYSCKTKDGTIATMELCDFGYWGQGTQVTVSSGGGSQVQLQESGGGSVQAGESLRLSCRASGSTYSNYCLGWFRQITGKEREGVAVINWVGGMLYFADSVKGRFTVSQDQAKNTVYLEMNSLKPEDTAMYYCATESVSSFSCGGWLTRPDRVPYWGQGTQVTVSS

SEQ ID NO: 575 - protein, 247 aa, synthetic construct
  source 1..247: note = Description of Artificial Sequence: Synthetic polypeptide
QVQLQESGGGSVQAGGSLRLSCTAPGFTSNSCGMDWYRQAPGKEREFVSSISTDGTTGYADSVKGRFTISKDKAKDTVYLQMNSLKPEDTGMYSCKTKDGTIATMELCDFGYWGQGTQVTVSSGGGSQVQLQESGGGSVQAGGSLRLSCVASGYVSCDYFLPSWYRQAPGKEREFVSIIDGTGSTSYAASVKGRFTASQDRGKNIAYLQMNSLKPEDTAMYYCKASCVRGRTISEYWGQGTQVTVSS

SEQ ID NO: 576 - protein, 247 aa, synthetic construct
  source 1..247: note = Description of Artificial Sequence: Synthetic polypeptide
QVQLQESGGGSVQAGGSLRLSCTAPGFTSNSCGMDWYRQAPGKEREFVSSISTDGTTGYADSVKGRFTISKDKAKDTVYLQMNSLKPEDTGMYSCKTKDGTIATMELCDFGYWGQGTQVTVSSGGGSQVQLQESGGGSVQAGGSLRLSCVASGYVSCDYFLPSWYRQAPGKEREFVSIIDGTGSTSYAASVKGRFTASQDKGKNIAYLQMNSLKPEDTAMYYCKASCVRGRAISEYWGQGTQVTVSS

SEQ ID NO: 577 - protein, 256 aa, synthetic construct
  source 1..256: note = Description of Artificial Sequence: Synthetic polypeptide
QVQLQESGGGSVQAGGSLRLSCTAPGFTSNSCGMDWYRQAPGKEREFVSSISTDGTTGYADSVKGRFTISKDKAKDTVYLQMNSLKPEDTGMYSCKTKDGTIATMELCDFGYWGQGTQVTVSSGGGSQVQLQESGGGSVQAGGSLRLSCRASGSTYSNYCLGWFRQITGKEREGVAVINWVGGMLYFADSVKGRFTVSQDQAKNTVYLQMNSLKPEDTAMYYCAAESASSFSCGGWLTRPDRVPYWGQGTQVTVSS

SEQ ID NO: 578 - protein, 250 aa, synthetic construct
  source 1..250: note = Description of Artificial Sequence: Synthetic polypeptide
QVQLQESGGGSVQAGGSLRLSCTAPGFTSNSCGMDWYRQAPGKEREFVSSISTDGTTGYADSVKGRFTISKDKAKDTVYLQMNSLKPEDTGMYSCKTKDGTIATMELCDFGYWGQGTQVTVSSGGGSQVQLQESGGGLVQPGGSLRLSCAASGFTFSLSGMSWVRQAPGKGLEWVSAISSGGASTYYTDSVKGRFTISRDNAKNMLYLQLNSLKTEDTAMYYCAKGGSGYGDASRMTSPGSQGTQVTVSS

SEQ ID NO: 579 - protein, 247 aa, synthetic construct
  source 1..247: note = Description of Artificial Sequence: Synthetic polypeptide
QVQLQESGGGSVQAGGSLRLSCTAPGFTSNSCGMDWYRQAPGKEREFVSSISTDGTTGYADSVKGRFTISKDKAKDTVYLQMNSLKPEDTGMYSCKTKDGTIATMELCDFGYWGQGTQVTVSSGGGSQVQLQESGGGSVQAGGSLRLSCVASGYVSCDYFLPSWYRQAPGKEREFVSIIDGTGSTSYAASVKGRFTASQDKGKNIAYLQMNSLKPEDTAMYYCKASCVRGRGISEYWGQGTQVTVSS

SEQ ID NO: 580 - protein, 250 aa, synthetic construct
  source 1..250: note = Description of Artificial Sequence: Synthetic polypeptide
QVQLQESGGGSVQAGGSLRLSCTAPGFTSNSCGMDWYRQAPGKEREFVSSISTDGTTGYADSVKGRFTISKDKAKDTVYLQMNSLKPEDTGMYSCKTKDGTIATMELCDFGYWGQGTQVTVSSGGGSQVQLQESGGGLVQPGGSLRLSCAASGFTFSSYPMSWVRQAPGKGLEWVSTISSGGDTTLYADSVKGRFTSSRDNAKNTLYLQLNSLKTEDTAMYYCAKRIDCNSGYCYKRSYWGQGTQVTVSS

SEQ ID NO: 581 - protein, 256 aa, synthetic construct
  source 1..256: note = Description of Artificial Sequence: Synthetic polypeptide
QVQLQESGGGSVQAGGSLRLSCTAPGFTSNSCGMDWYRQAPGKEREFVSSISTDGTTGYADSVKGRFTISKDKAKDTVYLQMNSLKPEDTGMYSCKTKDGTIATMELCDFGYWGQGTQVTVSSGGGSQVQLQESGGGSVQAGGSLRLSCRASGSTYSNYCLGWFRQTTGKEREGVAVINWVGGMLYFADSVKGRFTVSQDQAKNTVYLQMNSLKPEDTAMYYCAAESVSSFSCGGWLTRPDRVPYWGQGTQVTVSS

SEQ ID NO: 582 - protein, 256 aa, synthetic construct
  source 1..256: note = Description of Artificial Sequence: Synthetic polypeptide
QVQLQESGGGSVQAGGSLRLSCTAPGFTSNSCGMDWYRQAPGKEREFVSSISTDGTTGYADSVKGRFTISKDKAKDTVYLQMNSLKPEDTGMYSCKTKDGTIATMELCDFGYWGQGTQVTVSSGGGSQVQLQESGGGSVQAGGSLRLSCRASRSPYGNYCLGWFRQSTGKEREGVAVINWVGGMLYFADSVKGRFTVSQDHAKNTVTLQMNSLKPEDTAMYYCAAESVSSFSCGGWLTRPDRVPYWGQGTQVTVSS

SEQ ID NO: 583 - protein, 250 aa, synthetic construct
  source 1..250: note = Description of Artificial Sequence: Synthetic polypeptide
QVQLQESGGGSVQAGGSLRLSCTAPGFTSNSCGMDWYRQAPGKEREFVSSISTDGTTGYADSVKGRFTISKDKAKDTVYLQMNSLKPEDTGMYSCKTKDGTIATMELCDFGYWGQGTQVTVSSGGGSQVQLQESGGGLVQPGGSLRLSCAASGFTFSHSGMSWVRQAPGKGLEWVSTINSGGASTYYTDSVKGRFTISRDNAKNMLYLQLNSLKTEDTAMYYCAKGGSGYGDASRMTSPGSQGTQVTVSS

SEQ ID NO: 584 - protein, 255 aa, synthetic construct
  source 1..255: note = Description of Artificial Sequence: Synthetic polypeptide
QVQLQESGGGSVQAGGSLRLSCAASGYPYSNGYMGWFRQAPGKEREGVATIYTGDGRTYYADSVKGRFTISRDNAKNTVDLQMSSLKPEDTAMYYCAARAAPLYSSGSPLTRARYNVWGQGTQVTVSSGGGSQVQLQESGGGLVQPGGSLRLSCAASGFTFSLSGMSWVRQAPGKGLEWVSAISSGGASTYYTDSVKGRFTISRDNAKNILYLQLNSLKTEDTAMYYCAKGGSGYGDASRMTSPGSQGTQVTVSS

SEQ ID NO: 585 - protein, 252 aa, synthetic construct
  source 1..252: note = Description of Artificial Sequence: Synthetic polypeptide
QVQLQESGGGSVQAGGSLRLSCAASGYPYSNGYMGWFRQAPGKEREGVATIYTGDGRTYYADSVKGRFTISRDNAKNTVDLQMSSLKPEDTAMYYCAARAAPLYSSGSPLTRARYNVWGQGTQVTVSSGGGSQVQLQESGGGSVQAGGSLRLSCVASGYVSCDYFLPSWYRQAPGKEREFVSIIDGTGSTSYAASVKGRFTASEDKGKNIAYLQMNSLKPEDTAMYYCKASCVRGRAVSEYWGQGTQVTVSS

SEQ ID NO: 586 - protein, 252 aa, synthetic construct
  source 1..252: note = Description of Artificial Sequence: Synthetic polypeptide
QVQLQESGGGSVQAGGSLRLSCAASGYPYSNGYMGWFRQAPGKEREGVATIYTGDGRTYYADSVKGRFTISRDNAKNTVDLQMSSLKPEDTAMYYCAARAAPLYSSGSPLTRARYNVWGQGTQVTVSSGGGSQVQLQESGGGSVQAGGSLRLSCTASGYVSCDYFLPSWYRQAPGKEREFVSVIDGTGSTSYAASVKGRFTASQDKGKNIAYLQMNSLKPEDTAMYYCKASCVRGRAISEYWGQGTQVTVSS

SEQ ID NO: 587 - protein, 255 aa, synthetic construct
  source 1..255: note = Description of Artificial Sequence: Synthetic polypeptide
QVQLQESGGGSVQAGGSLRLSCAASGYPYSNGYMGWFRQAPGKEREGVATIYTGDGRTYYADSVKGRFTISRDNAKNTVDLQMSSLKPEDTAMYYCAARAAPLYSSGSPLTRARYNVWGQGTQVTVSSGGGSQVQLQESGGGLVQPGGSLRLSCAASGFTFSSYPMSWVRQAPGKGLEWISTISAGGDTTLYADSVKGRFTSSRDNAKNTLYLQLNSLKTEDTAIYYCAKRIDCNSGYCYRRNYWGQGTQVTVSS

SEQ ID NO: 588 - protein, 255 aa, synthetic construct
  source 1..255: note = Description of Artificial Sequence: Synthetic polypeptide
QVQLQESGGGSVQAGGSLRLSCAASGYPYSNGYMGWFRQAPGKEREGVATIYTGDGRTYYADSVKGRFTISRDNAKNTVDLQMSSLKPEDTAMYYCAARAAPLYSSGSPLTRARYNVWGQGTQVTVSSGGGSQVQLQESGGGSVQVGGSLRLSCAASGFTFSSYPMSWVRQAPGKGLEWISTISAGGDTTLYADSVKGRFTSSRDNAKNTLYLQLNSLKTEDTAIYYCAKRIDCNSGYCYRRNYWGQGTQVTVSS

SEQ ID NO: 589 - protein, 261 aa, synthetic construct
  source 1..261: note = Description of Artificial Sequence: Synthetic polypeptide
QVQLQESGGGSVQAGGSLRLSCAASGYPYSNGYMGWFRQAPGKEREGVATIYTGDGRTYYADSVKGRFTISRDNAKNTVDLQMSSLKPEDTAMYYCAARAAPLYSSGSPLTRARYNVWGQGTQVTVSSGGGSQVQLQESGGGSVQAGGSLRLSCRASGSTYSNYCLGWFRQITGKEREGVAVINWVGGMLYFADSVKGRFTVSQDQAKNTLYLQMNSLKPEDTAMYYCAAESVSSFSCGGWLTRPDRVPYWGQGTQVTVSS

SEQ ID NO: 590 - protein, 261 aa, synthetic construct
  source 1..261: note = Description of Artificial Sequence: Synthetic polypeptide
QVQLQESGGGSVQAGGSLRLSCAASGYPYSNGYMGWFRQAPGKEREGVATIYTGDGRTYYADSVKGRFTISRDNAKNTVDLQMSSLKPEDTAMYYCAARAAPLYSSGSPLTRARYNVWGQGTQVTVSSGGGSQVQLQESGGGSVQAGGSLRLSCRASGSTYSNYCLGWFRQSTGKEREGVAVINWVGGMLYFADSVKGRFTVSQDHAKNTVTLQMNSLKPEDTAMYYCAAESVSSFSCGGWLTRPGRVPYWGQGTQVTVSS

SEQ ID NO: 591 - protein, 261 aa, synthetic construct
  source 1..261: note = Description of Artificial Sequence: Synthetic polypeptide
QVQLQESGGGSVQAGGSLRLSCAASGYPYSNGYMGWFRQAPGKEREGVATIYTGDGRTYYADSVKGRFTISRDNAKNTVDLQMSSLKPEDTAMYYCAARAAPLYSSGSPLTRARYNVWGQGTQVTVSSGGGSQVQLQESGGGSVQAGESLRLSCRASGSTYSNYCLGWFRQITGKEREGVAVINWVGGMLYFADSVKGRFTVSQDQAKNTVYLEMNSLKPEDTAMYYCATESVSSFSCGGWLTRPDRVPYWGQGTQVTVSS

SEQ ID NO: 592 - protein, 252 aa, synthetic construct
  source 1..252: note = Description of Artificial Sequence: Synthetic polypeptide
QVQLQESGGGSVQAGGSLRLSCAASGYPYSNGYMGWFRQAPGKEREGVATIYTGDGRTYYADSVKGRFTISRDNAKNTVDLQMSSLKPEDTAMYYCAARAAPLYSSGSPLTRARYNVWGQGTQVTVSSGGGSQVQLQESGGGSVQAGGSLRLSCVASGYVSCDYFLPSWYRQAPGKEREFVSIIDGTGSTSYAASVKGRFTASQDRGKNIAYLQMNSLKPEDTAMYYCKASCVRGRTISEYWGQGTQVTVSS

SEQ ID NO: 593 - protein, 252 aa, synthetic construct
  source 1..252: note = Description of Artificial Sequence: Synthetic polypeptide
QVQLQESGGGSVQAGGSLRLSCAASGYPYSNGYMGWFRQAPGKEREGVATIYTGDGRTYYADSVKGRFTISRDNAKNTVDLQMSSLKPEDTAMYYCAARAAPLYSSGSPLTRARYNVWGQGTQVTVSSGGGSQVQLQESGGGSVQAGGSLRLSCVASGYVSCDYFLPSWYRQAPGKEREFVSIIDGTGSTSYAASVKGRFTASQDKGKNIAYLQMNSLKPEDTAMYYCKASCVRGRAISEYWGQGTQVTVSS

SEQ ID NO: 594 - protein, 261 aa, synthetic construct
  source 1..261: note = Description of Artificial Sequence: Synthetic polypeptide
QVQLQESGGGSVQAGGSLRLSCAASGYPYSNGYMGWFRQAPGKEREGVATIYTGDGRTYYADSVKGRFTISRDNAKNTVDLQMSSLKPEDTAMYYCAARAAPLYSSGSPLTRARYNVWGQGTQVTVSSGGGSQVQLQESGGGSVQAGGSLRLSCRASGSTYSNYCLGWFRQITGKEREGVAVINWVGGMLYFADSVKGRFTVSQDQAKNTVYLQMNSLKPEDTAMYYCAAESASSFSCGGWLTRPDRVPYWGQGTQVTVSS

SEQ ID NO: 595 - protein, 255 aa, synthetic construct
  source 1..255: note = Description of Artificial Sequence: Synthetic polypeptide
QVQLQESGGGSVQAGGSLRLSCAASGYPYSNGYMGWFRQAPGKEREGVATIYTGDGRTYYADSVKGRFTISRDNAKNTVDLQMSSLKPEDTAMYYCAARAAPLYSSGSPLTRARYNVWGQGTQVTVSSGGGSQVQLQESGGGLVQPGGSLRLSCAASGFTFSLSGMSWVRQAPGKGLEWVSAISSGGASTYYTDSVKGRFTISRDNAKNMLYLQLNSLKTEDTAMYYCAKGGSGYGDASRMTSPGSQGTQVTVSS

SEQ ID NO: 596 - protein, 252 aa, synthetic construct
  source 1..252: note = Description of Artificial Sequence: Synthetic polypeptide
QVQLQESGGGSVQAGGSLRLSCAASGYPYSNGYMGWFRQAPGKEREGVATIYTGDGRTYYADSVKGRFTISRDNAKNTVDLQMSSLKPEDTAMYYCAARAAPLYSSGSPLTRARYNVWGQGTQVTVSSGGGSQVQLQESGGGSVQAGGSLRLSCVASGYVSCDYFLPSWYRQAPGKEREFVSIIDGTGSTSYAASVKGRFTASQDKGKNIAYLQMNSLKPEDTAMYYCKASCVRGRGISEYWGQGTQVTVSS

SEQ ID NO: 597 - protein, 255 aa, synthetic construct
  source 1..255: note = Description of Artificial Sequence: Synthetic polypeptide
QVQLQESGGGSVQAGGSLRLSCAASGYPYSNGYMGWFRQAPGKEREGVATIYTGDGRTYYADSVKGRFTISRDNAKNTVDLQMSSLKPEDTAMYYCAARAAPLYSSGSPLTRARYNVWGQGTQVTVSSGGGSQVQLQESGGGLVQPGGSLRLSCAASGFTFSSYPMSWVRQAPGKGLEWVSTISSGGDTTLYADSVKGRFTSSRDNAKNTLYLQLNSLKTEDTAMYYCAKRIDCNSGYCYKRSYWGQGTQVTVSS

SEQ ID NO: 598 - protein, 261 aa, synthetic construct
  source 1..261: note = Description of Artificial Sequence: Synthetic polypeptide
QVQLQESGGGSVQAGGSLRLSCAASGYPYSNGYMGWFRQAPGKEREGVATIYTGDGRTYYADSVKGRFTISRDNAKNTVDLQMSSLKPEDTAMYYCAARAAPLYSSGSPLTRARYNVWGQGTQVTVSSGGGSQVQLQESGGGSVQAGGSLRLSCRASGSTYSNYCLGWFRQTTGKEREGVAVINWVGGMLYFADSVKGRFTVSQDQAKNTVYLQMNSLKPEDTAMYYCAAESVSSFSCGGWLTRPDRVPYWGQGTQVTVSS

SEQ ID NO: 599 - protein, 261 aa, synthetic construct
  source 1..261: note = Description of Artificial Sequence: Synthetic polypeptide
QVQLQESGGGSVQAGGSLRLSCAASGYPYSNGYMGWFRQAPGKEREGVATIYTGDGRTYYADSVKGRFTISRDNAKNTVDLQMSSLKPEDTAMYYCAARAAPLYSSGSPLTRARYNVWGQGTQVTVSSGGGSQVQLQESGGGSVQAGGSLRLSCRASRSPYGNYCLGWFRQSTGKEREGVAVINWVGGMLYFADSVKGRFTVSQDHAKNTVTLQMNSLKPEDTAMYYCAAESVSSFSCGGWLTRPDRVPYWGQGTQVTVSS

SEQ ID NO: 600 - protein, 255 aa, synthetic construct
  source 1..255: note = Description of Artificial Sequence: Synthetic polypeptide
QVQLQESGGGSVQAGGSLRLSCAASGYPYSNGYMGWFRQAPGKEREGVATIYTGDGRTYYADSVKGRFTISRDNAKNTVDLQMSSLKPEDTAMYYCAARAAPLYSSGSPLTRARYNVWGQGTQVTVSSGGGSQVQLQESGGGLVQPGGSLRLSCAASGFTFSHSGMSWVRQAPGKGLEWVSTINSGGASTYYTDSVKGRFTISRDNAKNMLYLQLNSLKTEDTAMYYCAKGGSGYGDASRMTSPGSQGTQVTVSS

SEQ ID NO: 601 - protein, 246 aa, synthetic construct
  source 1..246: note = Description of Artificial Sequence: Synthetic polypeptide
QVQLQESGGGSVQAGGSLRLSCVASASTYCTYDMHWYRQAPGKGREFVSAIDSDGTTRYADSVKGRFTISQGTAKNTVYLQMNSLQPEDTAMYYCKTVCVVGSRWSDYWGQGTQVTVSSGGGSQVQLQESGGGLVQPGGSLRLSCAASGFTFSLSGMSWVRQAPGKGLEWVSAISSGGASTYYTDSVKGRFTISRDNAKNILYLQLNSLKTEDTAMYYCAKGGSGYGDASRMTSPGSQGTQVTVSS

SEQ ID NO: 602 - protein, 243 aa, synthetic construct
  source 1..243: note = Description of Artificial Sequence: Synthetic polypeptide
QVQLQESGGGSVQAGGSLRLSCVASASTYCTYDMHWYRQAPGKGREFVSAIDSDGTTRYADSVKGRFTISQGTAKNTVYLQMNSLQPEDTAMYYCKTVCVVGSRWSDYWGQGTQVTVSSGGGSQVQLQESGGGSVQAGGSLRLSCVASGYVSCDYFLPSWYRQAPGKEREFVSIIDGTGSTSYAASVKGRFTASEDKGKNIAYLQMNSLKPEDTAMYYCKASCVRGRAVSEYWGQGTQVTVSS

SEQ ID NO: 603 - protein, 243 aa, synthetic construct
  source 1..243: note = Description of Artificial Sequence: Synthetic polypeptide
QVQLQESGGGSVQAGGSLRLSCVASASTYCTYDMHWYRQAPGKGREFVSAIDSDGTTRYADSVKGRFTISQGTAKNTVYLQMNSLQPEDTAMYYCKTVCVVGSRWSDYWGQGTQVTVSSGGGSQVQLQESGGGSVQAGGSLRLSCTASGYVSCDYFLPSWYRQAPGKEREFVSVIDGTGSTSYAASVKGRFTASQDKGKNIAYLQMNSLKPEDTAMYYCKASCVRGRAISEYWGQGTQVTVSS

SEQ ID NO: 604 - protein, 246 aa, synthetic construct
  source 1..246: note = Description of Artificial Sequence: Synthetic polypeptide
QVQLQESGGGSVQAGGSLRLSCVASASTYCTYDMHWYRQAPGKGREFVSAIDSDGTTRYADSVKGRFTISQGTAKNTVYLQMNSLQPEDTAMYYCKTVCVVGSRWSDYWGQGTQVTVSSGGGSQVQLQESGGGLVQPGGSLRLSCAASGFTFSSYPMSWVRQAPGKGLEWISTISAGGDTTLYADSVKGRFTSSRDNAKNTLYLQLNSLKTEDTAIYYCAKRIDCNSGYCYRRNYWGQGTQVTVSS

SEQ ID NO: 605 - protein, 246 aa, synthetic construct
  source 1..246: note = Description of Artificial Sequence: Synthetic polypeptide
QVQLQESGGGSVQAGGSLRLSCVASASTYCTYDMHWYRQAPGKGREFVSAIDSDGTTRYADSVKGRFTISQGTAKNTVYLQMNSLQPEDTAMYYCKTVCVVGSRWSDYWGQGTQVTVSSGGGSQVQLQESGGGSVQVGGSLRLSCAASGFTFSSYPMSWVRQAPGKGLEWISTISAGGDTTLYADSVKGRFTSSRDNAKNTLYLQLNSLKTEDTAIYYCAKRIDCNSGYCYRRNYWGQGTQVTVSS

SEQ ID NO: 606 - protein, 252 aa, synthetic construct
  source 1..252: note = Description of Artificial Sequence: Synthetic polypeptide
QVQLQESGGGSVQAGGSLRLSCVASASTYCTYDMHWYRQAPGKGREFVSAIDSDGTTRYADSVKGRFTISQGTAKNTVYLQMNSLQPEDTAMYYCKTVCVVGSRWSDYWGQGTQVTVSSGGGSQVQLQESGGGSVQAGGSLRLSCRASGSTYSNYCLGWFRQITGKEREGVAVINWVGGMLYFADSVKGRFTVSQDQAKNTLYLQMNSLKPEDTAMYYCAAESVSSFSCGGWLTRPDRVPYWGQGTQVTVSS

SEQ ID NO: 607 - protein, 252 aa, synthetic construct
  source 1..252: note = Description of Artificial Sequence: Synthetic polypeptide
QVQLQESGGGSVQAGGSLRLSCVASASTYCTYDMHWYRQAPGKGREFVSAIDSDGTTRYADSVKGRFTISQGTAKNTVYLQMNSLQPEDTAMYYCKTVCVVGSRWSDYWGQGTQVTVSSGGGSQVQLQESGGGSVQAGGSLRLSCRASGSTYSNYCLGWFRQSTGKEREGVAVINWVGGMLYFADSVKGRFTVSQDHAKNTVTLQMNSLKPEDTAMYYCAAESVSSFSCGGWLTRPGRVPYWGQGTQVTVSS

SEQ ID NO: 608 - protein, 252 aa, synthetic construct
  source 1..252: note = Description of Artificial Sequence: Synthetic polypeptide
QVQLQESGGGSVQAGGSLRLSCVASASTYCTYDMHWYRQAPGKGREFVSAIDSDGTTRYADSVKGRFTISQGTAKNTVYLQMNSLQPEDTAMYYCKTVCVVGSRWSDYWGQGTQVTVSSGGGSQVQLQESGGGSVQAGESLRLSCRASGSTYSNYCLGWFRQITGKEREGVAVINWVGGMLYFADSVKGRFTVSQDQAKNTVYLEMNSLKPEDTAMYYCATESVSSFSCGGWLTRPDRVPYWGQGTQVTVSS

SEQ ID NO: 609 - protein, 243 aa, synthetic construct
  source 1..243: note = Description of Artificial Sequence: Synthetic polypeptide
QVQLQESGGGSVQAGGSLRLSCVASASTYCTYDMHWYRQAPGKGREFVSAIDSDGTTRYADSVKGRFTISQGTAKNTVYLQMNSLQPEDTAMYYCKTVCVVGSRWSDYWGQGTQVTVSSGGGSQVQLQESGGGSVQAGGSLRLSCVASGYVSCDYFLPSWYRQAPGKEREFVSIIDGTGSTSYAASVKGRFTASQDRGKNIAYLQMNSLKPEDTAMYYCKASCVRGRTISEYWGQGTQVTVSS

SEQ ID NO: 610 - protein, 243 aa, synthetic construct
  source 1..243: note = Description of Artificial Sequence: Synthetic polypeptide
QVQLQESGGGSVQAGGSLRLSCVASASTYCTYDMHWYRQAPGKGREFVSAIDSDGTTRYADSVKGRFTISQGTAKNTVYLQMNSLQPEDTAMYYCKTVCVVGSRWSDYWGQGTQVTVSSGGGSQVQLQESGGGSVQAGGSLRLSCVASGYVSCDYFLPSWYRQAPGKEREFVSIIDGTGSTSYAASVKGRFTASQDKGKNIAYLQMNSLKPEDTAMYYCKASCVRGRAISEYWGQGTQVTVSS

SEQ ID NO: 611 - protein, 252 aa, synthetic construct
  source 1..252: note = Description of Artificial Sequence: Synthetic polypeptide
QVQLQESGGGSVQAGGSLRLSCVASASTYCTYDMHWYRQAPGKGREFVSAIDSDGTTRYADSVKGRFTISQGTAKNTVYLQMNSLQPEDTAMYYCKTVCVVGSRWSDYWGQGTQVTVSSGGGSQVQLQESGGGSVQAGGSLRLSCRASGSTYSNYCLGWFRQITGKEREGVAVINWVGGMLYFADSVKGRFTVSQDQAKNTVYLQMNSLKPEDTAMYYCAAESASSFSCGGWLTRPDRVPYWGQGTQVTVSS

SEQ ID NO: 612 - protein, 246 aa, synthetic construct
  source 1..246: note = Description of Artificial Sequence: Synthetic polypeptide
QVQLQESGGGSVQAGGSLRLSCVASASTYCTYDMHWYRQAPGKGREFVSAIDSDGTTRYADSVKGRFTISQGTAKNTVYLQMNSLQPEDTAMYYCKTVCVVGSRWSDYWGQGTQVTVSSGGGSQVQLQESGGGLVQPGGSLRLSCAASGFTFSLSGMSWVRQAPGKGLEWVSAISSGGASTYYTDSVKGRFTISRDNAKNMLYLQLNSLKTEDTAMYYCAKGGSGYGDASRMTSPGSQGTQVTVSS

SEQ ID NO: 613 - protein, 243 aa, synthetic construct
  source 1..243: note = Description of Artificial Sequence: Synthetic polypeptide
QVQLQESGGGSVQAGGSLRLSCVASASTYCTYDMHWYRQAPGKGREFVSAIDSDGTTRYADSVKGRFTISQGTAKNTVYLQMNSLQPEDTAMYYCKTVCVVGSRWSDYWGQGTQVTVSSGGGSQVQLQESGGGSVQAGGSLRLSCVASGYVSCDYFLPSWYRQAPGKEREFVSIIDGTGSTSYAASVKGRFTASQDKGKNIAYLQMNSLKPEDTAMYYCKASCVRGRGISEYWGQGTQVTVSS

SEQ ID NO: 614 - protein, 246 aa, synthetic construct
  source 1..246: note = Description of Artificial Sequence: Synthetic polypeptide
QVQLQESGGGSVQAGGSLRLSCVASASTYCTYDMHWYRQAPGKGREFVSAIDSDGTTRYADSVKGRFTISQGTAKNTVYLQMNSLQPEDTAMYYCKTVCVVGSRWSDYWGQGTQVTVSSGGGSQVQLQESGGGLVQPGGSLRLSCAASGFTFSSYPMSWVRQAPGKGLEWVSTISSGGDTTLYADSVKGRFTSSRDNAKNTLYLQLNSLKTEDTAMYYCAKRIDCNSGYCYKRSYWGQGTQVTVSS

SEQ ID NO: 615 - protein, 252 aa, synthetic construct
  source 1..252: note = Description of Artificial Sequence: Synthetic polypeptide
QVQLQESGGGSVQAGGSLRLSCVASASTYCTYDMHWYRQAPGKGREFVSAIDSDGTTRYADSVKGRFTISQGTAKNTVYLQMNSLQPEDTAMYYCKTVCVVGSRWSDYWGQGTQVTVSSGGGSQVQLQESGGGSVQAGGSLRLSCRASGSTYSNYCLGWFRQTTGKEREGVAVINWVGGMLYFADSVKGRFTVSQDQAKNTVYLQMNSLKPEDTAMYYCAAESVSSFSCGGWLTRPDRVPYWGQGTQVTVSS

SEQ ID NO: 616 - protein, 252 aa, synthetic construct
  source 1..252: note = Description of Artificial Sequence: Synthetic polypeptide
QVQLQESGGGSVQAGGSLRLSCVASASTYCTYDMHWYRQAPGKGREFVSAIDSDGTTRYADSVKGRFTISQGTAKNTVYLQMNSLQPEDTAMYYCKTVCVVGSRWSDYWGQGTQVTVSSGGGSQVQLQESGGGSVQAGGSLRLSCRASRSPYGNYCLGWFRQSTGKEREGVAVINWVGGMLYFADSVKGRFTVSQDHAKNTVTLQMNSLKPEDTAMYYCAAESVSSFSCGGWLTRPDRVPYWGQGTQVTVSS

SEQ ID NO: 617 - protein, 246 aa, synthetic construct
  source 1..246: note = Description of Artificial Sequence: Synthetic polypeptide
QVQLQESGGGSVQAGGSLRLSCVASASTYCTYDMHWYRQAPGKGREFVSAIDSDGTTRYADSVKGRFTISQGTAKNTVYLQMNSLQPEDTAMYYCKTVCVVGSRWSDYWGQGTQVTVSSGGGSQVQLQESGGGLVQPGGSLRLSCAASGFTFSHSGMSWVRQAPGKGLEWVSTINSGGASTYYTDSVKGRFTISRDNAKNMLYLQLNSLKTEDTAMYYCAKGGSGYGDASRMTSPGSQGTQVTVSS

SEQ ID NO: 618 - protein, 244 aa, synthetic construct
  source 1..244: note = Description of Artificial Sequence: Synthetic polypeptide
QVQLQESGGGSVQAGGSLTLSCAASEYAYSTCNMGWYRQAPGKERELVSAFISDGSTYYADSVKGRFTITRDNAKNTVYLQMNSLKPEDTAIYYCSANCYRRLRNYWGQGTQVTVSSGGGSQVQLQESGGGLVQPGGSLRLSCAASGFTFSLSGMSWVRQAPGKGLEWVSAISSGGASTYYTDSVKGRFTISRDNAKNILYLQLNSLKTEDTAMYYCAKGGSGYGDASRMTSPGSQGTQVTVSS

SEQ ID NO: 619 - protein, 241 aa, synthetic construct
  source 1..241: note = Description of Artificial Sequence: Synthetic polypeptide
QVQLQESGGGSVQAGGSLTLSCAASEYAYSTCNMGWYRQAPGKERELVSAFISDGSTYYADSVKGRFTITRDNAKNTVYLQMNSLKPEDTAIYYCSANCYRRLRNYWGQGTQVTVSSGGGSQVQLQESGGGSVQAGGSLRLSCVASGYVSCDYFLPSWYRQAPGKEREFVSIIDGTGSTSYAASVKGRFTASEDKGKNIAYLQMNSLKPEDTAMYYCKASCVRGRAVSEYWGQGTQVTVSS

SEQ ID NO: 620 - protein, 241 aa, synthetic construct
  source 1..241: note = Description of Artificial Sequence: Synthetic polypeptide
QVQLQESGGGSVQAGGSLTLSCAASEYAYSTCNMGWYRQAPGKERELVSAFISDGSTYYADSVKGRFTITRDNAKNTVYLQMNSLKPEDTAIYYCSANCYRRLRNYWGQGTQVTVSSGGGSQVQLQESGGGSVQAGGSLRLSCTASGYVSCDYFLPSWYRQAPGKEREFVSVIDGTGSTSYAASVKGRFTASQDKGKNIAYLQMNSLKPEDTAMYYCKASCVRGRAISEYWGQGTQVTVSS

SEQ ID NO: 621 - protein, 244 aa, synthetic construct
  source 1..244: note = Description of Artificial Sequence: Synthetic polypeptide
QVQLQESGGGSVQAGGSLTLSCAASEYAYSTCNMGWYRQAPGKERELVSAFISDGSTYYADSVKGRFTITRDNAKNTVYLQMNSLKPEDTAIYYCSANCYRRLRNYWGQGTQVTVSSGGGSQVQLQESGGGLVQPGGSLRLSCAASGFTFSSYPMSWVRQAPGKGLEWISTISAGGDTTLYADSVKGRFTSSRDNAKNTLYLQLNSLKTEDTAIYYCAKRIDCNSGYCYRRNYWGQGTQVTVSS

SEQ ID NO: 622 - protein, 244 aa, synthetic construct
  source 1..244: note = Description of Artificial Sequence: Synthetic polypeptide
QVQLQESGGGSVQAGGSLTLSCAASEYAYSTCNMGWYRQAPGKERELVSAFISDGSTYYADSVKGRFTITRDNAKNTVYLQMNSLKPEDTAIYYCSANCYRRLRNYWGQGTQVTVSSGGGSQVQLQESGGGSVQVGGSLRLSCAASGFTFSSYPMSWVRQAPGKGLEWISTISAGGDTTLYADSVKGRFTSSRDNAKNTLYLQLNSLKTEDTAIYYCAKRIDCNSGYCYRRNYWGQGTQVTVSS

SEQ ID NO: 623 - protein, 250 aa, synthetic construct
  source 1..250: note = Description of Artificial Sequence: Synthetic polypeptide
QVQLQESGGGSVQAGGSLTLSCAASEYAYSTCNMGWYRQAPGKERELVSAFISDGSTYYADSVKGRFTITRDNAKNTVYLQMNSLKPEDTAIYYCSANCYRRLRNYWGQGTQVTVSSGGGSQVQLQESGGGSVQAGGSLRLSCRASGSTYSNYCLGWFRQITGKEREGVAVINWVGGMLYFADSVKGRFTVSQDQAKNTLYLQMNSLKPEDTAMYYCAAESVSSFSCGGWLTRPDRVPYWGQGTQVTVSS

SEQ ID NO: 624 - protein, 250 aa, synthetic construct
  source 1..250: note = Description of Artificial Sequence: Synthetic polypeptide
QVQLQESGGGSVQAGGSLTLSCAASEYAYSTCNMGWYRQAPGKERELVSAFISDGSTYYADSVKGRFTITRDNAKNTVYLQMNSLKPEDTAIYYCSANCYRRLRNYWGQGTQVTVSSGGGSQVQLQESGGGSVQAGGSLRLSCRASGSTYSNYCLGWFRQSTGKEREGVAVINWVGGMLYFADSVKGRFTVSQDHAKNTVTLQMNSLKPEDTAMYYCAAESVSSFSCGGWLTRPGRVPYWGQGTQVTVSS

SEQ ID NO: 625 - protein, 250 aa, synthetic construct
  source 1..250: note = Description of Artificial Sequence: Synthetic polypeptide
QVQLQESGGGSVQAGGSLTLSCAASEYAYSTCNMGWYRQAPGKERELVSAFISDGSTYYADSVKGRFTITRDNAKNTVYLQMNSLKPEDTAIYYCSANCYRRLRNYWGQGTQVTVSSGGGSQVQLQESGGGSVQAGESLRLSCRASGSTYSNYCLGWFRQITGKEREGVAVINWVGGMLYFADSVKGRFTVSQDQAKNTVYLEMNSLKPEDTAMYYCATESVSSFSCGGWLTRPDRVPYWGQGTQVTVSS

SEQ ID NO: 626 - protein, 241 aa, synthetic construct
  source 1..241: note = Description of Artificial Sequence: Synthetic polypeptide
QVQLQESGGGSVQAGGSLTLSCAASEYAYSTCNMGWYRQAPGKERELVSAFISDGSTYYADSVKGRFTITRDNAKNTVYLQMNSLKPEDTAIYYCSANCYRRLRNYWGQGTQVTVSSGGGSQVQLQESGGGSVQAGGSLRLSCVASGYVSCDYFLPSWYRQAPGKEREFVSIIDGTGSTSYAASVKGRFTASQDRGKNIAYLQMNSLKPEDTAMYYCKASCVRGRTISEYWGQGTQVTVSS

SEQ ID NO: 627 - protein, 241 aa, synthetic construct
  source 1..241: note = Description of Artificial Sequence: Synthetic polypeptide
QVQLQESGGGSVQAGGSLTLSCAASEYAYSTCNMGWYRQAPGKERELVSAFISDGSTYYADSVKGRFTITRDNAKNTVYLQMNSLKPEDTAIYYCSANCYRRLRNYWGQGTQVTVSSGGGSQVQLQESGGGSVQAGGSLRLSCVASGYVSCDYFLPSWYRQAPGKEREFVSIIDGTGSTSYAASVKGRFTASQDKGKNIAYLQMNSLKPEDTAMYYCKASCVRGRAISEYWGQGTQVTVSS

SEQ ID NO: 628 - protein, 250 aa, synthetic construct
  source 1..250: note = Description of Artificial Sequence: Synthetic polypeptide
QVQLQESGGGSVQAGGSLTLSCAASEYAYSTCNMGWYRQAPGKERELVSAFISDGSTYYADSVKGRFTITRDNAKNTVYLQMNSLKPEDTAIYYCSANCYRRLRNYWGQGTQVTVSSGGGSQVQLQESGGGSVQAGGSLRLSCRASGSTYSNYCLGWFRQITGKEREGVAVINWVGGMLYFADSVKGRFTVSQDQAKNTVYLQMNSLKPEDTAMYYCAAESASSFSCGGWLTRPDRVPYWGQGTQVTVSS

SEQ ID NO: 629 - protein, 244 aa, synthetic construct
  source 1..244: note = Description of Artificial Sequence: Synthetic polypeptide
QVQLQESGGGSVQAGGSLTLSCAASEYAYSTCNMGWYRQAPGKERELVSAFISDGSTYYADSVKGRFTITRDNAKNTVYLQMNSLKPEDTAIYYCSANCYRRLRNYWGQGTQVTVSSGGGSQVQLQESGGGLVQPGGSLRLSCAASGFTFSLSGMSWVRQAPGKGLEWVSAISSGGASTYYTDSVKGRFTISRDNAKNMLYLQLNSLKTEDTAMYYCAKGGSGYGDASRMTSPGSQGTQVTVSS

SEQ ID NO: 630 - protein, 241 aa, synthetic construct
  source 1..241: note = Description of Artificial Sequence: Synthetic polypeptide
QVQLQESGGGSVQAGGSLTLSCAASEYAYSTCNMGWYRQAPGKERELVSAFISDGSTYYADSVKGRFTITRDNAKNTVYLQMNSLKPEDTAIYYCSANCYRRLRNYWGQGTQVTVSSGGGSQVQLQESGGGSVQAGGSLRLSCVASGYVSCDYFLPSWYRQAPGKEREFVSIIDGTGSTSYAASVKGRFTASQDKGKNIAYLQMNSLKPEDTAMYYCKASCVRGRGISEYWGQGTQVTVSS

SEQ ID NO: 631 - protein, 244 aa, synthetic construct
  source 1..244: note = Description of Artificial Sequence: Synthetic polypeptide
QVQLQESGGGSVQAGGSLTLSCAASEYAYSTCNMGWYRQAPGKERELVSAFISDGSTYYADSVKGRFTITRDNAKNTVYLQMNSLKPEDTAIYYCSANCYRRLRNYWGQGTQVTVSSGGGSQVQLQESGGGLVQPGGSLRLSCAASGFTFSSYPMSWVRQAPGKGLEWVSTISSGGDTTLYADSVKGRFTSSRDNAKNTLYLQLNSLKTEDTAMYYCAKRIDCNSGYCYKRSYWGQGTQVTVSS

SEQ ID NO: 632 - protein, 250 aa, synthetic construct
  source 1..250: note = Description of Artificial Sequence: Synthetic polypeptide
QVQLQESGGGSVQAGGSLTLSCAASEYAYSTCNMGWYRQAPGKERELVSAFISDGSTYYADSVKGRFTITRDNAKNTVYLQMNSLKPEDTAIYYCSANCYRRLRNYWGQGTQVTVSSGGGSQVQLQESGGGSVQAGGSLRLSCRASGSTYSNYCLGWFRQTTGKEREGVAVINWVGGMLYFADSVKGRFTVSQDQAKNTVYLQMNSLKPEDTAMYYCAAESVSSFSCGGWLTRPDRVPYWGQGTQVTVSS

SEQ ID NO: 633 - protein, 250 aa, synthetic construct
  source 1..250: note = Description of Artificial Sequence: Synthetic polypeptide
QVQLQESGGGSVQAGGSLTLSCAASEYAYSTCNMGWYRQAPGKERELVSAFISDGSTYYADSVKGRFTITRDNAKNTVYLQMNSLKPEDTAIYYCSANCYRRLRNYWGQGTQVTVSSGGGSQVQLQESGGGSVQAGGSLRLSCRASRSPYGNYCLGWFRQSTGKEREGVAVINWVGGMLYFADSVKGRFTVSQDHAKNTVTLQMNSLKPEDTAMYYCAAESVSSFSCGGWLTRPDRVPYWGQGTQVTVSS

SEQ ID NO: 634 - protein, 244 aa, synthetic construct
  source 1..244: note = Description of Artificial Sequence: Synthetic polypeptide
QVQLQESGGGSVQAGGSLTLSCAASEYAYSTCNMGWYRQAPGKERELVSAFISDGSTYYADSVKGRFTITRDNAKNTVYLQMNSLKPEDTAIYYCSANCYRRLRNYWGQGTQVTVSSGGGSQVQLQESGGGLVQPGGSLRLSCAASGFTFSHSGMSWVRQAPGKGLEWVSTINSGGASTYYTDSVKGRFTISRDNAKNMLYLQLNSLKTEDTAMYYCAKGGSGYGDASRMTSPGSQGTQVTVSS

SEQ ID NO: 635 - protein, 251 aa, synthetic construct
  source 1..251: note = Description of Artificial Sequence: Synthetic polypeptide
QVQLQESGGGLVQPGGSLRLSCTASGLTFDDSVMGWFRQAPGKGREAVSCISSSGANAFYADSVKGRFTISRDNAKNTLYLQMNSLKPEDTATYYCKRGHACAGYYPIPYDDYWGQGTQVTVSSGGGSQVQLQESGGGLVQPGGSLRLSCAASGFTFSLSGMSWVRQAPGKGLEWVSAISSGGASTYYTDSVKGRFTISRDNAKNILYLQLNSLKTEDTAMYYCAKGGSGYGDASRMTSPGSQGTQVTVSS

SEQ ID NO: 636 - protein, 248 aa, synthetic construct
  source 1..248: note = Description of Artificial Sequence: Synthetic polypeptide
QVQLQESGGGLVQPGGSLRLSCTASGLTFDDSVMGWFRQAPGKGREAVSCISSSGANAFYADSVKGRFTISRDNAKNTLYLQMNSLKPEDTATYYCKRGHACAGYYPIPYDDYWGQGTQVTVSSGGGSQVQLQESGGGSVQAGGSLRLSCVASGYVSCDYFLPSWYRQAPGKEREFVSIIDGTGSTSYAASVKGRFTASEDKGKNIAYLQMNSLKPEDTAMYYCKASCVRGRAVSEYWGQGTQVTVSS

SEQ ID NO: 637 - protein, 248 aa, synthetic construct
  source 1..248: note = Description of Artificial Sequence: Synthetic polypeptide
QVQLQESGGGLVQPGGSLRLSCTASGLTFDDSVMGWFRQAPGKGREAVSCISSSGANAFYADSVKGRFTISRDNAKNTLYLQMNSLKPEDTATYYCKRGHACAGYYPIPYDDYWGQGTQVTVSSGGGSQVQLQESGGGSVQAGGSLRLSCTASGYVSCDYFLPSWYRQAPGKEREFVSVIDGTGSTSYAASVKGRFTASQDKGKNIAYLQMNSLKPEDTAMYYCKASCVRGRAISEYWGQGTQVTVSS

SEQ ID NO: 638 - protein, 251 aa, synthetic construct
  source 1..251: note = Description of Artificial Sequence: Synthetic polypeptide
QVQLQESGGGLVQPGGSLRLSCTASGLTFDDSVMGWFRQAPGKGREAVSCISSSGANAFYADSVKGRFTISRDNAKNTLYLQMNSLKPEDTATYYCKRGHACAGYYPIPYDDYWGQGTQVTVSSGGGSQVQLQESGGGLVQPGGSLRLSCAASGFTFSSYPMSWVRQAPGKGLEWISTISAGGDTTLYADSVKGRFTSSRDNAKNTLYLQLNSLKTEDTAIYYCAKRIDCNSGYCYRRNYWGQGTQVTVSS

SEQ ID NO: 639 - protein, 251 aa, synthetic construct
  source 1..251: note = Description of Artificial Sequence: Synthetic polypeptide
QVQLQESGGGLVQPGGSLRLSCTASGLTFDDSVMGWFRQAPGKGREAVSCISSSGANAFYADSVKGRFTISRDNAKNTLYLQMNSLKPEDTATYYCKRGHACAGYYPIPYDDYWGQGTQVTVSSGGGSQVQLQESGGGSVQVGGSLRLSCAASGFTFSSYPMSWVRQAPGKGLEWISTISAGGDTTLYADSVKGRFTSSRDNAKNTLYLQLNSLKTEDTAIYYCAKRIDCNSGYCYRRNYWGQGTQVTVSS

SEQ ID NO: 640 - protein, 257 aa, synthetic construct
  source 1..257: note = Description of Artificial Sequence: Synthetic polypeptide
QVQLQESGGGLVQPGGSLRLSCTASGLTFDDSVMGWFRQAPGKGREAVSCISSSGANAFYADSVKGRFTISRDNAKNTLYLQMNSLKPEDTATYYCKRGHACAGYYPIPYDDYWGQGTQVTVSSGGGSQVQLQESGGGSVQAGGSLRLSCRASGSTYSNYCLGWFRQITGKEREGVAVINWVGGMLYFADSVKGRFTVSQDQAKNTLYLQMNSLKPEDTAMYYCAAESVSSFSCGGWLTRPDRVPYWGQGTQVTVSS

SEQ ID NO: 641 - protein, 257 aa, synthetic construct
  source 1..257: note = Description of Artificial Sequence: Synthetic polypeptide
QVQLQESGGGLVQPGGSLRLSCTASGLTFDDSVMGWFRQAPGKGREAVSCISSSGANAFYADSVKGRFTISRDNAKNTLYLQMNSLKPEDTATYYCKRGHACAGYYPIPYDDYWGQGTQVTVSSGGGSQVQLQESGGGSVQAGGSLRLSCRASGSTYSNYCLGWFRQSTGKEREGVAVINWVGGMLYFADSVKGRFTVSQDHAKNTVTLQMNSLKPEDTAMYYCAAESVSSFSCGGWLTRPGRVPYWGQGTQVTVSS

SEQ ID NO: 642 - protein, 257 aa, synthetic construct
  source 1..257: note = Description of Artificial Sequence: Synthetic polypeptide
QVQLQESGGGLVQPGGSLRLSCTASGLTFDDSVMGWFRQAPGKGREAVSCISSSGANAFYADSVKGRFTISRDNAKNTLYLQMNSLKPEDTATYYCKRGHACAGYYPIPYDDYWGQGTQVTVSSGGGSQVQLQESGGGSVQAGESLRLSCRASGSTYSNYCLGWFRQITGKEREGVAVINWVGGMLYFADSVKGRFTVSQDQAKNTVYLEMNSLKPEDTAMYYCATESVSSFSCGGWLTRPDRVPYWGQGTQVTVSS

SEQ ID NO: 643 - protein, 248 aa, synthetic construct
  source 1..248: note = Description of Artificial Sequence: Synthetic polypeptide
QVQLQESGGGLVQPGGSLRLSCTASGLTFDDSVMGWFRQAPGKGREAVSCISSSGANAFYADSVKGRFTISRDNAKNTLYLQMNSLKPEDTATYYCKRGHACAGYYPIPYDDYWGQGTQVTVSSGGGSQVQLQESGGGSVQAGGSLRLSCVASGYVSCDYFLPSWYRQAPGKEREFVSIIDGTGSTSYAASVKGRFTASQDRGKNIAYLQMNSLKPEDTAMYYCKASCVRGRTISEYWGQGTQVTVSS

SEQ ID NO: 644 - protein, 248 aa, synthetic construct
  source 1..248: note = Description of Artificial Sequence: Synthetic polypeptide
QVQLQESGGGLVQPGGSLRLSCTASGLTFDDSVMGWFRQAPGKGREAVSCISSSGANAFYADSVKGRFTISRDNAKNTLYLQMNSLKPEDTATYYCKRGHACAGYYPIPYDDYWGQGTQVTVSSGGGSQVQLQESGGGSVQAGGSLRLSCVASGYVSCDYFLPSWYRQAPGKEREFVSIIDGTGSTSYAASVKGRFTASQDKGKNIAYLQMNSLKPEDTAMYYCKASCVRGRAISEYWGQGTQVTVSS

SEQ ID NO: 645 - protein, 257 aa, synthetic construct
  source 1..257: note = Description of Artificial Sequence: Synthetic polypeptide
QVQLQESGGGLVQPGGSLRLSCTASGLTFDDSVMGWFRQAPGKGREAVSCISSSGANAFYADSVKGRFTISRDNAKNTLYLQMNSLKPEDTATYYCKRGHACAGYYPIPYDDYWGQGTQVTVSSGGGSQVQLQESGGGSVQAGGSLRLSCRASGSTYSNYCLGWFRQITGKEREGVAVINWVGGMLYFADSVKGRFTVSQDQAKNTVYLQMNSLKPEDTAMYYCAAESASSFSCGGWLTRPDRVPYWGQGTQVTVSS

SEQ ID NO: 646 - protein, 251 aa, synthetic construct
  source 1..251: note = Description of Artificial Sequence: Synthetic polypeptide
QVQLQESGGGLVQPGGSLRLSCTASGLTFDDSVMGWFRQAPGKGREAVSCISSSGANAFYADSVKGRFTISRDNAKNTLYLQMNSLKPEDTATYYCKRGHACAGYYPIPYDDYWGQGTQVTVSSGGGSQVQLQESGGGLVQPGGSLRLSCAASGFTFSLSGMSWVRQAPGKGLEWVSAISSGGASTYYTDSVKGRFTISRDNAKNMLYLQLNSLKTEDTAMYYCAKGGSGYGDASRMTSPGSQGTQVTVSS

SEQ ID NO: 647 - protein, 248 aa, synthetic construct
  source 1..248: note = Description of Artificial Sequence: Synthetic polypeptide
QVQLQESGGGLVQPGGSLRLSCTASGLTFDDSVMGWFRQAPGKGREAVSCISSSGANAFYADSVKGRFTISRDNAKNTLYLQMNSLKPEDTATYYCKRGHACAGYYPIPYDDYWGQGTQVTVSSGGGSQVQLQESGGGSVQAGGSLRLSCVASGYVSCDYFLPSWYRQAPGKEREFVSIIDGTGSTSYAASVKGRFTASQDKGKNIAYLQMNSLKPEDTAMYYCKASCVRGRGISEYWGQGTQVTVSS

SEQ ID NO: 648 - protein, 251 aa, synthetic construct
  source 1..251: note = Description of Artificial Sequence: Synthetic polypeptide
QVQLQESGGGLVQPGGSLRLSCTASGLTFDDSVMGWFRQAPGKGREAVSCISSSGANAFYADSVKGRFTISRDNAKNTLYLQMNSLKPEDTATYYCKRGHACAGYYPIPYDDYWGQGTQVTVSSGGGSQVQLQESGGGLVQPGGSLRLSCAASGFTFSSYPMSWVRQAPGKGLEWVSTISSGGDTTLYADSVKGRFTSSRDNAKNTLYLQLNSLKTEDTAMYYCAKRIDCNSGYCYKRSYWGQGTQVTVSS

SEQ ID NO: 649 - protein, 257 aa, synthetic construct
  source 1..257: note = Description of Artificial Sequence: Synthetic polypeptide
QVQLQESGGGLVQPGGSLRLSCTASGLTFDDSVMGWFRQAPGKGREAVSCISSSGANAFYADSVKGRFTISRDNAKNTLYLQMNSLKPEDTATYYCKRGHACAGYYPIPYDDYWGQGTQVTVSSGGGSQVQLQESGGGSVQAGGSLRLSCRASGSTYSNYCLGWFRQTTGKEREGVAVINWVGGMLYFADSVKGRFTVSQDQAKNTVYLQMNSLKPEDTAMYYCAAESVSSFSCGGWLTRPDRVPYWGQGTQVTVSS

SEQ ID NO: 650 - protein, 257 aa, synthetic construct
  source 1..257: note = Description of Artificial Sequence: Synthetic polypeptide
QVQLQESGGGLVQPGGSLRLSCTASGLTFDDSVMGWFRQAPGKGREAVSCISSSGANAFYADSVKGRFTISRDNAKNTLYLQMNSLKPEDTATYYCKRGHACAGYYPIPYDDYWGQGTQVTVSSGGGSQVQLQESGGGSVQAGGSLRLSCRASRSPYGNYCLGWFRQSTGKEREGVAVINWVGGMLYFADSVKGRFTVSQDHAKNTVTLQMNSLKPEDTAMYYCAAESVSSFSCGGWLTRPDRVPYWGQGTQVTVSS

SEQ ID NO: 651 - protein, 251 aa, synthetic construct
  source 1..251: note = Description of Artificial Sequence: Synthetic polypeptide
QVQLQESGGGLVQPGGSLRLSCTASGLTFDDSVMGWFRQAPGKGREAVSCISSSGANAFYADSVKGRFTISRDNAKNTLYLQMNSLKPEDTATYYCKRGHACAGYYPIPYDDYWGQGTQVTVSSGGGSQVQLQESGGGLVQPGGSLRLSCAASGFTFSHSGMSWVRQAPGKGLEWVSTINSGGASTYYTDSVKGRFTISRDNAKNMLYLQLNSLKTEDTAMYYCAKGGSGYGDASRMTSPGSQGTQVTVSS

SEQ ID NO: 652 - protein, 262 aa, synthetic construct
  source 1..262: note = Description of Artificial Sequence: Synthetic polypeptide
QVQLQESGGGLVQPGGSLRLSCAASGFTFSSYPMSWVRQAPGKGLEWISTISAGGDTTLYADSVKGRFTSSRDNAKNTLYLQLNSLKTEDAAIYYCAKRIDCNSGYCYRRNYWGQGTQVTVSSGGSGGSGGSGQVQLQESGGGSVQAGGSLRLSCTASGAIASGYIDSRWCMAWFRQAPGKEREGVAAIWPGGGLTVYADSVKGRFTISRDHAKNTLYLQMNNLKPEDTAMYYCAAGSPRMCPSLEFGFDYWGQGTQVTVSS

SEQ ID NO: 653 - protein, 262 aa, synthetic construct
  source 1..262: note = Description of Artificial Sequence: Synthetic polypeptide
QVQLQESGGGLVQPGGSLRLSCAASGFTFSLSGMSWVRQAPGKGLEWVSAISSGGASTYYTDSVKGRFTISRDNAKNILYLQLNSLKTEDTAMYYCAKGGSGYGDASRMTSPGSQGTQVTVSSGGSGGSGGSGQVQLQESGGGSVQAGGSLRLSCTASGAIASGYIDSRWCMAWFRQAPGKEREGVAAIWPGGGLTVYADSVKGRFTISRDHAKNTLYLQMNNLKPEDTAMYYCAAGSPRMCPSLEFGFDYWGQGTQVTVSS

SEQ ID NO: 654 - protein, 259 aa, synthetic construct
  source 1..259: note = Description of Artificial Sequence: Synthetic polypeptide
QVQLQESGGGSVQAGGSLRLSCVASGYVSCDYFLPSWYRQAPGKEREFVSIIDGTGSTSYAASVKGRFTASEDKGKNIAYLQMNSLKPEDTAMYYCKASCVRGRAVSEYWGQGTQVTVSSGGSGGSGGSGQVQLQESGGGSVQAGGSLRLSCTASGAIASGYIDSRWCMAWFRQAPGKEREGVAAIWPGGGLTVYADSVKGRFTISRDHAKNTLYLQMNNLKPEDTAMYYCAAGSPRMCPSLEFGFDYWGQGTQVTVSS

SEQ ID NO: 655 - protein, 263 aa, synthetic construct
  source 1..263: note = Description of Artificial Sequence: Synthetic polypeptide
QVQLQESGGGLVQPGESLRLSCTASGFTFSNYAMSWVRQAPGKGLEWVSGINVAYGITSYADSVKGRFTISRDNTKNTLYLQLNSLKTEDTAIYYCVKHSGTTIPRGFISYTKRGQGTQVTVSSGGSGGSGGSGQVQLQESGGGSVQAGGSLRLSCTASGAIASGYIDSRWCMAWFRQAPGKEREGVAAIWPGGGLTVYADSVKGRFTISRDHAKNTLYLQMNNLKPEDTAMYYCAAGSPRMCPSLEFGFDYWGQGTQVTVSS

SEQ ID NO: 656 - protein, 259 aa, synthetic construct
  source 1..259: note = Description of Artificial Sequence: Synthetic polypeptide
QVQLQESGGGSVQAGGSLRLSCTASGYVSCDYFLPSWYRQAPGKEREFVSVIDGTGSTSYAASVKGRFTASQDKGKNIAYLQMNSLKPEDTAMYYCKASCVRGRAISEYWGQGTQVTVSSGGSGGSGGSGQVQLQESGGGSVQAGGSLRLSCTASGAIASGYIDSRWCMAWFRQAPGKEREGVAAIWPGGGLTVYADSVKGRFTISRDHAKNTLYLQMNNLKPEDTAMYYCAAGSPRMCPSLEFGFDYWGQGTQVTVSS

SEQ ID NO: 657 - protein, 258 aa, synthetic construct
  source 1..258: note = Description of Artificial Sequence: Synthetic polypeptide
QVQLQESGGGLVQPGGSLRLSCAASGFSFSSYAMKWVRQAPGKGLEWVSTISSGGSSTNYADSVKGRFTISRDNAKNTLYLQLNSLKIEDTAMYYCAKAIVPTGATMERGQGTQVTVSSGGSGGSGGSGQVQLQESGGGSVQAGGSLRLSCTASGAIASGYIDSRWCMAWFRQAPGKEREGVAAIWPGGGLTVYADSVKGRFTISRDHAKNTLYLQMNNLKPEDTAMYYCAAGSPRMCPSLEFGFDYWGQGTQVTVSS

SEQ ID NO: 658 - protein, 262 aa, synthetic construct
  source 1..262: note = Description of Artificial Sequence: Synthetic polypeptide
QVQLQESGGGLVQPGGSLRLSCAASGFTFSSYPMSWVRQAPGKGLEWISTISAGGDTTLYADSVKGRFTSSRDNAKNTLYLQLNSLKTEDTAIYYCAKRIDCNSGYCYRRNYWGQGTQVTVSSGGSGGSGGSGQVQLQESGGGSVQAGGSLRLSCTASGAIASGYIDSRWCMAWFRQAPGKEREGVAAIWPGGGLTVYADSVKGRFTISRDHAKNTLYLQMNNLKPEDTAMYYCAAGSPRMCPSLEFGFDYWGQGTQVTVSS

SEQ ID NO: 659 - protein, 262 aa, synthetic construct
  source 1..262: note = Description of Artificial Sequence: Synthetic polypeptide
QVQLQESGGGSVQVGGSLRLSCAASGFTFSSYPMSWVRQAPGKGLEWISTISAGGDTTLYADSVKGRFTSSRDNAKNTLYLQLNSLKTEDTAIYYCAKRIDCNSGYCYRRNYWGQGTQVTVSSGGSGGSGGSGQVQLQESGGGSVQAGGSLRLSCTASGAIASGYIDSRWCMAWFRQAPGKEREGVAAIWPGGGLTVYADSVKGRFTISRDHAKNTLYLQMNNLKPEDTAMYYCAAGSPRMCPSLEFGFDYWGQGTQVTVSS

SEQ ID NO: 660 - protein, 267 aa, synthetic construct
  source 1..267: note = Description of Artificial Sequence: Synthetic polypeptide
QVQLQESGGGSVQSGGSLRLSCAASGFTYSTSNSWMAWFRQAPGKEREGVAAIYTVGGSIFYADSVRGRFTISQDATKNMFYLQMNTLKPEDTAMYYCAAASGRLRGKWFWPYEYNYWGQGTQVTVSSGGSGGSGGSGQVQLQESGGGSVQAGGSLRLSCTASGAIASGYIDSRWCMAWFRQAPGKEREGVAAIWPGGGLTVYADSVKGRFTISRDHAKNTLYLQMNNLKPEDTAMYYCAAGSPRMCPSLEFGFDYWGQGTQVTVSS

SEQ ID NO: 661 - protein, 268 aa, synthetic construct
  source 1..268: note = Description of Artificial Sequence: Synthetic polypeptide
QVQLQESGGGSVQAGGSLRLSCRASGSTYSNYCLGWFRQITGKEREGVAVINWVGGMLYFADSVKGRFTVSQDQAKNTLYLQMNSLKPEDTAMYYCAAESVSSFSCGGWLTRPDRVPYWGQGTQVTVSSGGSGGSGGSGQVQLQESGGGSVQAGGSLRLSCTASGAIASGYIDSRWCMAWFRQAPGKEREGVAAIWPGGGLTVYADSVKGRFTISRDHAKNTLYLQMNNLKPEDTAMYYCAAGSPRMCPSLEFGFDYWGQGTQVTVSS

SEQ ID NO: 662 - protein, 268 aa, synthetic construct
  source 1..268: note = Description of Artificial Sequence: Synthetic polypeptide
QVQLQESGGGSVQAGGSLRLSCRASGSTYSNYCLGWFRQSTGKEREGVAVINWVGGMLYFADSVKGRFTVSQDHAKNTVTLQMNSLKPEDTAMYYCAAESVSSFSCGGWLTRPGRVPYWGQGTQVTVSSGGSGGSGGSGQVQLQESGGGSVQAGGSLRLSCTASGAIASGYIDSRWCMAWFRQAPGKEREGVAAIWPGGGLTVYADSVKGRFTISRDHAKNTLYLQMNNLKPEDTAMYYCAAGSPRMCPSLEFGFDYWGQGTQVTVSS

SEQ ID NO: 663 - protein, 268 aa, synthetic construct
  source 1..268: note = Description of Artificial Sequence: Synthetic polypeptide
QVQLQESGGGSVQAGESLRLSCRASGSTYSNYCLGWFRQITGKEREGVAVINWVGGMLYFADSVKGRFTVSQDQAKNTVYLEMNSLKPEDTAMYYCATESVSSFSCGGWLTRPDRVPYWGQGTQVTVSSGGSGGSGGSGQVQLQESGGGSVQAGGSLRLSCTASGAIASGYIDSRWCMAWFRQAPGKEREGVAAIWPGGGLTVYADSVKGRFTISRDHAKNTLYLQMNNLKPEDTAMYYCAAGSPRMCPSLEFGFDYWGQGTQVTVSS

SEQ ID NO: 664 - protein, 259 aa, synthetic construct
  source 1..259: note = Description of Artificial Sequence: Synthetic polypeptide
QVQLQESGGGSVQAGGSLRLSCVASGYVSCDYFLPSWYRQAPGKEREFVSIIDGTGSTSYAASVKGRFTASQDRGKNIAYLQMNSLKPEDTAMYYCKASCVRGRTISEYWGQGTQVTVSSGGSGGSGGSGQVQLQESGGGSVQAGGSLRLSCTASGAIASGYIDSRWCMAWFRQAPGKEREGVAAIWPGGGLTVYADSVKGRFTISRDHAKNTLYLQMNNLKPEDTAMYYCAAGSPRMCPSLEFGFDYWGQGTQVTVSS

SEQ ID NO: 665 - protein, 259 aa, synthetic construct
  source 1..259: note = Description of Artificial Sequence: Synthetic polypeptide
QVQLQESGGGSVQAGGSLRLSCVASGYVSCDYFLPSWYRQAPGKEREFVSIIDGTGSTSYAASVKGRFTASQDKGKNIAYLQMNSLKPEDTAMYYCKASCVRGRAISEYWGQGTQVTVSSGGSGGSGGSGQVQLQESGGGSVQAGGSLRLSCTASGAIASGYIDSRWCMAWFRQAPGKEREGVAAIWPGGGLTVYADSVKGRFTISRDHAKNTLYLQMNNLKPEDTAMYYCAAGSPRMCPSLEFGFDYWGQGTQVTVSS

SEQ ID NO: 666 - protein, 259 aa, synthetic construct
  source 1..259: note = Description of Artificial Sequence: Synthetic polypeptide
QVQLQESGGGSVQAGGSLRLSCVASGYVSCDYFLPSWYRQAPGKEREFVSIIDGTGSTSYAASVKGRFTASQDKGKNIAYLQMNTLKPEDTAMYYCKASCVRGRAISEYWGQGTQVTVSSGGSGGSGGSGQVQLQESGGGSVQAGGSLRLSCTASGAIASGYIDSRWCMAWFRQAPGKEREGVAAIWPGGGLTVYADSVKGRFTISRDHAKNTLYLQMNNLKPEDTAMYYCAAGSPRMCPSLEFGFDYWGQGTQVTVSS

SEQ ID NO: 667 - protein, 268 aa, synthetic construct
  source 1..268: note = Description of Artificial Sequence: Synthetic polypeptide
QVQLQESGGGSVQAGGSLRLSCRASGSTYSNYCLGWFRQITGKEREGVAVINWVGGMLYFADSVKGRFTVSQDQAKNTVYLQMNSLKPEDTAMYYCAAESASSFSCGGWLTRPDRVPYWGQGTQVTVSSGGSGGSGGSGQVQLQESGGGSVQAGGSLRLSCTASGAIASGYIDSRWCMAWFRQAPGKEREGVAAIWPGGGLTVYADSVKGRFTISRDHAKNTLYLQMNNLKPEDTAMYYCAAGSPRMCPSLEFGFDYWGQGTQVTVSS

SEQ ID NO: 668 - protein, 262 aa, synthetic construct
  source 1..262: note = Description of Artificial Sequence: Synthetic polypeptide
QVQLQESGGGLVQPGGSLRLSCAASGFTFSLSGMSWVRQAPGKGLEWVSAISSGGASTYYTDSVKGRFTISRDNAKNMLYLQLNSLKTEDTAMYYCAKGGSGYGDASRMTSPGSQGTQVTVSSGGSGGSGGSGQVQLQESGGGSVQAGGSLRLSCTASGAIASGYIDSRWCMAWFRQAPGKEREGVAAIWPGGGLTVYADSVKGRFTISRDHAKNTLYLQMNNLKPEDTAMYYCAAGSPRMCPSLEFGFDYWGQGTQVTVSS

SEQ ID NO: 669 - protein, 259 aa, synthetic construct
  source 1..259: note = Description of Artificial Sequence: Synthetic polypeptide
QVQLQESGGGSVQAGGSLRLSCVASGYVSCDYFLPSWYRQAPGKEREFVSIIDGTGSTSYAASVKGRFTASQDKGKNIAYLQMNSLKPEDTAMYYCKASCVRGRGISEYWGQGTQVTVSSGGSGGSGGSGQVQLQESGGGSVQAGGSLRLSCTASGAIASGYIDSRWCMAWFRQAPGKEREGVAAIWPGGGLTVYADSVKGRFTISRDHAKNTLYLQMNNLKPEDTAMYYCAAGSPRMCPSLEFGFDYWGQGTQVTVSS

SEQ ID NO: 670 - protein, 268 aa, synthetic construct
  source 1..268: note = Description of Artificial Sequence: Synthetic polypeptide
QVQLQESGGGSVQAGGSLRLSCRASGSTYSNYCLGWFRQITGKEREGVAVINWVGGMLYFADSVKGRFTVSQDQAKNTVYLQMNSLKPEDTAMYYCAAESVSSFSCGGWLTRPDRVPYWGQGTQVTVSSGGSGGSGGSGQVQLQESGGGSVQAGGSLRLSCTASGAIASGYIDSRWCMAWFRQAPGKEREGVAAIWPGGGLTVYADSVKGRFTISRDHAKNTLYLQMNNLKPEDTAMYYCAAGSPRMCPSLEFGFDYWGQGTQVTVSS

SEQ ID NO: 671 - protein, 262 aa, synthetic construct
  source 1..262: note = Description of Artificial Sequence: Synthetic polypeptide
QVQLQESGGGLVQPGGSLRLSCAASGFTFSSYPMSWVRQAPGKGLEWVSTISSGGDTTLYADSVKGRFTSSRDNAKNTLYLQLNSLKTEDTAMYYCAKRIDCNSGYCYKRSYWGQGTQVTVSSGGSGGSGGSGQVQLQESGGGSVQAGGSLRLSCTASGAIASGYIDSRWCMAWFRQAPGKEREGVAAIWPGGGLTVYADSVKGRFTISRDHAKNTLYLQMNNLKPEDTAMYYCAAGSPRMCPSLEFGFDYWGQGTQVTVSS

SEQ ID NO: 672 - protein, 262 aa, synthetic construct
  source 1..262: note = Description of Artificial Sequence: Synthetic polypeptide
QVQLQESGGGLVQPGGSLRLSCAASGFTFSLSSMSWVRQAPGKGLEWVSAISSGGASTYYTDSVKGRFTISRDNAKNMLYLQLNSLKTEDTAMYYCAKGGSGYGDASRMTSPGSQGTQVTVSSGGSGGSGGSGQVQLQESGGGSVQAGGSLRLSCTASGAIASGYIDSRWCMAWFRQAPGKEREGVAAIWPGGGLTVYADSVKGRFTISRDHAKNTLYLQMNNLKPEDTAMYYCAAGSPRMCPSLEFGFDYWGQGTQVTVSS

SEQ ID NO: 673 - protein, 268 aa, synthetic construct
  source 1..268: note = Description of Artificial Sequence: Synthetic polypeptide
QVQLQESGGGSVQAGGSLRLSCRASGSTYSNYCLGWFRQTTGKEREGVAVINWVGGMLYFADSVKGRFTVSQDQAKNTVYLQMNSLKPEDTAMYYCAAESVSSFSCGGWLTRPDRVPYWGQGTQVTVSSGGSGGSGGSGQVQLQESGGGSVQAGGSLRLSCTASGAIASGYIDSRWCMAWFRQAPGKEREGVAAIWPGGGLTVYADSVKGRFTISRDHAKNTLYLQMNNLKPEDTAMYYCAAGSPRMCPSLEFGFDYWGQGTQVTVSS

SEQ ID NO: 674 - protein, 268 aa, synthetic construct
  source 1..268: note = Description of Artificial Sequence: Synthetic polypeptide
QVQLQESGGGSVQAGGSLRLSCRASRSPYGNYCLGWFRQSTGKEREGVAVINWVGGMLYFADSVKGRFTVSQDHAKNTVTLQMNSLKPEDTAMYYCAAESVSSFSCGGWLTRPDRVPYWGQGTQVTVSSGGSGGSGGSGQVQLQESGGGSVQAGGSLRLSCTASGAIASGYIDSRWCMAWFRQAPGKEREGVAAIWPGGGLTVYADSVKGRFTISRDHAKNTLYLQMNNLKPEDTAMYYCAAGSPRMCPSLEFGFDYWGQGTQVTVSS

SEQ ID NO: 675 - protein, 262 aa, synthetic construct
  source 1..262: note = Description of Artificial Sequence: Synthetic polypeptide
QVQLQESGGGLVQPGGSLRLSCAASGFTFSHSGMSWVRQAPGKGLEWVSTINSGGASTYYTDSVKGRFTISRDNAKNMLYLQLNSLKTEDTAMYYCAKGGSGYGDASRMTSPGSQGTQVTVSSGGSGGSGGSGQVQLQESGGGSVQAGGSLRLSCTASGAIASGYIDSRWCMAWFRQAPGKEREGVAAIWPGGGLTVYADSVKGRFTISRDHAKNTLYLQMNNLKPEDTAMYYCAAGSPRMCPSLEFGFDYWGQGTQVTVSS

SEQ ID NO: 676 - protein, 256 aa, synthetic construct
  source 1..256: note = Description of Artificial Sequence: Synthetic polypeptide
QVQLQESGGGLVQPGGSLRLSCAASGFTFSSYPMSWVRQAPGKGLEWISTISAGGDTTLYADSVKGRFTSSRDNAKNTLYLQLNSLKTEDAAIYYCAKRIDCNSGYCYRRNYWGQGTQVTVSSGGSGGSGGSGQVQLQESGGGSVQAGGSLRLSCTAPGFTSNSCGMDWYRQAPGKEREFVSSISTDGTTGYADSVKGRFTISKDKAKDTVYLQMNSLKPEDTGMYSCKTKDGTIATMELCDFGYWGQGTQVTVSS

SEQ ID NO: 677 - protein, 256 aa, synthetic construct
  source 1..256: note = Description of Artificial Sequence: Synthetic polypeptide
QVQLQESGGGLVQPGGSLRLSCAASGFTFSLSGMSWVRQAPGKGLEWVSAISSGGASTYYTDSVKGRFTISRDNAKNILYLQLNSLKTEDTAMYYCAKGGSGYGDASRMTSPGSQGTQVTVSSGGSGGSGGSGQVQLQESGGGSVQAGGSLRLSCTAPGFTSNSCGMDWYRQAPGKEREFVSSISTDGTTGYADSVKGRFTISKDKAKDTVYLQMNSLKPEDTGMYSCKTKDGTIATMELCDFGYWGQGTQVTVSS

SEQ ID NO: 678 - protein, 253 aa, synthetic construct
  source 1..253: note = Description of Artificial Sequence: Synthetic polypeptide
QVQLQESGGGSVQAGGSLRLSCVASGYVSCDYFLPSWYRQAPGKEREFVSIIDGTGSTSYAASVKGRFTASEDKGKNIAYLQMNSLKPEDTAMYYCKASCVRGRAVSEYWGQGTQVTVSSGGSGGSGGSGQVQLQESGGGSVQAGGSLRLSCTAPGFTSNSCGMDWYRQAPGKEREFVSSISTDGTTGYADSVKGRFTISKDKAKDTVYLQMNSLKPEDTGMYSCKTKDGTIATMELCDFGYWGQGTQVTVSS

SEQ ID NO: 679 - protein, 257 aa, synthetic construct
  source 1..257: note = Description of Artificial Sequence: Synthetic polypeptide
QVQLQESGGGLVQPGESLRLSCTASGFTFSNYAMSWVRQAPGKGLEWVSGINVAYGITSYADSVKGRFTISRDNTKNTLYLQLNSLKTEDTAIYYCVKHSGTTIPRGFISYTKRGQGTQVTVSSGGSGGSGGSGQVQLQESGGGSVQAGGSLRLSCTAPGFTSNSCGMDWYRQAPGKEREFVSSISTDGTTGYADSVKGRFTISKDKAKDTVYLQMNSLKPEDTGMYSCKTKDGTIATMELCDFGYWGQGTQVTVSS

SEQ ID NO: 680 - protein, 253 aa, synthetic construct
  source 1..253: note = Description of Artificial Sequence: Synthetic polypeptide
QVQLQESGGGSVQAGGSLRLSCTASGYVSCDYFLPSWYRQAPGKEREFVSVIDGTGSTSYAASVKGRFTASQDKGKNIAYLQMNSLKPEDTAMYYCKASCVRGRAISEYWGQGTQVTVSSGGSGGSGGSGQVQLQESGGGSVQAGGSLRLSCTAPGFTSNSCGMDWYRQAPGKEREFVSSISTDGTTGYADSVKGRFTISKDKAKDTVYLQMNSLKPEDTGMYSCKTKDGTIATMELCDFGYWGQGTQVTVSS

SEQ ID NO: 681 - protein, 252 aa, synthetic construct
  source 1..252: note = Description of Artificial Sequence: Synthetic polypeptide
QVQLQESGGGLVQPGGSLRLSCAASGFSFSSYAMKWVRQAPGKGLEWVSTISSGGSSTNYADSVKGRFTISRDNAKNTLYLQLNSLKIEDTAMYYCAKAIVPTGATMERGQGTQVTVSSGGSGGSGGSGQVQLQESGGGSVQAGGSLRLSCTAPGFTSNSCGMDWYRQAPGKEREFVSSISTDGTTGYADSVKGRFTISKDKAKDTVYLQMNSLKPEDTGMYSCKTKDGTIATMELCDFGYWGQGTQVTVSS

SEQ ID NO: 682 - protein, 256 aa, synthetic construct
  source 1..256: note = Description of Artificial Sequence: Synthetic polypeptide
QVQLQESGGGLVQPGGSLRLSCAASGFTFSSYPMSWVRQAPGKGLEWISTISAGGDTTLYADSVKGRFTSSRDNAKNTLYLQLNSLKTEDTAIYYCAKRIDCNSGYCYRRNYWGQGTQVTVSSGGSGGSGGSGQVQLQESGGGSVQAGGSLRLSCTAPGFTSNSCGMDWYRQAPGKEREFVSSISTDGTTGYADSVKGRFTISKDKAKDTVYLQMNSLKPEDTGMYSCKTKDGTIATMELCDFGYWGQGTQVTVSS

SEQ ID NO: 683 - protein, 256 aa, synthetic construct
  source 1..256: note = Description of Artificial Sequence: Synthetic polypeptide
QVQLQESGGGSVQVGGSLRLSCAASGFTFSSYPMSWVRQAPGKGLEWISTISAGGDTTLYADSVKGRFTSSRDNAKNTLYLQLNSLKTEDTAIYYCAKRIDCNSGYCYRRNYWGQGTQVTVSSGGSGGSGGSGQVQLQESGGGSVQAGGSLRLSCTAPGFTSNSCGMDWYRQAPGKEREFVSSISTDGTTGYADSVKGRFTISKDKAKDTVYLQMNSLKPEDTGMYSCKTKDGTIATMELCDFGYWGQGTQVTVSS

SEQ ID NO: 684 - protein, 261 aa, synthetic construct
  source 1..261: note = Description of Artificial Sequence: Synthetic polypeptide
QVQLQESGGGSVQSGGSLRLSCAASGFTYSTSNSWMAWFRQAPGKEREGVAAIYTVGGSIFYADSVRGRFTISQDATKNMFYLQMNTLKPEDTAMYYCAAASGRLRGKWFWPYEYNYWGQGTQVTVSSGGSGGSGGSGQVQLQESGGGSVQAGGSLRLSCTAPGFTSNSCGMDWYRQAPGKEREFVSSISTDGTTGYADSVKGRFTISKDKAKDTVYLQMNSLKPEDTGMYSCKTKDGTIATMELCDFGYWGQGTQVTVSS

SEQ ID NO: 685 - protein, 262 aa, synthetic construct
  source 1..262: note = Description of Artificial Sequence: Synthetic polypeptide
QVQLQESGGGSVQAGGSLRLSCRASGSTYSNYCLGWFRQITGKEREGVAVINWVGGMLYFADSVKGRFTVSQDQAKNTLYLQMNSLKPEDTAMYYCAAESVSSFSCGGWLTRPDRVPYWGQGTQVTVSSGGSGGSGGSGQVQLQESGGGSVQAGGSLRLSCTAPGFTSNSCGMDWYRQAPGKEREFVSSISTDGTTGYADSVKGRFTISKDKAKDTVYLQMNSLKPEDTGMYSCKTKDGTIATMELCDFGYWGQGTQVTVSS

SEQ ID NO: 686 - protein, 262 aa, synthetic construct
  source 1..262: note = Description of Artificial Sequence: Synthetic polypeptide
QVQLQESGGGSVQAGGSLRLSCRASGSTYSNYCLGWFRQSTGKEREGVAVINWVGGMLYFADSVKGRFTVSQDHAKNTVTLQMNSLKPEDTAMYYCAAESVSSFSCGGWLTRPGRVPYWGQGTQVTVSSGGSGGSGGSGQVQLQESGGGSVQAGGSLRLSCTAPGFTSNSCGMDWYRQAPGKEREFVSSISTDGTTGYADSVKGRFTISKDKAKDTVYLQMNSLKPEDTGMYSCKTKDGTIATMELCDFGYWGQGTQVTVSS

SEQ ID NO: 687 - protein, 262 aa, synthetic construct
  source 1..262: note = Description of Artificial Sequence: Synthetic polypeptide
QVQLQESGGGSVQAGESLRLSCRASGSTYSNYCLGWFRQITGKEREGVAVINWVGGMLYFADSVKGRFTVSQDQAKNTVYLEMNSLKPEDTAMYYCATESVSSFSCGGWLTRPDRVPYWGQGTQVTVSSGGSGGSGGSGQVQLQESGGGSVQAGGSLRLSCTAPGFTSNSCGMDWYRQAPGKEREFVSSISTDGTTGYADSVKGRFTISKDKAKDTVYLQMNSLKPEDTGMYSCKTKDGTIATMELCDFGYWGQGTQVTVSS

SEQ ID NO: 688 - protein, 253 aa, synthetic construct
  source 1..253: note = Description of Artificial Sequence: Synthetic polypeptide
QVQLQESGGGSVQAGGSLRLSCVASGYVSCDYFLPSWYRQAPGKEREFVSIIDGTGSTSYAASVKGRFTASQDRGKNIAYLQMNSLKPEDTAMYYCKASCVRGRTISEYWGQGTQVTVSSGGSGGSGGSGQVQLQESGGGSVQAGGSLRLSCTAPGFTSNSCGMDWYRQAPGKEREFVSSISTDGTTGYADSVKGRFTISKDKAKDTVYLQMNSLKPEDTGMYSCKTKDGTIATMELCDFGYWGQGTQVTVSS

SEQ ID NO: 689 - protein, 253 aa, synthetic construct
  source 1..253: note = Description of Artificial Sequence: Synthetic polypeptide
QVQLQESGGGSVQAGGSLRLSCVASGYVSCDYFLPSWYRQAPGKEREFVSIIDGTGSTSYAASVKGRFTASQDKGKNIAYLQMNSLKPEDTAMYYCKASCVRGRAISEYWGQGTQVTVSSGGSGGSGGSGQVQLQESGGGSVQAGGSLRLSCTAPGFTSNSCGMDWYRQAPGKEREFVSSISTDGTTGYADSVKGRFTISKDKAKDTVYLQMNSLKPEDTGMYSCKTKDGTIATMELCDFGYWGQGTQVTVSS

SEQ ID NO: 690 - protein, 253 aa, synthetic construct
  source 1..253: note = Description of Artificial Sequence: Synthetic polypeptide
QVQLQESGGGSVQAGGSLRLSCVASGYVSCDYFLPSWYRQAPGKEREFVSIIDGTGSTSYAASVKGRFTASQDKGKNIAYLQMNTLKPEDTAMYYCKASCVRGRAISEYWGQGTQVTVSSGGSGGSGGSGQVQLQESGGGSVQAGGSLRLSCTAPGFTSNSCGMDWYRQAPGKEREFVSSISTDGTTGYADSVKGRFTISKDKAKDTVYLQMNSLKPEDTGMYSCKTKDGTIATMELCDFGYWGQGTQVTVSS

SEQ ID NO: 691 - protein, 262 aa, synthetic construct
  source 1..262: note = Description of Artificial Sequence: Synthetic polypeptide
QVQLQESGGGSVQAGGSLRLSCRASGSTYSNYCLGWFRQITGKEREGVAVINWVGGMLYFADSVKGRFTVSQDQAKNTVYLQMNSLKPEDTAMYYCAAESASSFSCGGWLTRPDRVPYWGQGTQVTVSSGGSGGSGGSGQVQLQESGGGSVQAGGSLRLSCTAPGFTSNSCGMDWYRQAPGKEREFVSSISTDGTTGYADSVKGRFTISKDKAKDTVYLQMNSLKPEDTGMYSCKTKDGTIATMELCDFGYWGQGTQVTVSS

SEQ ID NO: 692 - protein, 256 aa, synthetic construct
  source 1..256: note = Description of Artificial Sequence: Synthetic polypeptide
QVQLQESGGGLVQPGGSLRLSCAASGFTFSLSGMSWVRQAPGKGLEWVSAISSGGASTYYTDSVKGRFTISRDNAKNMLYLQLNSLKTEDTAMYYCAKGGSGYGDASRMTSPGSQGTQVTVSSGGSGGSGGSGQVQLQESGGGSVQAGGSLRLSCTAPGFTSNSCGMDWYRQAPGKEREFVSSISTDGTTGYADSVKGRFTISKDKAKDTVYLQMNSLKPEDTGMYSCKTKDGTIATMELCDFGYWGQGTQVTVSS

SEQ ID NO: 693 - protein, 253 aa, synthetic construct
  source 1..253: note = Description of Artificial Sequence: Synthetic polypeptide
QVQLQESGGGSVQAGGSLRLSCVASGYVSCDYFLPSWYRQAPGKEREFVSIIDGTGSTSYAASVKGRFTASQDKGKNIAYLQMNSLKPEDTAMYYCKASCVRGRGISEYWGQGTQVTVSSGGSGGSGGSGQVQLQESGGGSVQAGGSLRLSCTAPGFTSNSCGMDWYRQAPGKEREFVSSISTDGTTGYADSVKGRFTISKDKAKDTVYLQMNSLKPEDTGMYSCKTKDGTIATMELCDFGYWGQGTQVTVSS

SEQ ID NO: 694 - protein, 262 aa, synthetic construct
  source 1..262: note = Description of Artificial Sequence: Synthetic polypeptide
QVQLQESGGGSVQAGGSLRLSCRASGSTYSNYCLGWFRQITGKEREGVAVINWVGGMLYFADSVKGRFTVSQDQAKNTVYLQMNSLKPEDTAMYYCAAESVSSFSCGGWLTRPDRVPYWGQGTQVTVSSGGSGGSGGSGQVQLQESGGGSVQAGGSLRLSCTAPGFTSNSCGMDWYRQAPGKEREFVSSISTDGTTGYADSVKGRFTISKDKAKDTVYLQMNSLKPEDTGMYSCKTKDGTIATMELCDFGYWGQGTQVTVSS

SEQ ID NO: 695 - protein, 256 aa, synthetic construct
  source 1..256: note = Description of Artificial Sequence: Synthetic polypeptide
QVQLQESGGGLVQPGGSLRLSCAASGFTFSSYPMSWVRQAPGKGLEWVSTISSGGDTTLYADSVKGRFTSSRDNAKNTLYLQLNSLKTEDTAMYYCAKRIDCNSGYCYKRSYWGQGTQVTVSSGGSGGSGGSGQVQLQESGGGSVQAGGSLRLSCTAPGFTSNSCGMDWYRQAPGKEREFVSSISTDGTTGYADSVKGRFTISKDKAKDTVYLQMNSLKPEDTGMYSCKTKDGTIATMELCDFGYWGQGTQVTVSS

SEQ ID NO: 696 - protein, 256 aa, synthetic construct
  source 1..256: note = Description of Artificial Sequence: Synthetic polypeptide
QVQLQESGGGLVQPGGSLRLSCAASGFTFSLSSMSWVRQAPGKGLEWVSAISSGGASTYYTDSVKGRFTISRDNAKNMLYLQLNSLKTEDTAMYYCAKGGSGYGDASRMTSPGSQGTQVTVSSGGSGGSGGSGQVQLQESGGGSVQAGGSLRLSCTAPGFTSNSCGMDWYRQAPGKEREFVSSISTDGTTGYADSVKGRFTISKDKAKDTVYLQMNSLKPEDTGMYSCKTKDGTIATMELCDFGYWGQGTQVTVSS

SEQ ID NO: 697 - protein, 262 aa, synthetic construct
  source 1..262: note = Description of Artificial Sequence: Synthetic polypeptide
QVQLQESGGGSVQAGGSLRLSCRASGSTYSNYCLGWFRQTTGKEREGVAVINWVGGMLYFADSVKGRFTVSQDQAKNTVYLQMNSLKPEDTAMYYCAAESVSSFSCGGWLTRPDRVPYWGQGTQVTVSSGGSGGSGGSGQVQLQESGGGSVQAGGSLRLSCTAPGFTSNSCGMDWYRQAPGKEREFVSSISTDGTTGYADSVKGRFTISKDKAKDTVYLQMNSLKPEDTGMYSCKTKDGTIATMELCDFGYWGQGTQVTVSS

SEQ ID NO: 698 - protein, 262 aa, synthetic construct
  source 1..262: note = Description of Artificial Sequence: Synthetic polypeptide
QVQLQESGGGSVQAGGSLRLSCRASRSPYGNYCLGWFRQSTGKEREGVAVINWVGGMLYFADSVKGRFTVSQDHAKNTVTLQMNSLKPEDTAMYYCAAESVSSFSCGGWLTRPDRVPYWGQGTQVTVSSGGSGGSGGSGQVQLQESGGGSVQAGGSLRLSCTAPGFTSNSCGMDWYRQAPGKEREFVSSISTDGTTGYADSVKGRFTISKDKAKDTVYLQMNSLKPEDTGMYSCKTKDGTIATMELCDFGYWGQGTQVTVSS

SEQ ID NO: 699 - protein, 256 aa, synthetic construct
  source 1..256: note = Description of Artificial Sequence: Synthetic polypeptide
QVQLQESGGGLVQPGGSLRLSCAASGFTFSHSGMSWVRQAPGKGLEWVSTINSGGASTYYTDSVKGRFTISRDNAKNMLYLQLNSLKTEDTAMYYCAKGGSGYGDASRMTSPGSQGTQVTVSSGGSGGSGGSGQVQLQESGGGSVQAGGSLRLSCTAPGFTSNSCGMDWYRQAPGKEREFVSSISTDGTTGYADSVKGRFTISKDKAKDTVYLQMNSLKPEDTGMYSCKTKDGTIATMELCDFGYWGQGTQVTVSS

SEQ ID NO: 700 - protein, 261 aa, synthetic construct
  source 1..261: note = Description of Artificial Sequence: Synthetic polypeptide
QVQLQESGGGLVQPGGSLRLSCAASGFTFSSYPMSWVRQAPGKGLEWISTISAGGDTTLYADSVKGRFTSSRDNAKNTLYLQLNSLKTEDAAIYYCAKRIDCNSGYCYRRNYWGQGTQVTVSSGGSGGSGGSGQVQLQESGGGSVQAGGSLRLSCAASGYPYSNGYMGWFRQAPGKEREGVATIYTGDGRTYYADSVKGRFTISRDNAKNTVDLQMSSLKPEDTAMYYCAARAAPLYSSGSPLTRARYNVWGQGTQVTVSS

SEQ ID NO: 701 - protein, 261 aa, synthetic construct
  source 1..261: note = Description of Artificial Sequence: Synthetic polypeptide
QVQLQESGGGLVQPGGSLRLSCAASGFTFSLSGMSWVRQAPGKGLEWVSAISSGGASTYYTDSVKGRFTISRDNAKNILYLQLNSLKTEDTAMYYCAKGGSGYGDASRMTSPGSQGTQVTVSSGGSGGSGGSGQVQLQESGGGSVQAGGSLRLSCAASGYPYSNGYMGWFRQAPGKEREGVATIYTGDGRTYYADSVKGRFTISRDNAKNTVDLQMSSLKPEDTAMYYCAARAAPLYSSGSPLTRARYNVWGQGTQVTVSS

SEQ ID NO: 702 - protein, 258 aa, synthetic construct
  source 1..258: note = Description of Artificial Sequence: Synthetic polypeptide
QVQLQESGGGSVQAGGSLRLSCVASGYVSCDYFLPSWYRQAPGKEREFVSIIDGTGSTSYAASVKGRFTASEDKGKNIAYLQMNSLKPEDTAMYYCKASCVRGRAVSEYWGQGTQVTVSSGGSGGSGGSGQVQLQESGGGSVQAGGSLRLSCAASGYPYSNGYMGWFRQAPGKEREGVATIYTGDGRTYYADSVKGRFTISRDNAKNTVDLQMSSLKPEDTAMYYCAARAAPLYSSGSPLTRARYNVWGQGTQVTVSS

SEQ ID NO: 703 - protein, 262 aa, synthetic construct
  source 1..262: note = Description of Artificial Sequence: Synthetic polypeptide
QVQLQESGGGLVQPGESLRLSCTASGFTFSNYAMSWVRQAPGKGLEWVSGINVAYGITSYADSVKGRFTISRDNTKNTLYLQLNSLKTEDTAIYYCVKHSGTTIPRGFISYTKRGQGTQVTVSSGGSGGSGGSGQVQLQESGGGSVQAGGSLRLSCAASGYPYSNGYMGWFRQAPGKEREGVATIYTGDGRTYYADSVKGRFTISRDNAKNTVDLQMSSLKPEDTAMYYCAARAAPLYSSGSPLTRARYNVWGQGTQVTVSS

SEQ ID NO: 704 - protein, 258 aa, synthetic construct
  source 1..258: note = Description of Artificial Sequence: Synthetic polypeptide
QVQLQESGGGSVQAGGSLRLSCTASGYVSCDYFLPSWYRQAPGKEREFVSVIDGTGSTSYAASVKGRFTASQDKGKNIAYLQMNSLKPEDTAMYYCKASCVRGRAISEYWGQGTQVTVSSGGSGGSGGSGQVQLQESGGGSVQAGGSLRLSCAASGYPYSNGYMGWFRQAPGKEREGVATIYTGDGRTYYADSVKGRFTISRDNAKNTVDLQMSSLKPEDTAMYYCAARAAPLYSSGSPLTRARYNVWGQGTQVTVSS

SEQ ID NO: 705 - protein, 257 aa, synthetic construct
  source 1..257: note = Description of Artificial Sequence: Synthetic polypeptide
QVQLQESGGGLVQPGGSLRLSCAASGFSFSSYAMKWVRQAPGKGLEWVSTISSGGSSTNYADSVKGRFTISRDNAKNTLYLQLNSLKIEDTAMYYCAKAIVPTGATMERGQGTQVTVSSGGSGGSGGSGQVQLQESGGGSVQAGGSLRLSCAASGYPYSNGYMGWFRQAPGKEREGVATIYTGDGRTYYADSVKGRFTISRDNAKNTVDLQMSSLKPEDTAMYYCAARAAPLYSSGSPLTRARYNVWGQGTQVTVSS

SEQ ID NO: 706 - protein, 261 aa, synthetic construct
  source 1..261: note = Description of Artificial Sequence: Synthetic polypeptide
QVQLQESGGGLVQPGGSLRLSCAASGFTFSSYPMSWVRQAPGKGLEWISTISAGGDTTLYADSVKGRFTSSRDNAKNTLYLQLNSLKTEDTAIYYCAKRIDCNSGYCYRRNYWGQGTQVTVSSGGSGGSGGSGQVQLQESGGGSVQAGGSLRLSCAASGYPYSNGYMGWFRQAPGKEREGVATIYTGDGRTYYADSVKGRFTISRDNAKNTVDLQMSSLKPEDTAMYYCAARAAPLYSSGSPLTRARYNVWGQGTQVTVSS

SEQ ID NO: 707 - protein, 261 aa, synthetic construct
  source 1..261: note = Description of Artificial Sequence: Synthetic polypeptide
QVQLQESGGGSVQVGGSLRLSCAASGFTFSSYPMSWVRQAPGKGLEWISTISAGGDTTLYADSVKGRFTSSRDNAKNTLYLQLNSLKTEDTAIYYCAKRIDCNSGYCYRRNYWGQGTQVTVSSGGSGGSGGSGQVQLQESGGGSVQAGGSLRLSCAASGYPYSNGYMGWFRQAPGKEREGVATIYTGDGRTYYADSVKGRFTISRDNAKNTVDLQMSSLKPEDTAMYYCAARAAPLYSSGSPLTRARYNVWGQGTQVTVSS

SEQ ID NO: 708 - protein, 266 aa, synthetic construct
  source 1..266: note = Description of Artificial Sequence: Synthetic polypeptide
QVQLQESGGGSVQSGGSLRLSCAASGFTYSTSNSWMAWFRQAPGKEREGVAAIYTVGGSIFYADSVRGRFTISQDATKNMFYLQMNTLKPEDTAMYYCAAASGRLRGKWFWPYEYNYWGQGTQVTVSSGGSGGSGGSGQVQLQESGGGSVQAGGSLRLSCAASGYPYSNGYMGWFRQAPGKEREGVATIYTGDGRTYYADSVKGRFTISRDNAKNTVDLQMSSLKPEDTAMYYCAARAAPLYSSGSPLTRARYNVWGQGTQVTVSS

SEQ ID NO: 709 - protein, 267 aa, synthetic construct
  source 1..267: note = Description of Artificial Sequence: Synthetic polypeptide
QVQLQESGGGSVQAGGSLRLSCRASGSTYSNYCLGWFRQITGKEREGVAVINWVGGMLYFADSVKGRFTVSQDQAKNTLYLQMNSLKPEDTAMYYCAAESVSSFSCGGWLTRPDRVPYWGQGTQVTVSSGGSGGSGGSGQVQLQESGGGSVQAGGSLRLSCAASGYPYSNGYMGWFRQAPGKEREGVATIYTGDGRTYYADSVKGRFTISRDNAKNTVDLQMSSLKPEDTAMYYCAARAAPLYSSGSPLTRARYNVWGQGTQVTVSS

SEQ ID NO: 710 - protein, 267 aa, synthetic construct
  source 1..267: note = Description of Artificial Sequence: Synthetic polypeptide
QVQLQESGGGSVQAGGSLRLSCRASGSTYSNYCLGWFRQSTGKEREGVAVINWVGGMLYFADSVKGRFTVSQDHAKNTVTLQMNSLKPEDTAMYYCAAESVSSFSCGGWLTRPGRVPYWGQGTQVTVSSGGSGGSGGSGQVQLQESGGGSVQAGGSLRLSCAASGYPYSNGYMGWFRQAPGKEREGVATIYTGDGRTYYADSVKGRFTISRDNAKNTVDLQMSSLKPEDTAMYYCAARAAPLYSSGSPLTRARYNVWGQGTQVTVSS

SEQ ID NO: 711 - protein, 267 aa, synthetic construct
  source 1..267: note = Description of Artificial Sequence: Synthetic polypeptide
QVQLQESGGGSVQAGESLRLSCRASGSTYSNYCLGWFRQITGKEREGVAVINWVGGMLYFADSVKGRFTVSQDQAKNTVYLEMNSLKPEDTAMYYCATESVSSFSCGGWLTRPDRVPYWGQGTQVTVSSGGSGGSGGSGQVQLQESGGGSVQAGGSLRLSCAASGYPYSNGYMGWFRQAPGKEREGVATIYTGDGRTYYADSVKGRFTISRDNAKNTVDLQMSSLKPEDTAMYYCAARAAPLYSSGSPLTRARYNVWGQGTQVTVSS

SEQ ID NO: 712 - protein, 258 aa, synthetic construct
  source 1..258: note = Description of Artificial Sequence: Synthetic polypeptide
QVQLQESGGGSVQAGGSLRLSCVASGYVSCDYFLPSWYRQAPGKEREFVSIIDGTGSTSYAASVKGRFTASQDRGKNIAYLQMNSLKPEDTAMYYCKASCVRGRTISEYWGQGTQVTVSSGGSGGSGGSGQVQLQESGGGSVQAGGSLRLSCAASGYPYSNGYMGWFRQAPGKEREGVATIYTGDGRTYYADSVKGRFTISRDNAKNTVDLQMSSLKPEDTAMYYCAARAAPLYSSGSPLTRARYNVWGQGTQVTVSS

SEQ ID NO: 713 - protein, 258 aa, synthetic construct
  source 1..258: note = Description of Artificial Sequence: Synthetic polypeptide
QVQLQESGGGSVQAGGSLRLSCVASGYVSCDYFLPSWYRQAPGKEREFVSIIDGTGSTSYAASVKGRFTASQDKGKNIAYLQMNSLKPEDTAMYYCKASCVRGRAISEYWGQGTQVTVSSGGSGGSGGSGQVQLQESGGGSVQAGGSLRLSCAASGYPYSNGYMGWFRQAPGKEREGVATIYTGDGRTYYADSVKGRFTISRDNAKNTVDLQMSSLKPEDTAMYYCAARAAPLYSSGSPLTRARYNVWGQGTQVTVSS

SEQ ID NO: 714 - protein, 258 aa, synthetic construct
  source 1..258: note = Description of Artificial Sequence: Synthetic polypeptide
QVQLQESGGGSVQAGGSLRLSCVASGYVSCDYFLPSWYRQAPGKEREFVSIIDGTGSTSYAASVKGRFTASQDKGKNIAYLQMNTLKPEDTAMYYCKASCVRGRAISEYWGQGTQVTVSSGGSGGSGGSGQVQLQESGGGSVQAGGSLRLSCAASGYPYSNGYMGWFRQAPGKEREGVATIYTGDGRTYYADSVKGRFTISRDNAKNTVDLQMSSLKPEDTAMYYCAARAAPLYSSGSPLTRARYNVWGQGTQVTVSS

SEQ ID NO: 715 - protein, 267 aa, synthetic construct
  source 1..267: note = Description of Artificial Sequence: Synthetic polypeptide
QVQLQESGGGSVQAGGSLRLSCRASGSTYSNYCLGWFRQITGKEREGVAVINWVGGMLYFADSVKGRFTVSQDQAKNTVYLQMNSLKPEDTAMYYCAAESASSFSCGGWLTRPDRVPYWGQGTQVTVSSGGSGGSGGSGQVQLQESGGGSVQAGGSLRLSCAASGYPYSNGYMGWFRQAPGKEREGVATIYTGDGRTYYADSVKGRFTISRDNAKNTVDLQMSSLKPEDTAMYYCAARAAPLYSSGSPLTRARYNVWGQGTQVTVSS

SEQ ID NO: 716 - protein, 261 aa, synthetic construct
  source 1..261: note = Description of Artificial Sequence: Synthetic polypeptide
QVQLQESGGGLVQPGGSLRLSCAASGFTFSLSGMSWVRQAPGKGLEWVSAISSGGASTYYTDSVKGRFTISRDNAKNMLYLQLNSLKTEDTAMYYCAKGGSGYGDASRMTSPGSQGTQVTVSSGGSGGSGGSGQVQLQESGGGSVQAGGSLRLSCAASGYPYSNGYMGWFRQAPGKEREGVATIYTGDGRTYYADSVKGRFTISRDNAKNTVDLQMSSLKPEDTAMYYCAARAAPLYSSGSPLTRARYNVWGQGTQVTVSS

SEQ ID NO: 717 - protein, 258 aa, synthetic construct
  source 1..258: note = Description of Artificial Sequence: Synthetic polypeptide
QVQLQESGGGSVQAGGSLRLSCVASGYVSCDYFLPSWYRQAPGKEREFVSIIDGTGSTSYAASVKGRFTASQDKGKNIAYLQMNSLKPEDTAMYYCKASCVRGRGISEYWGQGTQVTVSSGGSGGSGGSGQVQLQESGGGSVQAGGSLRLSCAASGYPYSNGYMGWFRQAPGKEREGVATIYTGDGRTYYADSVKGRFTISRDNAKNTVDLQMSSLKPEDTAMYYCAARAAPLYSSGSPLTRARYNVWGQGTQVTVSS

SEQ ID NO: 718 - protein, 267 aa, synthetic construct
  source 1..267: note = Description of Artificial Sequence: Synthetic polypeptide
QVQLQESGGGSVQAGGSLRLSCRASGSTYSNYCLGWFRQITGKEREGVAVINWVGGMLYFADSVKGRFTVSQDQAKNTVYLQMNSLKPEDTAMYYCAAESVSSFSCGGWLTRPDRVPYWGQGTQVTVSSGGSGGSGGSGQVQLQESGGGSVQAGGSLRLSCAASGYPYSNGYMGWFRQAPGKEREGVATIYTGDGRTYYADSVKGRFTISRDNAKNTVDLQMSSLKPEDTAMYYCAARAAPLYSSGSPLTRARYNVWGQGTQVTVSS

SEQ ID NO: 719 - protein, 261 aa, synthetic construct
  source 1..261: note = Description of Artificial Sequence: Synthetic polypeptide
QVQLQESGGGLVQPGGSLRLSCAASGFTFSSYPMSWVRQAPGKGLEWVSTISSGGDTTLYADSVKGRFTSSRDNAKNTLYLQLNSLKTEDTAMYYCAKRIDCNSGYCYKRSYWGQGTQVTVSSGGSGGSGGSGQVQLQESGGGSVQAGGSLRLSCAASGYPYSNGYMGWFRQAPGKEREGVATIYTGDGRTYYADSVKGRFTISRDNAKNTVDLQMSSLKPEDTAMYYCAARAAPLYSSGSPLTRARYNVWGQGTQVTVSS

SEQ ID NO: 720 - protein, 261 aa, synthetic construct
  source 1..261: note = Description of Artificial Sequence: Synthetic polypeptide
QVQLQESGGGLVQPGGSLRLSCAASGFTFSLSSMSWVRQAPGKGLEWVSAISSGGASTYYTDSVKGRFTISRDNAKNMLYLQLNSLKTEDTAMYYCAKGGSGYGDASRMTSPGSQGTQVTVSSGGSGGSGGSGQVQLQESGGGSVQAGGSLRLSCAASGYPYSNGYMGWFRQAPGKEREGVATIYTGDGRTYYADSVKGRFTISRDNAKNTVDLQMSSLKPEDTAMYYCAARAAPLYSSGSPLTRARYNVWGQGTQVTVSS

SEQ ID NO: 721 - protein, 267 aa, synthetic construct
  source 1..267: note = Description of Artificial Sequence: Synthetic polypeptide
QVQLQESGGGSVQAGGSLRLSCRASGSTYSNYCLGWFRQTTGKEREGVAVINWVGGMLYFADSVKGRFTVSQDQAKNTVYLQMNSLKPEDTAMYYCAAESVSSFSCGGWLTRPDRVPYWGQGTQVTVSSGGSGGSGGSGQVQLQESGGGSVQAGGSLRLSCAASGYPYSNGYMGWFRQAPGKEREGVATIYTGDGRTYYADSVKGRFTISRDNAKNTVDLQMSSLKPEDTAMYYCAARAAPLYSSGSPLTRARYNVWGQGTQVTVSS

SEQ ID NO: 722 - protein, 267 aa, synthetic construct
  source 1..267: note = Description of Artificial Sequence: Synthetic polypeptide
QVQLQESGGGSVQAGGSLRLSCRASRSPYGNYCLGWFRQSTGKEREGVAVINWVGGMLYFADSVKGRFTVSQDHAKNTVTLQMNSLKPEDTAMYYCAAESVSSFSCGGWLTRPDRVPYWGQGTQVTVSSGGSGGSGGSGQVQLQESGGGSVQAGGSLRLSCAASGYPYSNGYMGWFRQAPGKEREGVATIYTGDGRTYYADSVKGRFTISRDNAKNTVDLQMSSLKPEDTAMYYCAARAAPLYSSGSPLTRARYNVWGQGTQVTVSS

SEQ ID NO: 723 - protein, 261 aa, synthetic construct
  source 1..261: note = Description of Artificial Sequence: Synthetic polypeptide
QVQLQESGGGLVQPGGSLRLSCAASGFTFSHSGMSWVRQAPGKGLEWVSTINSGGASTYYTDSVKGRFTISRDNAKNMLYLQLNSLKTEDTAMYYCAKGGSGYGDASRMTSPGSQGTQVTVSSGGSGGSGGSGQVQLQESGGGSVQAGGSLRLSCAASGYPYSNGYMGWFRQAPGKEREGVATIYTGDGRTYYADSVKGRFTISRDNAKNTVDLQMSSLKPEDTAMYYCAARAAPLYSSGSPLTRARYNVWGQGTQVTVSS

SEQ ID NO: 724 - protein, 252 aa, synthetic construct
  source 1..252: note = Description of Artificial Sequence: Synthetic polypeptide
QVQLQESGGGLVQPGGSLRLSCAASGFTFSSYPMSWVRQAPGKGLEWISTISAGGDTTLYADSVKGRFTSSRDNAKNTLYLQLNSLKTEDAAIYYCAKRIDCNSGYCYRRNYWGQGTQVTVSSGGSGGSGGSGQVQLQESGGGSVQAGGSLRLSCVASASTYCTYDMHWYRQAPGKGREFVSAIDSDGTTRYADSVKGRFTISQGTAKNTVYLQMNSLQPEDTAMYYCKTVCVVGSRWSDYWGQGTQVTVSS

SEQ ID NO: 725 - protein, 252 aa, synthetic construct
  source 1..252: note = Description of Artificial Sequence: Synthetic polypeptide
QVQLQESGGGLVQPGGSLRLSCAASGFTFSLSGMSWVRQAPGKGLEWVSAISSGGASTYYTDSVKGRFTISRDNAKNILYLQLNSLKTEDTAMYYCAKGGSGYGDASRMTSPGSQGTQVTVSSGGSGGSGGSGQVQLQESGGGSVQAGGSLRLSCVASASTYCTYDMHWYRQAPGKGREFVSAIDSDGTTRYADSVKGRFTISQGTAKNTVYLQMNSLQPEDTAMYYCKTVCVVGSRWSDYWGQGTQVTVSS

SEQ ID NO: 726 - protein, 249 aa, synthetic construct
  source 1..249: note = Description of Artificial Sequence: Synthetic polypeptide
QVQLQESGGGSVQAGGSLRLSCVASGYVSCDYFLPSWYRQAPGKEREFVSIIDGTGSTSYAASVKGRFTASEDKGKNIAYLQMNSLKPEDTAMYYCKASCVRGRAVSEYWGQGTQVTVSSGGSGGSGGSGQVQLQESGGGSVQAGGSLRLSCVASASTYCTYDMHWYRQAPGKGREFVSAIDSDGTTRYADSVKGRFTISQGTAKNTVYLQMNSLQPEDTAMYYCKTVCVVGSRWSDYWGQGTQVTVSS

SEQ ID NO: 727 - protein, 253 aa, synthetic construct
  source 1..253: note = Description of Artificial Sequence: Synthetic polypeptide
QVQLQESGGGLVQPGESLRLSCTASGFTFSNYAMSWVRQAPGKGLEWVSGINVAYGITSYADSVKGRFTISRDNTKNTLYLQLNSLKTEDTAIYYCVKHSGTTIPRGFISYTKRGQGTQVTVSSGGSGGSGGSGQVQLQESGGGSVQAGGSLRLSCVASASTYCTYDMHWYRQAPGKGREFVSAIDSDGTTRYADSVKGRFTISQGTAKNTVYLQMNSLQPEDTAMYYCKTVCVVGSRWSDYWGQGTQVTVSS

SEQ ID NO: 728 - protein, 249 aa, synthetic construct
  source 1..249: note = Description of Artificial Sequence: Synthetic polypeptide
QVQLQESGGGSVQAGGSLRLSCTASGYVSCDYFLPSWYRQAPGKEREFVSVIDGTGSTSYAASVKGRFTASQDKGKNIAYLQMNSLKPEDTAMYYCKASCVRGRAISEYWGQGTQVTVSSGGSGGSGGSGQVQLQESGGGSVQAGGSLRLSCVASASTYCTYDMHWYRQAPGKGREFVSAIDSDGTTRYADSVKGRFTISQGTAKNTVYLQMNSLQPEDTAMYYCKTVCVVGSRWSDYWGQGTQVTVSS

SEQ ID NO: 729 - protein, 248 aa, synthetic construct
  source 1..248: note = Description of Artificial Sequence: Synthetic polypeptide
QVQLQESGGGLVQPGGSLRLSCAASGFSFSSYAMKWVRQAPGKGLEWVSTISSGGSSTNYADSVKGRFTISRDNAKNTLYLQLNSLKIEDTAMYYCAKAIVPTGATMERGQGTQVTVSSGGSGGSGGSGQVQLQESGGGSVQAGGSLRLSCVASASTYCTYDMHWYRQAPGKGREFVSAIDSDGTTRYADSVKGRFTISQGTAKNTVYLQMNSLQPEDTAMYYCKTVCVVGSRWSDYWGQGTQVTVSS

SEQ ID NO: 730 - protein, 252 aa, synthetic construct
  source 1..252: note = Description of Artificial Sequence: Synthetic polypeptide
QVQLQESGGGLVQPGGSLRLSCAASGFTFSSYPMSWVRQAPGKGLEWISTISAGGDTTLYADSVKGRFTSSRDNAKNTLYLQLNSLKTEDTAIYYCAKRIDCNSGYCYRRNYWGQGTQVTVSSGGSGGSGGSGQVQLQESGGGSVQAGGSLRLSCVASASTYCTYDMHWYRQAPGKGREFVSAIDSDGTTRYADSVKGRFTISQGTAKNTVYLQMNSLQPEDTAMYYCKTVCVVGSRWSDYWGQGTQVTVSS

SEQ ID NO: 731 - protein, 252 aa, synthetic construct
  source 1..252: note = Description of Artificial Sequence: Synthetic polypeptide
QVQLQESGGGSVQVGGSLRLSCAASGFTFSSYPMSWVRQAPGKGLEWISTISAGGDTTLYADSVKGRFTSSRDNAKNTLYLQLNSLKTEDTAIYYCAKRIDCNSGYCYRRNYWGQGTQVTVSSGGSGGSGGSGQVQLQESGGGSVQAGGSLRLSCVASASTYCTYDMHWYRQAPGKGREFVSAIDSDGTTRYADSVKGRFTISQGTAKNTVYLQMNSLQPEDTAMYYCKTVCVVGSRWSDYWGQGTQVTVSS

SEQ ID NO: 732 - protein, 257 aa, synthetic construct
  source 1..257: note = Description of Artificial Sequence: Synthetic polypeptide
QVQLQESGGGSVQSGGSLRLSCAASGFTYSTSNSWMAWFRQAPGKEREGVAAIYTVGGSIFYADSVRGRFTISQDATKNMFYLQMNTLKPEDTAMYYCAAASGRLRGKWFWPYEYNYWGQGTQVTVSSGGSGGSGGSGQVQLQESGGGSVQAGGSLRLSCVASASTYCTYDMHWYRQAPGKGREFVSAIDSDGTTRYADSVKGRFTISQGTAKNTVYLQMNSLQPEDTAMYYCKTVCVVGSRWSDYWGQGTQVTVSS

SEQ ID NO: 733 - protein, 258 aa, synthetic construct
  source 1..258: note = Description of Artificial Sequence: Synthetic polypeptide
QVQLQESGGGSVQAGGSLRLSCRASGSTYSNYCLGWFRQITGKEREGVAVINWVGGMLYFADSVKGRFTVSQDQAKNTLYLQMNSLKPEDTAMYYCAAESVSSFSCGGWLTRPDRVPYWGQGTQVTVSSGGSGGSGGSGQVQLQESGGGSVQAGGSLRLSCVASASTYCTYDMHWYRQAPGKGREFVSAIDSDGTTRYADSVKGRFTISQGTAKNTVYLQMNSLQPEDTAMYYCKTVCVVGSRWSDYWGQGTQVTVSS

SEQ ID NO: 734 - protein, 258 aa, synthetic construct
  source 1..258: note = Description of Artificial Sequence: Synthetic polypeptide
QVQLQESGGGSVQAGGSLRLSCRASGSTYSNYCLGWFRQSTGKEREGVAVINWVGGMLYFADSVKGRFTVSQDHAKNTVTLQMNSLKPEDTAMYYCAAESVSSFSCGGWLTRPGRVPYWGQGTQVTVSSGGSGGSGGSGQVQLQESGGGSVQAGGSLRLSCVASASTYCTYDMHWYRQAPGKGREFVSAIDSDGTTRYADSVKGRFTISQGTAKNTVYLQMNSLQPEDTAMYYCKTVCVVGSRWSDYWGQGTQVTVSS

SEQ ID NO: 735 - protein, 258 aa, synthetic construct
  source 1..258: note = Description of Artificial Sequence: Synthetic polypeptide
QVQLQESGGGSVQAGESLRLSCRASGSTYSNYCLGWFRQITGKEREGVAVINWVGGMLYFADSVKGRFTVSQDQAKNTVYLEMNSLKPEDTAMYYCATESVSSFSCGGWLTRPDRVPYWGQGTQVTVSSGGSGGSGGSGQVQLQESGGGSVQAGGSLRLSCVASASTYCTYDMHWYRQAPGKGREFVSAIDSDGTTRYADSVKGRFTISQGTAKNTVYLQMNSLQPEDTAMYYCKTVCVVGSRWSDYWGQGTQVTVSS

SEQ ID NO: 736 - protein, 249 aa, synthetic construct
  source 1..249: note = Description of Artificial Sequence: Synthetic polypeptide
QVQLQESGGGSVQAGGSLRLSCVASGYVSCDYFLPSWYRQAPGKEREFVSIIDGTGSTSYAASVKGRFTASQDRGKNIAYLQMNSLKPEDTAMYYCKASCVRGRTISEYWGQGTQVTVSSGGSGGSGGSGQVQLQESGGGSVQAGGSLRLSCVASASTYCTYDMHWYRQAPGKGREFVSAIDSDGTTRYADSVKGRFTISQGTAKNTVYLQMNSLQPEDTAMYYCKTVCVVGSRWSDYWGQGTQVTVSS

SEQ ID NO: 737 - protein, 249 aa, synthetic construct
  source 1..249: note = Description of Artificial Sequence: Synthetic polypeptide
QVQLQESGGGSVQAGGSLRLSCVASGYVSCDYFLPSWYRQAPGKEREFVSIIDGTGSTSYAASVKGRFTASQDKGKNIAYLQMNSLKPEDTAMYYCKASCVRGRAISEYWGQGTQVTVSSGGSGGSGGSGQVQLQESGGGSVQAGGSLRLSCVASASTYCTYDMHWYRQAPGKGREFVSAIDSDGTTRYADSVKGRFTISQGTAKNTVYLQMNSLQPEDTAMYYCKTVCVVGSRWSDYWGQGTQVTVSS

SEQ ID NO: 738 - protein, 249 aa, synthetic construct
  source 1..249: note = Description of Artificial Sequence: Synthetic polypeptide
QVQLQESGGGSVQAGGSLRLSCVASGYVSCDYFLPSWYRQAPGKEREFVSIIDGTGSTSYAASVKGRFTASQDKGKNIAYLQMNTLKPEDTAMYYCKASCVRGRAISEYWGQGTQVTVSSGGSGGSGGSGQVQLQESGGGSVQAGGSLRLSCVASASTYCTYDMHWYRQAPGKGREFVSAIDSDGTTRYADSVKGRFTISQGTAKNTVYLQMNSLQPEDTAMYYCKTVCVVGSRWSDYWGQGTQVTVSS

SEQ ID NO: 739 - protein, 258 aa, synthetic construct
  source 1..258: note = Description of Artificial Sequence: Synthetic polypeptide
QVQLQESGGGSVQAGGSLRLSCRASGSTYSNYCLGWFRQITGKEREGVAVINWVGGMLYFADSVKGRFTVSQDQAKNTVYLQMNSLKPEDTAMYYCAAESASSFSCGGWLTRPDRVPYWGQGTQVTVSSGGSGGSGGSGQVQLQESGGGSVQAGGSLRLSCVASASTYCTYDMHWYRQAPGKGREFVSAIDSDGTTRYADSVKGRFTISQGTAKNTVYLQMNSLQPEDTAMYYCKTVCVVGSRWSDYWGQGTQVTVSS

SEQ ID NO: 740 - protein, 252 aa, synthetic construct
  source 1..252: note = Description of Artificial Sequence: Synthetic polypeptide
QVQLQESGGGLVQPGGSLRLSCAASGFTFSLSGMSWVRQAPGKGLEWVSAISSGGASTYYTDSVKGRFTISRDNAKNMLYLQLNSLKTEDTAMYYCAKGGSGYGDASRMTSPGSQGTQVTVSSGGSGGSGGSGQVQLQESGGGSVQAGGSLRLSCVASASTYCTYDMHWYRQAPGKGREFVSAIDSDGTTRYADSVKGRFTISQGTAKNTVYLQMNSLQPEDTAMYYCKTVCVVGSRWSDYWGQGTQVTVSS

SEQ ID NO: 741 - protein, 249 aa, synthetic construct
  source 1..249: note = Description of Artificial Sequence: Synthetic polypeptide
QVQLQESGGGSVQAGGSLRLSCVASGYVSCDYFLPSWYRQAPGKEREFVSIIDGTGSTSYAASVKGRFTASQDKGKNIAYLQMNSLKPEDTAMYYCKASCVRGRGISEYWGQGTQVTVSSGGSGGSGGSGQVQLQESGGGSVQAGGSLRLSCVASASTYCTYDMHWYRQAPGKGREFVSAIDSDGTTRYADSVKGRFTISQGTAKNTVYLQMNSLQPEDTAMYYCKTVCVVGSRWSDYWGQGTQVTVSS

SEQ ID NO: 742 - protein, 258 aa, synthetic construct
  source 1..258: note = Description of Artificial Sequence: Synthetic polypeptide
QVQLQESGGGSVQAGGSLRLSCRASGSTYSNYCLGWFRQITGKEREGVAVINWVGGMLYFADSVKGRFTVSQDQAKNTVYLQMNSLKPEDTAMYYCAAESVSSFSCGGWLTRPDRVPYWGQGTQVTVSSGGSGGSGGSGQVQLQESGGGSVQAGGSLRLSCVASASTYCTYDMHWYRQAPGKGREFVSAIDSDGTTRYADSVKGRFTISQGTAKNTVYLQMNSLQPEDTAMYYCKTVCVVGSRWSDYWGQGTQVTVSS

SEQ ID NO: 743 - protein, 252 aa, synthetic construct
  source 1..252: note = Description of Artificial Sequence: Synthetic polypeptide
QVQLQESGGGLVQPGGSLRLSCAASGFTFSSYPMSWVRQAPGKGLEWVSTISSGGDTTLYADSVKGRFTSSRDNAKNTLYLQLNSLKTEDTAMYYCAKRIDCNSGYCYKRSYWGQGTQVTVSSGGSGGSGGSGQVQLQESGGGSVQAGGSLRLSCVASASTYCTYDMHWYRQAPGKGREFVSAIDSDGTTRYADSVKGRFTISQGTAKNTVYLQMNSLQPEDTAMYYCKTVCVVGSRWSDYWGQGTQVTVSS

SEQ ID NO: 744 - protein, 252 aa, synthetic construct
  source 1..252: note = Description of Artificial Sequence: Synthetic polypeptide
QVQLQESGGGLVQPGGSLRLSCAASGFTFSLSSMSWVRQAPGKGLEWVSAISSGGASTYYTDSVKGRFTISRDNAKNMLYLQLNSLKTEDTAMYYCAKGGSGYGDASRMTSPGSQGTQVTVSSGGSGGSGGSGQVQLQESGGGSVQAGGSLRLSCVASASTYCTYDMHWYRQAPGKGREFVSAIDSDGTTRYADSVKGRFTISQGTAKNTVYLQMNSLQPEDTAMYYCKTVCVVGSRWSDYWGQGTQVTVSS

SEQ ID NO: 745 - protein, 258 aa, synthetic construct
  source 1..258: note = Description of Artificial Sequence: Synthetic polypeptide
QVQLQESGGGSVQAGGSLRLSCRASGSTYSNYCLGWFRQTTGKEREGVAVINWVGGMLYFADSVKGRFTVSQDQAKNTVYLQMNSLKPEDTAMYYCAAESVSSFSCGGWLTRPDRVPYWGQGTQVTVSSGGSGGSGGSGQVQLQESGGGSVQAGGSLRLSCVASASTYCTYDMHWYRQAPGKGREFVSAIDSDGTTRYADSVKGRFTISQGTAKNTVYLQMNSLQPEDTAMYYCKTVCVVGSRWSDYWGQGTQVTVSS

SEQ ID NO: 746 - protein, 258 aa, synthetic construct
  source 1..258: note = Description of Artificial Sequence: Synthetic polypeptide
QVQLQESGGGSVQAGGSLRLSCRASRSPYGNYCLGWFRQSTGKEREGVAVINWVGGMLYFADSVKGRFTVSQDHAKNTVTLQMNSLKPEDTAMYYCAAESVSSFSCGGWLTRPDRVPYWGQGTQVTVSSGGSGGSGGSGQVQLQESGGGSVQAGGSLRLSCVASASTYCTYDMHWYRQAPGKGREFVSAIDSDGTTRYADSVKGRFTISQGTAKNTVYLQMNSLQPEDTAMYYCKTVCVVGSRWSDYWGQGTQVTVSS

SEQ ID NO: 747 - protein, 252 aa, synthetic construct
  source 1..252: note = Description of Artificial Sequence: Synthetic polypeptide
QVQLQESGGGLVQPGGSLRLSCAASGFTFSHSGMSWVRQAPGKGLEWVSTINSGGASTYYTDSVKGRFTISRDNAKNMLYLQLNSLKTEDTAMYYCAKGGSGYGDASRMTSPGSQGTQVTVSSGGSGGSGGSGQVQLQESGGGSVQAGGSLRLSCVASASTYCTYDMHWYRQAPGKGREFVSAIDSDGTTRYADSVKGRFTISQGTAKNTVYLQMNSLQPEDTAMYYCKTVCVVGSRWSDYWGQGTQVTVSS

SEQ ID NO: 748 - protein, 250 aa, synthetic construct
  source 1..250: note = Description of Artificial Sequence: Synthetic polypeptide
QVQLQESGGGLVQPGGSLRLSCAASGFTFSSYPMSWVRQAPGKGLEWISTISAGGDTTLYADSVKGRFTSSRDNAKNTLYLQLNSLKTEDAAIYYCAKRIDCNSGYCYRRNYWGQGTQVTVSSGGSGGSGGSGQVQLQESGGGSVQAGGSLTLSCAASEYAYSTCNMGWYRQAPGKERELVSAFISDGSTYYADSVKGRFTITRDNAKNTVYLQMNSLKPEDTAIYYCSANCYRRLRNYWGQGTQVTVSS

SEQ ID NO: 749 - protein, 250 aa, synthetic construct
  source 1..250: note = Description of Artificial Sequence: Synthetic polypeptide
QVQLQESGGGLVQPGGSLRLSCAASGFTFSLSGMSWVRQAPGKGLEWVSAISSGGASTYYTDSVKGRFTISRDNAKNILYLQLNSLKTEDTAMYYCAKGGSGYGDASRMTSPGSQGTQVTVSSGGSGGSGGSGQVQLQESGGGSVQAGGSLTLSCAASEYAYSTCNMGWYRQAPGKERELVSAFISDGSTYYADSVKGRFTITRDNAKNTVYLQMNSLKPEDTAIYYCSANCYRRLRNYWGQGTQVTVSS

SEQ ID NO: 750 - protein, 247 aa, synthetic construct
  source 1..247: note = Description of Artificial Sequence: Synthetic polypeptide
QVQLQESGGGSVQAGGSLRLSCVASGYVSCDYFLPSWYRQAPGKEREFVSIIDGTGSTSYAASVKGRFTASEDKGKNIAYLQMNSLKPEDTAMYYCKASCVRGRAVSEYWGQGTQVTVSSGGSGGSGGSGQVQLQESGGGSVQAGGSLTLSCAASEYAYSTCNMGWYRQAPGKERELVSAFISDGSTYYADSVKGRFTITRDNAKNTVYLQMNSLKPEDTAIYYCSANCYRRLRNYWGQGTQVTVSS

SEQ ID NO: 751 - protein, 251 aa, synthetic construct
  source 1..251: note = Description of Artificial Sequence: Synthetic polypeptide
QVQLQESGGGLVQPGESLRLSCTASGFTFSNYAMSWVRQAPGKGLEWVSGINVAYGITSYADSVKGRFTISRDNTKNTLYLQLNSLKTEDTAIYYCVKHSGTTIPRGFISYTKRGQGTQVTVSSGGSGGSGGSGQVQLQESGGGSVQAGGSLTLSCAASEYAYSTCNMGWYRQAPGKERELVSAFISDGSTYYADSVKGRFTITRDNAKNTVYLQMNSLKPEDTAIYYCSANCYRRLRNYWGQGTQVTVSS

SEQ ID NO: 752 - protein, 247 aa, synthetic construct
  source 1..247: note = Description of Artificial Sequence: Synthetic polypeptide
QVQLQESGGGSVQAGGSLRLSCTASGYVSCDYFLPSWYRQAPGKEREFVSVIDGTGSTSYAASVKGRFTASQDKGKNIAYLQMNSLKPEDTAMYYCKASCVRGRAISEYWGQGTQVTVSSGGSGGSGGSGQVQLQESGGGSVQAGGSLTLSCAASEYAYSTCNMGWYRQAPGKERELVSAFISDGSTYYADSVKGRFTITRDNAKNTVYLQMNSLKPEDTAIYYCSANCYRRLRNYWGQGTQVTVSS

SEQ ID NO: 753 - protein, 246 aa, synthetic construct
  source 1..246: note = Description of Artificial Sequence: Synthetic polypeptide
QVQLQESGGGLVQPGGSLRLSCAASGFSFSSYAMKWVRQAPGKGLEWVSTISSGGSSTNYADSVKGRFTISRDNAKNTLYLQLNSLKIEDTAMYYCAKAIVPTGATMERGQGTQVTVSSGGSGGSGGSGQVQLQESGGGSVQAGGSLTLSCAASEYAYSTCNMGWYRQAPGKERELVSAFISDGSTYYADSVKGRFTITRDNAKNTVYLQMNSLKPEDTAIYYCSANCYRRLRNYWGQGTQVTVSS

SEQ ID NO: 754 - protein, 250 aa, synthetic construct
  source 1..250: note = Description of Artificial Sequence: Synthetic polypeptide
QVQLQESGGGLVQPGGSLRLSCAASGFTFSSYPMSWVRQAPGKGLEWISTISAGGDTTLYADSVKGRFTSSRDNAKNTLYLQLNSLKTEDTAIYYCAKRIDCNSGYCYRRNYWGQGTQVTVSSGGSGGSGGSGQVQLQESGGGSVQAGGSLTLSCAASEYAYSTCNMGWYRQAPGKERELVSAFISDGSTYYADSVKGRFTITRDNAKNTVYLQMNSLKPEDTAIYYCSANCYRRLRNYWGQGTQVTVSS

SEQ ID NO: 755 - protein, 250 aa, synthetic construct
  source 1..250: note = Description of Artificial Sequence: Synthetic polypeptide
QVQLQESGGGSVQVGGSLRLSCAASGFTFSSYPMSWVRQAPGKGLEWISTISAGGDTTLYADSVKGRFTSSRDNAKNTLYLQLNSLKTEDTAIYYCAKRIDCNSGYCYRRNYWGQGTQVTVSSGGSGGSGGSGQVQLQESGGGSVQAGGSLTLSCAASEYAYSTCNMGWYRQAPGKERELVSAFISDGSTYYADSVKGRFTITRDNAKNTVYLQMNSLKPEDTAIYYCSANCYRRLRNYWGQGTQVTVSS

SEQ ID NO: 756 - protein, 255 aa, synthetic construct
  source 1..255: note = Description of Artificial Sequence: Synthetic polypeptide
QVQLQESGGGSVQSGGSLRLSCAASGFTYSTSNSWMAWFRQAPGKEREGVAAIYTVGGSIFYADSVRGRFTISQDATKNMFYLQMNTLKPEDTAMYYCAAASGRLRGKWFWPYEYNYWGQGTQVTVSSGGSGGSGGSGQVQLQESGGGSVQAGGSLTLSCAASEYAYSTCNMGWYRQAPGKERELVSAFISDGSTYYADSVKGRFTITRDNAKNTVYLQMNSLKPEDTAIYYCSANCYRRLRNYWGQGTQVTVSS

SEQ ID NO: 757 - protein, 256 aa, synthetic construct
  source 1..256: note = Description of Artificial Sequence: Synthetic polypeptide
QVQLQESGGGSVQAGGSLRLSCRASGSTYSNYCLGWFRQITGKEREGVAVINWVGGMLYFADSVKGRFTVSQDQAKNTLYLQMNSLKPEDTAMYYCAAESVSSFSCGGWLTRPDRVPYWGQGTQVTVSSGGSGGSGGSGQVQLQESGGGSVQAGGSLTLSCAASEYAYSTCNMGWYRQAPGKERELVSAFISDGSTYYADSVKGRFTITRDNAKNTVYLQMNSLKPEDTAIYYCSANCYRRLRNYWGQGTQVTVSS

SEQ ID NO: 758 - protein, 256 aa, synthetic construct
  source 1..256: note = Description of Artificial Sequence: Synthetic polypeptide
QVQLQESGGGSVQAGGSLRLSCRASGSTYSNYCLGWFRQSTGKEREGVAVINWVGGMLYFADSVKGRFTVSQDHAKNTVTLQMNSLKPEDTAMYYCAAESVSSFSCGGWLTRPGRVPYWGQGTQVTVSSGGSGGSGGSGQVQLQESGGGSVQAGGSLTLSCAASEYAYSTCNMGWYRQAPGKERELVSAFISDGSTYYADSVKGRFTITRDNAKNTVYLQMNSLKPEDTAIYYCSANCYRRLRNYWGQGTQVTVSS

SEQ ID NO: 759 - protein, 256 aa, synthetic construct
  source 1..256: note = Description of Artificial Sequence: Synthetic polypeptide
QVQLQESGGGSVQAGESLRLSCRASGSTYSNYCLGWFRQITGKEREGVAVINWVGGMLYFADSVKGRFTVSQDQAKNTVYLEMNSLKPEDTAMYYCATESVSSFSCGGWLTRPDRVPYWGQGTQVTVSSGGSGGSGGSGQVQLQESGGGSVQAGGSLTLSCAASEYAYSTCNMGWYRQAPGKERELVSAFISDGSTYYADSVKGRFTITRDNAKNTVYLQMNSLKPEDTAIYYCSANCYRRLRNYWGQGTQVTVSS

SEQ ID NO: 760 - protein, 247 aa, synthetic construct
  source 1..247: note = Description of Artificial Sequence: Synthetic polypeptide
QVQLQESGGGSVQAGGSLRLSCVASGYVSCDYFLPSWYRQAPGKEREFVSIIDGTGSTSYAASVKGRFTASQDRGKNIAYLQMNSLKPEDTAMYYCKASCVRGRTISEYWGQGTQVTVSSGGSGGSGGSGQVQLQESGGGSVQAGGSLTLSCAASEYAYSTCNMGWYRQAPGKERELVSAFISDGSTYYADSVKGRFTITRDNAKNTVYLQMNSLKPEDTAIYYCSANCYRRLRNYWGQGTQVTVSS

SEQ ID NO: 761 - protein, 247 aa, synthetic construct
  source 1..247: note = Description of Artificial Sequence: Synthetic polypeptide
QVQLQESGGGSVQAGGSLRLSCVASGYVSCDYFLPSWYRQAPGKEREFVSIIDGTGSTSYAASVKGRFTASQDKGKNIAYLQMNSLKPEDTAMYYCKASCVRGRAISEYWGQGTQVTVSSGGSGGSGGSGQVQLQESGGGSVQAGGSLTLSCAASEYAYSTCNMGWYRQAPGKERELVSAFISDGSTYYADSVKGRFTITRDNAKNTVYLQMNSLKPEDTAIYYCSANCYRRLRNYWGQGTQVTVSS

SEQ ID NO: 762 - protein, 247 aa, synthetic construct
  source 1..247: note = Description of Artificial Sequence: Synthetic polypeptide
QVQLQESGGGSVQAGGSLRLSCVASGYVSCDYFLPSWYRQAPGKEREFVSIIDGTGSTSYAASVKGRFTASQDKGKNIAYLQMNTLKPEDTAMYYCKASCVRGRAISEYWGQGTQVTVSSGGSGGSGGSGQVQLQESGGGSVQAGGSLTLSCAASEYAYSTCNMGWYRQAPGKERELVSAFISDGSTYYADSVKGRFTITRDNAKNTVYLQMNSLKPEDTAIYYCSANCYRRLRNYWGQGTQVTVSS

SEQ ID NO: 763 - protein, 256 aa, synthetic construct
  source 1..256: note = Description of Artificial Sequence: Synthetic polypeptide
QVQLQESGGGSVQAGGSLRLSCRASGSTYSNYCLGWFRQITGKEREGVAVINWVGGMLYFADSVKGRFTVSQDQAKNTVYLQMNSLKPEDTAMYYCAAESASSFSCGGWLTRPDRVPYWGQGTQVTVSSGGSGGSGGSGQVQLQESGGGSVQAGGSLTLSCAASEYAYSTCNMGWYRQAPGKERELVSAFISDGSTYYADSVKGRFTITRDNAKNTVYLQMNSLKPEDTAIYYCSANCYRRLRNYWGQGTQVTVSS

SEQ ID NO: 764 - protein, 250 aa, synthetic construct
  source 1..250: note = Description of Artificial Sequence: Synthetic polypeptide
QVQLQESGGGLVQPGGSLRLSCAASGFTFSLSGMSWVRQAPGKGLEWVSAISSGGASTYYTDSVKGRFTISRDNAKNMLYLQLNSLKTEDTAMYYCAKGGSGYGDASRMTSPGSQGTQVTVSSGGSGGSGGSGQVQLQESGGGSVQAGGSLTLSCAASEYAYSTCNMGWYRQAPGKERELVSAFISDGSTYYADSVKGRFTITRDNAKNTVYLQMNSLKPEDTAIYYCSANCYRRLRNYWGQGTQVTVSS

SEQ ID NO: 765 - protein, 247 aa, synthetic construct
  source 1..247: note = Description of Artificial Sequence: Synthetic polypeptide
QVQLQESGGGSVQAGGSLRLSCVASGYVSCDYFLPSWYRQAPGKEREFVSIIDGTGSTSYAASVKGRFTASQDKGKNIAYLQMNSLKPEDTAMYYCKASCVRGRGISEYWGQGTQVTVSSGGSGGSGGSGQVQLQESGGGSVQAGGSLTLSCAASEYAYSTCNMGWYRQAPGKERELVSAFISDGSTYYADSVKGRFTITRDNAKNTVYLQMNSLKPEDTAIYYCSANCYRRLRNYWGQGTQVTVSS

SEQ ID NO: 766 - protein, 256 aa, synthetic construct
  source 1..256: note = Description of Artificial Sequence: Synthetic polypeptide
QVQLQESGGGSVQAGGSLRLSCRASGSTYSNYCLGWFRQITGKEREGVAVINWVGGMLYFADSVKGRFTVSQDQAKNTVYLQMNSLKPEDTAMYYCAAESVSSFSCGGWLTRPDRVPYWGQGTQVTVSSGGSGGSGGSGQVQLQESGGGSVQAGGSLTLSCAASEYAYSTCNMGWYRQAPGKERELVSAFISDGSTYYADSVKGRFTITRDNAKNTVYLQMNSLKPEDTAIYYCSANCYRRLRNYWGQGTQVTVSS

SEQ ID NO: 767 - protein, 250 aa, synthetic construct
  source 1..250: note = Description of Artificial Sequence: Synthetic polypeptide
QVQLQESGGGLVQPGGSLRLSCAASGFTFSSYPMSWVRQAPGKGLEWVSTISSGGDTTLYADSVKGRFTSSRDNAKNTLYLQLNSLKTEDTAMYYCAKRIDCNSGYCYKRSYWGQGTQVTVSSGGSGGSGGSGQVQLQESGGGSVQAGGSLTLSCAASEYAYSTCNMGWYRQAPGKERELVSAFISDGSTYYADSVKGRFTITRDNAKNTVYLQMNSLKPEDTAIYYCSANCYRRLRNYWGQGTQVTVSS

SEQ ID NO: 768 - protein, 250 aa, synthetic construct
  source 1..250: note = Description of Artificial Sequence: Synthetic polypeptide
QVQLQESGGGLVQPGGSLRLSCAASGFTFSLSSMSWVRQAPGKGLEWVSAISSGGASTYYTDSVKGRFTISRDNAKNMLYLQLNSLKTEDTAMYYCAKGGSGYGDASRMTSPGSQGTQVTVSSGGSGGSGGSGQVQLQESGGGSVQAGGSLTLSCAASEYAYSTCNMGWYRQAPGKERELVSAFISDGSTYYADSVKGRFTITRDNAKNTVYLQMNSLKPEDTAIYYCSANCYRRLRNYWGQGTQVTVSS

SEQ ID NO: 769 - protein, 256 aa, synthetic construct
  source 1..256: note = Description of Artificial Sequence: Synthetic polypeptide
QVQLQESGGGSVQAGGSLRLSCRASGSTYSNYCLGWFRQTTGKEREGVAVINWVGGMLYFADSVKGRFTVSQDQAKNTVYLQMNSLKPEDTAMYYCAAESVSSFSCGGWLTRPDRVPYWGQGTQVTVSSGGSGGSGGSGQVQLQESGGGSVQAGGSLTLSCAASEYAYSTCNMGWYRQAPGKERELVSAFISDGSTYYADSVKGRFTITRDNAKNTVYLQMNSLKPEDTAIYYCSANCYRRLRNYWGQGTQVTVSS

SEQ ID NO: 770 - protein, 256 aa, synthetic construct
  source 1..256: note = Description of Artificial Sequence: Synthetic polypeptide
QVQLQESGGGSVQAGGSLRLSCRASRSPYGNYCLGWFRQSTGKEREGVAVINWVGGMLYFADSVKGRFTVSQDHAKNTVTLQMNSLKPEDTAMYYCAAESVSSFSCGGWLTRPDRVPYWGQGTQVTVSSGGSGGSGGSGQVQLQESGGGSVQAGGSLTLSCAASEYAYSTCNMGWYRQAPGKERELVSAFISDGSTYYADSVKGRFTITRDNAKNTVYLQMNSLKPEDTAIYYCSANCYRRLRNYWGQGTQVTVSS

SEQ ID NO: 771 - protein, 250 aa, synthetic construct
  source 1..250: note = Description of Artificial Sequence: Synthetic polypeptide
QVQLQESGGGLVQPGGSLRLSCAASGFTFSHSGMSWVRQAPGKGLEWVSTINSGGASTYYTDSVKGRFTISRDNAKNMLYLQLNSLKTEDTAMYYCAKGGSGYGDASRMTSPGSQGTQVTVSSGGSGGSGGSGQVQLQESGGGSVQAGGSLTLSCAASEYAYSTCNMGWYRQAPGKERELVSAFISDGSTYYADSVKGRFTITRDNAKNTVYLQMNSLKPEDTAIYYCSANCYRRLRNYWGQGTQVTVSS

SEQ ID NO: 772 - protein, 257 aa, synthetic construct
  source 1..257: note = Description of Artificial Sequence: Synthetic polypeptide
QVQLQESGGGLVQPGGSLRLSCAASGFTFSSYPMSWVRQAPGKGLEWISTISAGGDTTLYADSVKGRFTSSRDNAKNTLYLQLNSLKTEDAAIYYCAKRIDCNSGYCYRRNYWGQGTQVTVSSGGSGGSGGSGQVQLQESGGGLVQPGGSLRLSCTASGLTFDDSVMGWFRQAPGKGREAVSCISSSGANAFYADSVKGRFTISRDNAKNTLYLQMNSLKPEDTATYYCKRGHACAGYYPIPYDDYWGQGTQVTVSS

SEQ ID NO: 773 - protein, 257 aa, synthetic construct
  source 1..257: note = Description of Artificial Sequence: Synthetic polypeptide
QVQLQESGGGLVQPGGSLRLSCAASGFTFSLSGMSWVRQAPGKGLEWVSAISSGGASTYYTDSVKGRFTISRDNAKNILYLQLNSLKTEDTAMYYCAKGGSGYGDASRMTSPGSQGTQVTVSSGGSGGSGGSGQVQLQESGGGLVQPGGSLRLSCTASGLTFDDSVMGWFRQAPGKGREAVSCISSSGANAFYADSVKGRFTISRDNAKNTLYLQMNSLKPEDTATYYCKRGHACAGYYPIPYDDYWGQGTQVTVSS

SEQ ID NO: 774 - protein, 254 aa, synthetic construct
  source 1..254: note = Description of Artificial Sequence: Synthetic polypeptide
QVQLQESGGGSVQAGGSLRLSCVASGYVSCDYFLPSWYRQAPGKEREFVSIIDGTGSTSYAASVKGRFTASEDKGKNIAYLQMNSLKPEDTAMYYCKASCVRGRAVSEYWGQGTQVTVSSGGSGGSGGSGQVQLQESGGGLVQPGGSLRLSCTASGLTFDDSVMGWFRQAPGKGREAVSCISSSGANAFYADSVKGRFTISRDNAKNTLYLQMNSLKPEDTATYYCKRGHACAGYYPIPYDDYWGQGTQVTVSS

SEQ ID NO: 775 - protein, 258 aa, synthetic construct
  source 1..258: note = Description of Artificial Sequence: Synthetic polypeptide
QVQLQESGGGLVQPGESLRLSCTASGFTFSNYAMSWVRQAPGKGLEWVSGINVAYGITSYADSVKGRFTISRDNTKNTLYLQLNSLKTEDTAIYYCVKHSGTTIPRGFISYTKRGQGTQVTVSSGGSGGSGGSGQVQLQESGGGLVQPGGSLRLSCTASGLTFDDSVMGWFRQAPGKGREAVSCISSSGANAFYADSVKGRFTISRDNAKNTLYLQMNSLKPEDTATYYCKRGHACAGYYPIPYDDYWGQGTQVTVSS

SEQ ID NO: 776 - protein, 254 aa, synthetic construct
  source 1..254: note = Description of Artificial Sequence: Synthetic polypeptide
QVQLQESGGGSVQAGGSLRLSCTASGYVSCDYFLPSWYRQAPGKEREFVSVIDGTGSTSYAASVKGRFTASQDKGKNIAYLQMNSLKPEDTAMYYCKASCVRGRAISEYWGQGTQVTVSSGGSGGSGGSGQVQLQESGGGLVQPGGSLRLSCTASGLTFDDSVMGWFRQAPGKGREAVSCISSSGANAFYADSVKGRFTISRDNAKNTLYLQMNSLKPEDTATYYCKRGHACAGYYPIPYDDYWGQGTQVTVSS

SEQ ID NO: 777 - protein, 253 aa, synthetic construct
  source 1..253: note = Description of Artificial Sequence: Synthetic polypeptide
QVQLQESGGGLVQPGGSLRLSCAASGFSFSSYAMKWVRQAPGKGLEWVSTISSGGSSTNYADSVKGRFTISRDNAKNTLYLQLNSLKIEDTAMYYCAKAIVPTGATMERGQGTQVTVSSGGSGGSGGSGQVQLQESGGGLVQPGGSLRLSCTASGLTFDDSVMGWFRQAPGKGREAVSCISSSGANAFYADSVKGRFTISRDNAKNTLYLQMNSLKPEDTATYYCKRGHACAGYYPIPYDDYWGQGTQVTVSS

SEQ ID NO: 778 - protein, 257 aa, synthetic construct
  source 1..257: note = Description of Artificial Sequence: Synthetic polypeptide
QVQLQESGGGLVQPGGSLRLSCAASGFTFSSYPMSWVRQAPGKGLEWISTISAGGDTTLYADSVKGRFTSSRDNAKNTLYLQLNSLKTEDTAIYYCAKRIDCNSGYCYRRNYWGQGTQVTVSSGGSGGSGGSGQVQLQESGGGLVQPGGSLRLSCTASGLTFDDSVMGWFRQAPGKGREAVSCISSSGANAFYADSVKGRFTISRDNAKNTLYLQMNSLKPEDTATYYCKRGHACAGYYPIPYDDYWGQGTQVTVSS

SEQ ID NO: 779 - protein, 257 aa, synthetic construct
  source 1..257: note = Description of Artificial Sequence: Synthetic polypeptide
QVQLQESGGGSVQVGGSLRLSCAASGFTFSSYPMSWVRQAPGKGLEWISTISAGGDTTLYADSVKGRFTSSRDNAKNTLYLQLNSLKTEDTAIYYCAKRIDCNSGYCYRRNYWGQGTQVTVSSGGSGGSGGSGQVQLQESGGGLVQPGGSLRLSCTASGLTFDDSVMGWFRQAPGKGREAVSCISSSGANAFYADSVKGRFTISRDNAKNTLYLQMNSLKPEDTATYYCKRGHACAGYYPIPYDDYWGQGTQVTVSS

SEQ ID NO: 780 - protein, 262 aa, synthetic construct
  source 1..262: note = Description of Artificial Sequence: Synthetic polypeptide
QVQLQESGGGSVQSGGSLRLSCAASGFTYSTSNSWMAWFRQAPGKEREGVAAIYTVGGSIFYADSVRGRFTISQDATKNMFYLQMNTLKPEDTAMYYCAAASGRLRGKWFWPYEYNYWGQGTQVTVSSGGSGGSGGSGQVQLQESGGGLVQPGGSLRLSCTASGLTFDDSVMGWFRQAPGKGREAVSCISSSGANAFYADSVKGRFTISRDNAKNTLYLQMNSLKPEDTATYYCKRGHACAGYYPIPYDDYWGQGTQVTVSS

SEQ ID NO: 781 - protein, 263 aa, synthetic construct
  source 1..263: note = Description of Artificial Sequence: Synthetic polypeptide
QVQLQESGGGSVQAGGSLRLSCRASGSTYSNYCLGWFRQITGKEREGVAVINWVGGMLYFADSVKGRFTVSQDQAKNTLYLQMNSLKPEDTAMYYCAAESVSSFSCGGWLTRPDRVPYWGQGTQVTVSSGGSGGSGGSGQVQLQESGGGLVQPGGSLRLSCTASGLTFDDSVMGWFRQAPGKGREAVSCISSSGANAFYADSVKGRFTISRDNAKNTLYLQMNSLKPEDTATYYCKRGHACAGYYPIPYDDYWGQGTQVTVSS

SEQ ID NO: 782 - protein, 263 aa, synthetic construct
  source 1..263: note = Description of Artificial Sequence: Synthetic polypeptide
QVQLQESGGGSVQAGGSLRLSCRASGSTYSNYCLGWFRQSTGKEREGVAVINWVGGMLYFADSVKGRFTVSQDHAKNTVTLQMNSLKPEDTAMYYCAAESVSSFSCGGWLTRPGRVPYWGQGTQVTVSSGGSGGSGGSGQVQLQESGGGLVQPGGSLRLSCTASGLTFDDSVMGWFRQAPGKGREAVSCISSSGANAFYADSVKGRFTISRDNAKNTLYLQMNSLKPEDTATYYCKRGHACAGYYPIPYDDYWGQGTQVTVSS

SEQ ID NO: 783 - protein, 263 aa, synthetic construct
  source 1..263: note = Description of Artificial Sequence: Synthetic polypeptide
QVQLQESGGGSVQAGESLRLSCRASGSTYSNYCLGWFRQITGKEREGVAVINWVGGMLYFADSVKGRFTVSQDQAKNTVYLEMNSLKPEDTAMYYCATESVSSFSCGGWLTRPDRVPYWGQGTQVTVSSGGSGGSGGSGQVQLQESGGGLVQPGGSLRLSCTASGLTFDDSVMGWFRQAPGKGREAVSCISSSGANAFYADSVKGRFTISRDNAKNTLYLQMNSLKPEDTATYYCKRGHACAGYYPIPYDDYWGQGTQVTVSS

SEQ ID NO: 784 - protein, 254 aa, synthetic construct
  source 1..254: note = Description of Artificial Sequence: Synthetic polypeptide
QVQLQESGGGSVQAGGSLRLSCVASGYVSCDYFLPSWYRQAPGKEREFVSIIDGTGSTSYAASVKGRFTASQDRGKNIAYLQMNSLKPEDTAMYYCKASCVRGRTISEYWGQGTQVTVSSGGSGGSGGSGQVQLQESGGGLVQPGGSLRLSCTASGLTFDDSVMGWFRQAPGKGREAVSCISSSGANAFYADSVKGRFTISRDNAKNTLYLQMNSLKPEDTATYYCKRGHACAGYYPIPYDDYWGQGTQVTVSS

SEQ ID NO: 785 - protein, 254 aa, synthetic construct
  source 1..254: note = Description of Artificial Sequence: Synthetic polypeptide
QVQLQESGGGSVQAGGSLRLSCVASGYVSCDYFLPSWYRQAPGKEREFVSIIDGTGSTSYAASVKGRFTASQDKGKNIAYLQMNSLKPEDTAMYYCKASCVRGRAISEYWGQGTQVTVSSGGSGGSGGSGQVQLQESGGGLVQPGGSLRLSCTASGLTFDDSVMGWFRQAPGKGREAVSCISSSGANAFYADSVKGRFTISRDNAKNTLYLQMNSLKPEDTATYYCKRGHACAGYYPIPYDDYWGQGTQVTVSS

SEQ ID NO: 786 - protein, 254 aa, synthetic construct
  source 1..254: note = Description of Artificial Sequence: Synthetic polypeptide
QVQLQESGGGSVQAGGSLRLSCVASGYVSCDYFLPSWYRQAPGKEREFVSIIDGTGSTSYAASVKGRFTASQDKGKNIAYLQMNTLKPEDTAMYYCKASCVRGRAISEYWGQGTQVTVSSGGSGGSGGSGQVQLQESGGGLVQPGGSLRLSCTASGLTFDDSVMGWFRQAPGKGREAVSCISSSGANAFYADSVKGRFTISRDNAKNTLYLQMNSLKPEDTATYYCKRGHACAGYYPIPYDDYWGQGTQVTVSS

SEQ ID NO: 787 - protein, 263 aa, synthetic construct
  source 1..263: note = Description of Artificial Sequence: Synthetic polypeptide
QVQLQESGGGSVQAGGSLRLSCRASGSTYSNYCLGWFRQITGKEREGVAVINWVGGMLYFADSVKGRFTVSQDQAKNTVYLQMNSLKPEDTAMYYCAAESASSFSCGGWLTRPDRVPYWGQGTQVTVSSGGSGGSGGSGQVQLQESGGGLVQPGGSLRLSCTASGLTFDDSVMGWFRQAPGKGREAVSCISSSGANAFYADSVKGRFTISRDNAKNTLYLQMNSLKPEDTATYYCKRGHACAGYYPIPYDDYWGQGTQVTVSS

SEQ ID NO: 788 - protein, 257 aa, synthetic construct
  source 1..257: note = Description of Artificial Sequence: Synthetic polypeptide
QVQLQESGGGLVQPGGSLRLSCAASGFTFSLSGMSWVRQAPGKGLEWVSAISSGGASTYYTDSVKGRFTISRDNAKNMLYLQLNSLKTEDTAMYYCAKGGSGYGDASRMTSPGSQGTQVTVSSGGSGGSGGSGQVQLQESGGGLVQPGGSLRLSCTASGLTFDDSVMGWFRQAPGKGREAVSCISSSGANAFYADSVKGRFTISRDNAKNTLYLQMNSLKPEDTATYYCKRGHACAGYYPIPYDDYWGQGTQVTVSS

SEQ ID NO: 789 - protein, 254 aa, synthetic construct
  source 1..254: note = Description of Artificial Sequence: Synthetic polypeptide
QVQLQESGGGSVQAGGSLRLSCVASGYVSCDYFLPSWYRQAPGKEREFVSIIDGTGSTSYAASVKGRFTASQDKGKNIAYLQMNSLKPEDTAMYYCKASCVRGRGISEYWGQGTQVTVSSGGSGGSGGSGQVQLQESGGGLVQPGGSLRLSCTASGLTFDDSVMGWFRQAPGKGREAVSCISSSGANAFYADSVKGRFTISRDNAKNTLYLQMNSLKPEDTATYYCKRGHACAGYYPIPYDDYWGQGTQVTVSS

SEQ ID NO: 790 - protein, 263 aa, synthetic construct
  source 1..263: note = Description of Artificial Sequence: Synthetic polypeptide
QVQLQESGGGSVQAGGSLRLSCRASGSTYSNYCLGWFRQITGKEREGVAVINWVGGMLYFADSVKGRFTVSQDQAKNTVYLQMNSLKPEDTAMYYCAAESVSSFSCGGWLTRPDRVPYWGQGTQVTVSSGGSGGSGGSGQVQLQESGGGLVQPGGSLRLSCTASGLTFDDSVMGWFRQAPGKGREAVSCISSSGANAFYADSVKGRFTISRDNAKNTLYLQMNSLKPEDTATYYCKRGHACAGYYPIPYDDYWGQGTQVTVSS

SEQ ID NO: 791 - protein, 257 aa, synthetic construct
  source 1..257: note = Description of Artificial Sequence: Synthetic polypeptide
QVQLQESGGGLVQPGGSLRLSCAASGFTFSSYPMSWVRQAPGKGLEWVSTISSGGDTTLYADSVKGRFTSSRDNAKNTLYLQLNSLKTEDTAMYYCAKRIDCNSGYCYKRSYWGQGTQVTVSSGGSGGSGGSGQVQLQESGGGLVQPGGSLRLSCTASGLTFDDSVMGWFRQAPGKGREAVSCISSSGANAFYADSVKGRFTISRDNAKNTLYLQMNSLKPEDTATYYCKRGHACAGYYPIPYDDYWGQGTQVTVSS

SEQ ID NO: 792 - protein, 257 aa, synthetic construct
  source 1..257: note = Description of Artificial Sequence: Synthetic polypeptide
QVQLQESGGGLVQPGGSLRLSCAASGFTFSLSSMSWVRQAPGKGLEWVSAISSGGASTYYTDSVKGRFTISRDNAKNMLYLQLNSLKTEDTAMYYCAKGGSGYGDASRMTSPGSQGTQVTVSSGGSGGSGGSGQVQLQESGGGLVQPGGSLRLSCTASGLTFDDSVMGWFRQAPGKGREAVSCISSSGANAFYADSVKGRFTISRDNAKNTLYLQMNSLKPEDTATYYCKRGHACAGYYPIPYDDYWGQGTQVTVSS

SEQ ID NO: 793 - protein, 263 aa, synthetic construct
  source 1..263: note = Description of Artificial Sequence: Synthetic polypeptide
QVQLQESGGGSVQAGGSLRLSCRASGSTYSNYCLGWFRQTTGKEREGVAVINWVGGMLYFADSVKGRFTVSQDQAKNTVYLQMNSLKPEDTAMYYCAAESVSSFSCGGWLTRPDRVPYWGQGTQVTVSSGGSGGSGGSGQVQLQESGGGLVQPGGSLRLSCTASGLTFDDSVMGWFRQAPGKGREAVSCISSSGANAFYADSVKGRFTISRDNAKNTLYLQMNSLKPEDTATYYCKRGHACAGYYPIPYDDYWGQGTQVTVSS

SEQ ID NO: 794 - protein, 263 aa, synthetic construct
  source 1..263: note = Description of Artificial Sequence: Synthetic polypeptide
QVQLQESGGGSVQAGGSLRLSCRASRSPYGNYCLGWFRQSTGKEREGVAVINWVGGMLYFADSVKGRFTVSQDHAKNTVTLQMNSLKPEDTAMYYCAAESVSSFSCGGWLTRPDRVPYWGQGTQVTVSSGGSGGSGGSGQVQLQESGGGLVQPGGSLRLSCTASGLTFDDSVMGWFRQAPGKGREAVSCISSSGANAFYADSVKGRFTISRDNAKNTLYLQMNSLKPEDTATYYCKRGHACAGYYPIPYDDYWGQGTQVTVSS

SEQ ID NO: 795 - protein, 257 aa, synthetic construct
  source 1..257: note = Description of Artificial Sequence: Synthetic polypeptide
QVQLQESGGGLVQPGGSLRLSCAASGFTFSHSGMSWVRQAPGKGLEWVSTINSGGASTYYTDSVKGRFTISRDNAKNMLYLQLNSLKTEDTAMYYCAKGGSGYGDASRMTSPGSQGTQVTVSSGGSGGSGGSGQVQLQESGGGLVQPGGSLRLSCTASGLTFDDSVMGWFRQAPGKGREAVSCISSSGANAFYADSVKGRFTISRDNAKNTLYLQMNSLKPEDTATYYCKRGHACAGYYPIPYDDYWGQGTQVTVSS

SEQ ID NO: 796 - protein, 262 aa, synthetic construct
  source 1..262: note = Description of Artificial Sequence: Synthetic polypeptide
QVQLQESGGGSVQAGGSLRLSCTASGAIASGYIDSRWCMAWFRQAPGKEREGVAAIWPGGGLTVYADSVKGRFTISRDHAKNTLYLQMNNLKPEDTAMYYCAAGSPRMCPSLEFGFDYWGQGTQVTVSSGGSGGSGGSGQVQLQESGGGLVQPGGSLRLSCAASGFTFSSYPMSWVRQAPGKGLEWISTISAGGDTTLYADSVKGRFTSSRDNAKNTLYLQLNSLKTEDAAIYYCAKRIDCNSGYCYRRNYWGQGTQVTVSS

SEQ ID NO: 797 - protein, 262 aa, synthetic construct
  source 1..262: note = Description of Artificial Sequence: Synthetic polypeptide
QVQLQESGGGSVQAGGSLRLSCTASGAIASGYIDSRWCMAWFRQAPGKEREGVAAIWPGGGLTVYADSVKGRFTISRDHAKNTLYLQMNNLKPEDTAMYYCAAGSPRMCPSLEFGFDYWGQGTQVTVSSGGSGGSGGSGQVQLQESGGGLVQPGGSLRLSCAASGFTFSLSGMSWVRQAPGKGLEWVSAISSGGASTYYTDSVKGRFTISRDNAKNILYLQLNSLKTEDTAMYYCAKGGSGYGDASRMTSPGSQGTQVTVSS

SEQ ID NO: 798 - protein, 259 aa, synthetic construct
  source 1..259: note = Description of Artificial Sequence: Synthetic polypeptide
QVQLQESGGGSVQAGGSLRLSCTASGAIASGYIDSRWCMAWFRQAPGKEREGVAAIWPGGGLTVYADSVKGRFTISRDHAKNTLYLQMNNLKPEDTAMYYCAAGSPRMCPSLEFGFDYWGQGTQVTVSSGGSGGSGGSGQVQLQESGGGSVQAGGSLRLSCVASGYVSCDYFLPSWYRQAPGKEREFVSIIDGTGSTSYAASVKGRFTASEDKGKNIAYLQMNSLKPEDTAMYYCKASCVRGRAVSEYWGQGTQVTVSS

SEQ ID NO: 799 - protein, 263 aa, synthetic construct
  source 1..263: note = Description of Artificial Sequence: Synthetic polypeptide
QVQLQESGGGSVQAGGSLRLSCTASGAIASGYIDSRWCMAWFRQAPGKEREGVAAIWPGGGLTVYADSVKGRFTISRDHAKNTLYLQMNNLKPEDTAMYYCAAGSPRMCPSLEFGFDYWGQGTQVTVSSGGSGGSGGSGQVQLQESGGGLVQPGESLRLSCTASGFTFSNYAMSWVRQAPGKGLEWVSGINVAYGITSYADSVKGRFTISRDNTKNTLYLQLNSLKTEDTAIYYCVKHSGTTIPRGFISYTKRGQGTQVTVSS

SEQ ID NO: 800 - protein, 259 aa, synthetic construct
  source 1..259: note = Description of Artificial Sequence: Synthetic polypeptide
QVQLQESGGGSVQAGGSLRLSCTASGAIASGYIDSRWCMAWFRQAPGKEREGVAAIWPGGGLTVYADSVKGRFTISRDHAKNTLYLQMNNLKPEDTAMYYCAAGSPRMCPSLEFGFDYWGQGTQVTVSSGGSGGSGGSGQVQLQESGGGSVQAGGSLRLSCTASGYVSCDYFLPSWYRQAPGKEREFVSVIDGTGSTSYAASVKGRFTASQDKGKNIAYLQMNSLKPEDTAMYYCKASCVRGRAISEYWGQGTQVTVSS

SEQ ID NO: 801 - protein, 258 aa, synthetic construct
  source 1..258: note = Description of Artificial Sequence: Synthetic polypeptide
QVQLQESGGGSVQAGGSLRLSCTASGAIASGYIDSRWCMAWFRQAPGKEREGVAAIWPGGGLTVYADSVKGRFTISRDHAKNTLYLQMNNLKPEDTAMYYCAAGSPRMCPSLEFGFDYWGQGTQVTVSSGGSGGSGGSGQVQLQESGGGLVQPGGSLRLSCAASGFSFSSYAMKWVRQAPGKGLEWVSTISSGGSSTNYADSVKGRFTISRDNAKNTLYLQLNSLKIEDTAMYYCAKAIVPTGATMERGQGTQVTVSS

SEQ ID NO: 802 - protein, 262 aa, synthetic construct
  source 1..262: note = Description of Artificial Sequence: Synthetic polypeptide
QVQLQESGGGSVQAGGSLRLSCTASGAIASGYIDSRWCMAWFRQAPGKEREGVAAIWPGGGLTVYADSVKGRFTISRDHAKNTLYLQMNNLKPEDTAMYYCAAGSPRMCPSLEFGFDYWGQGTQVTVSSGGSGGSGGSGQVQLQESGGGLVQPGGSLRLSCAASGFTFSSYPMSWVRQAPGKGLEWISTISAGGDTTLYADSVKGRFTSSRDNAKNTLYLQLNSLKTEDTAIYYCAKRIDCNSGYCYRRNYWGQGTQVTVSS

SEQ ID NO: 803 - protein, 262 aa, synthetic construct
  source 1..262: note = Description of Artificial Sequence: Synthetic polypeptide
QVQLQESGGGSVQAGGSLRLSCTASGAIASGYIDSRWCMAWFRQAPGKEREGVAAIWPGGGLTVYADSVKGRFTISRDHAKNTLYLQMNNLKPEDTAMYYCAAGSPRMCPSLEFGFDYWGQGTQVTVSSGGSGGSGGSGQVQLQESGGGSVQVGGSLRLSCAASGFTFSSYPMSWVRQAPGKGLEWISTISAGGDTTLYADSVKGRFTSSRDNAKNTLYLQLNSLKTEDTAIYYCAKRIDCNSGYCYRRNYWGQGTQVTVSS

SEQ ID NO: 804 - protein, 267 aa, synthetic construct
  source 1..267: note = Description of Artificial Sequence: Synthetic polypeptide
QVQLQESGGGSVQAGGSLRLSCTASGAIASGYIDSRWCMAWFRQAPGKEREGVAAIWPGGGLTVYADSVKGRFTISRDHAKNTLYLQMNNLKPEDTAMYYCAAGSPRMCPSLEFGFDYWGQGTQVTVSSGGSGGSGGSGQVQLQESGGGSVQSGGSLRLSCAASGFTYSTSNSWMAWFRQAPGKEREGVAAIYTVGGSIFYADSVRGRFTISQDATKNMFYLQMNTLKPEDTAMYYCAAASGRLRGKWFWPYEYNYWGQGTQVTVSS

SEQ ID NO: 805 - protein, 268 aa, synthetic construct
  source 1..268: note = Description of Artificial Sequence: Synthetic polypeptide
QVQLQESGGGSVQAGGSLRLSCTASGAIASGYIDSRWCMAWFRQAPGKEREGVAAIWPGGGLTVYADSVKGRFTISRDHAKNTLYLQMNNLKPEDTAMYYCAAGSPRMCPSLEFGFDYWGQGTQVTVSSGGSGGSGGSGQVQLQESGGGSVQAGGSLRLSCRASGSTYSNYCLGWFRQITGKEREGVAVINWVGGMLYFADSVKGRFTVSQDQAKNTLYLQMNSLKPEDTAMYYCAAESVSSFSCGGWLTRPDRVPYWGQGTQVTVSS

SEQ ID NO: 806 - protein, 268 aa, synthetic construct
  source 1..268: note = Description of Artificial Sequence: Synthetic polypeptide
QVQLQESGGGSVQAGGSLRLSCTASGAIASGYIDSRWCMAWFRQAPGKEREGVAAIWPGGGLTVYADSVKGRFTISRDHAKNTLYLQMNNLKPEDTAMYYCAAGSPRMCPSLEFGFDYWGQGTQVTVSSGGSGGSGGSGQVQLQESGGGSVQAGGSLRLSCRASGSTYSNYCLGWFRQSTGKEREGVAVINWVGGMLYFADSVKGRFTVSQDHAKNTVTLQMNSLKPEDTAMYYCAAESVSSFSCGGWLTRPGRVPYWGQGTQVTVSS

SEQ ID NO: 807 - protein, 268 aa, synthetic construct
  source 1..268: note = Description of Artificial Sequence: Synthetic polypeptide
QVQLQESGGGSVQAGGSLRLSCTASGAIASGYIDSRWCMAWFRQAPGKEREGVAAIWPGGGLTVYADSVKGRFTISRDHAKNTLYLQMNNLKPEDTAMYYCAAGSPRMCPSLEFGFDYWGQGTQVTVSSGGSGGSGGSGQVQLQESGGGSVQAGESLRLSCRASGSTYSNYCLGWFRQITGKEREGVAVINWVGGMLYFADSVKGRFTVSQDQAKNTVYLEMNSLKPEDTAMYYCATESVSSFSCGGWLTRPDRVPYWGQGTQVTVSS

SEQ ID NO: 808 - protein, 259 aa, synthetic construct
  source 1..259: note = Description of Artificial Sequence: Synthetic polypeptide
QVQLQESGGGSVQAGGSLRLSCTASGAIASGYIDSRWCMAWFRQAPGKEREGVAAIWPGGGLTVYADSVKGRFTISRDHAKNTLYLQMNNLKPEDTAMYYCAAGSPRMCPSLEFGFDYWGQGTQVTVSSGGSGGSGGSGQVQLQESGGGSVQAGGSLRLSCVASGYVSCDYFLPSWYRQAPGKEREFVSIIDGTGSTSYAASVKGRFTASQDRGKNIAYLQMNSLKPEDTAMYYCKASCVRGRTISEYWGQGTQVTVSS

SEQ ID NO: 809 - protein, 259 aa, synthetic construct
  source 1..259: note = Description of Artificial Sequence: Synthetic polypeptide
QVQLQESGGGSVQAGGSLRLSCTASGAIASGYIDSRWCMAWFRQAPGKEREGVAAIWPGGGLTVYADSVKGRFTISRDHAKNTLYLQMNNLKPEDTAMYYCAAGSPRMCPSLEFGFDYWGQGTQVTVSSGGSGGSGGSGQVQLQESGGGSVQAGGSLRLSCVASGYVSCDYFLPSWYRQAPGKEREFVSIIDGTGSTSYAASVKGRFTASQDKGKNIAYLQMNSLKPEDTAMYYCKASCVRGRAISEYWGQGTQVTVSS

SEQ ID NO: 810 - protein, 259 aa, synthetic construct
  source 1..259: note = Description of Artificial Sequence: Synthetic polypeptide
QVQLQESGGGSVQAGGSLRLSCTASGAIASGYIDSRWCMAWFRQAPGKEREGVAAIWPGGGLTVYADSVKGRFTISRDHAKNTLYLQMNNLKPEDTAMYYCAAGSPRMCPSLEFGFDYWGQGTQVTVSSGGSGGSGGSGQVQLQESGGGSVQAGGSLRLSCVASGYVSCDYFLPSWYRQAPGKEREFVSIIDGTGSTSYAASVKGRFTASQDKGKNIAYLQMNTLKPEDTAMYYCKASCVRGRAISEYWGQGTQVTVSS

SEQ ID NO: 811 - protein, 268 aa, synthetic construct
  source 1..268: note = Description of Artificial Sequence: Synthetic polypeptide
QVQLQESGGGSVQAGGSLRLSCTASGAIASGYIDSRWCMAWFRQAPGKEREGVAAIWPGGGLTVYADSVKGRFTISRDHAKNTLYLQMNNLKPEDTAMYYCAAGSPRMCPSLEFGFDYWGQGTQVTVSSGGSGGSGGSGQVQLQESGGGSVQAGGSLRLSCRASGSTYSNYCLGWFRQITGKEREGVAVINWVGGMLYFADSVKGRFTVSQDQAKNTVYLQMNSLKPEDTAMYYCAAESASSFSCGGWLTRPDRVPYWGQGTQVTVSS

SEQ ID NO: 812 - protein, 262 aa, synthetic construct
  source 1..262: note = Description of Artificial Sequence: Synthetic polypeptide
QVQLQESGGGSVQAGGSLRLSCTASGAIASGYIDSRWCMAWFRQAPGKEREGVAAIWPGGGLTVYADSVKGRFTISRDHAKNTLYLQMNNLKPEDTAMYYCAAGSPRMCPSLEFGFDYWGQGTQVTVSSGGSGGSGGSGQVQLQESGGGLVQPGGSLRLSCAASGFTFSLSGMSWVRQAPGKGLEWVSAISSGGASTYYTDSVKGRFTISRDNAKNMLYLQLNSLKTEDTAMYYCAKGGSGYGDASRMTSPGSQGTQVTVSS

SEQ ID NO: 813 - protein, 259 aa, synthetic construct
  source 1..259: note = Description of Artificial Sequence: Synthetic polypeptide
QVQLQESGGGSVQAGGSLRLSCTASGAIASGYIDSRWCMAWFRQAPGKEREGVAAIWPGGGLTVYADSVKGRFTISRDHAKNTLYLQMNNLKPEDTAMYYCAAGSPRMCPSLEFGFDYWGQGTQVTVSSGGSGGSGGSGQVQLQESGGGSVQAGGSLRLSCVASGYVSCDYFLPSWYRQAPGKEREFVSIIDGTGSTSYAASVKGRFTASQDKGKNIAYLQMNSLKPEDTAMYYCKASCVRGRGISEYWGQGTQVTVSS

SEQ ID NO: 814 - protein, 268 aa, synthetic construct
  source 1..268: note = Description of Artificial Sequence: Synthetic polypeptide
QVQLQESGGGSVQAGGSLRLSCTASGAIASGYIDSRWCMAWFRQAPGKEREGVAAIWPGGGLTVYADSVKGRFTISRDHAKNTLYLQMNNLKPEDTAMYYCAAGSPRMCPSLEFGFDYWGQGTQVTVSSGGSGGSGGSGQVQLQESGGGSVQAGGSLRLSCRASGSTYSNYCLGWFRQITGKEREGVAVINWVGGMLYFADSVKGRFTVSQDQAKNTVYLQMNSLKPEDTAMYYCAAESVSSFSCGGWLTRPDRVPYWGQGTQVTVSS

SEQ ID NO: 815 - protein, 262 aa, synthetic construct
  source 1..262: note = Description of Artificial Sequence: Synthetic polypeptide
QVQLQESGGGSVQAGGSLRLSCTASGAIASGYIDSRWCMAWFRQAPGKEREGVAAIWPGGGLTVYADSVKGRFTISRDHAKNTLYLQMNNLKPEDTAMYYCAAGSPRMCPSLEFGFDYWGQGTQVTVSSGGSGGSGGSGQVQLQESGGGLVQPGGSLRLSCAASGFTFSSYPMSWVRQAPGKGLEWVSTISSGGDTTLYADSVKGRFTSSRDNAKNTLYLQLNSLKTEDTAMYYCAKRIDCNSGYCYKRSYWGQGTQVTVSS

SEQ ID NO: 816 - protein, 262 aa, synthetic construct
  source 1..262: note = Description of Artificial Sequence: Synthetic polypeptide
QVQLQESGGGSVQAGGSLRLSCTASGAIASGYIDSRWCMAWFRQAPGKEREGVAAIWPGGGLTVYADSVKGRFTISRDHAKNTLYLQMNNLKPEDTAMYYCAAGSPRMCPSLEFGFDYWGQGTQVTVSSGGSGGSGGSGQVQLQESGGGLVQPGGSLRLSCAASGFTFSLSSMSWVRQAPGKGLEWVSAISSGGASTYYTDSVKGRFTISRDNAKNMLYLQLNSLKTEDTAMYYCAKGGSGYGDASRMTSPGSQGTQVTVSS

SEQ ID NO: 817 - protein, 268 aa, synthetic construct
  source 1..268: note = Description of Artificial Sequence: Synthetic polypeptide
QVQLQESGGGSVQAGGSLRLSCTASGAIASGYIDSRWCMAWFRQAPGKEREGVAAIWPGGGLTVYADSVKGRFTISRDHAKNTLYLQMNNLKPEDTAMYYCAAGSPRMCPSLEFGFDYWGQGTQVTVSSGGSGGSGGSGQVQLQESGGGSVQAGGSLRLSCRASGSTYSNYCLGWFRQTTGKEREGVAVINWVGGMLYFADSVKGRFTVSQDQAKNTVYLQMNSLKPEDTAMYYCAAESVSSFSCGGWLTRPDRVPYWGQGTQVTVSS

SEQ ID NO: 818 - protein, 268 aa, synthetic construct
  source 1..268: note = Description of Artificial Sequence: Synthetic polypeptide
QVQLQESGGGSVQAGGSLRLSCTASGAIASGYIDSRWCMAWFRQAPGKEREGVAAIWPGGGLTVYADSVKGRFTISRDHAKNTLYLQMNNLKPEDTAMYYCAAGSPRMCPSLEFGFDYWGQGTQVTVSSGGSGGSGGSGQVQLQESGGGSVQAGGSLRLSCRASRSPYGNYCLGWFRQSTGKEREGVAVINWVGGMLYFADSVKGRFTVSQDHAKNTVTLQMNSLKPEDTAMYYCAAESVSSFSCGGWLTRPDRVPYWGQGTQVTVSS

SEQ ID NO: 819 - protein, 262 aa, synthetic construct
  source 1..262: note = Description of Artificial Sequence: Synthetic polypeptide
QVQLQESGGGSVQAGGSLRLSCTASGAIASGYIDSRWCMAWFRQAPGKEREGVAAIWPGGGLTVYADSVKGRFTISRDHAKNTLYLQMNNLKPEDTAMYYCAAGSPRMCPSLEFGFDYWGQGTQVTVSSGGSGGSGGSGQVQLQESGGGLVQPGGSLRLSCAASGFTFSHSGMSWVRQAPGKGLEWVSTINSGGASTYYTDSVKGRFTISRDNAKNMLYLQLNSLKTEDTAMYYCAKGGSGYGDASRMTSPGSQGTQVTVSS

SEQ ID NO: 820 - protein, 256 aa, synthetic construct
  source 1..256: note = Description of Artificial Sequence: Synthetic polypeptide
QVQLQESGGGSVQAGGSLRLSCTAPGFTSNSCGMDWYRQAPGKEREFVSSISTDGTTGYADSVKGRFTISKDKAKDTVYLQMNSLKPEDTGMYSCKTKDGTIATMELCDFGYWGQGTQVTVSSGGSGGSGGSGQVQLQESGGGLVQPGGSLRLSCAASGFTFSSYPMSWVRQAPGKGLEWISTISAGGDTTLYADSVKGRFTSSRDNAKNTLYLQLNSLKTEDAAIYYCAKRIDCNSGYCYRRNYWGQGTQVTVSS

SEQ ID NO: 821 - protein, 256 aa, synthetic construct
  source 1..256: note = Description of Artificial Sequence: Synthetic polypeptide
QVQLQESGGGSVQAGGSLRLSCTAPGFTSNSCGMDWYRQAPGKEREFVSSISTDGTTGYADSVKGRFTISKDKAKDTVYLQMNSLKPEDTGMYSCKTKDGTIATMELCDFGYWGQGTQVTVSSGGSGGSGGSGQVQLQESGGGLVQPGGSLRLSCAASGFTFSLSGMSWVRQAPGKGLEWVSAISSGGASTYYTDSVKGRFTISRDNAKNILYLQLNSLKTEDTAMYYCAKGGSGYGDASRMTSPGSQGTQVTVSS

SEQ ID NO: 822 - protein, 253 aa, synthetic construct
  source 1..253: note = Description of Artificial Sequence: Synthetic polypeptide
QVQLQESGGGSVQAGGSLRLSCTAPGFTSNSCGMDWYRQAPGKEREFVSSISTDGTTGYADSVKGRFTISKDKAKDTVYLQMNSLKPEDTGMYSCKTKDGTIATMELCDFGYWGQGTQVTVSSGGSGGSGGSGQVQLQESGGGSVQAGGSLRLSCVASGYVSCDYFLPSWYRQAPGKEREFVSIIDGTGSTSYAASVKGRFTASEDKGKNIAYLQMNSLKPEDTAMYYCKASCVRGRAVSEYWGQGTQVTVSS

SEQ ID NO: 823 - protein, 257 aa, synthetic construct
  source 1..257: note = Description of Artificial Sequence: Synthetic polypeptide
QVQLQESGGGSVQAGGSLRLSCTAPGFTSNSCGMDWYRQAPGKEREFVSSISTDGTTGYADSVKGRFTISKDKAKDTVYLQMNSLKPEDTGMYSCKTKDGTIATMELCDFGYWGQGTQVTVSSGGSGGSGGSGQVQLQESGGGLVQPGESLRLSCTASGFTFSNYAMSWVRQAPGKGLEWVSGINVAYGITSYADSVKGRFTISRDNTKNTLYLQLNSLKTEDTAIYYCVKHSGTTIPRGFISYTKRGQGTQVTVSS

SEQ ID NO: 824 - protein, 253 aa, synthetic construct
  source 1..253: note = Description of Artificial Sequence: Synthetic polypeptide
QVQLQESGGGSVQAGGSLRLSCTAPGFTSNSCGMDWYRQAPGKEREFVSSISTDGTTGYADSVKGRFTISKDKAKDTVYLQMNSLKPEDTGMYSCKTKDGTIATMELCDFGYWGQGTQVTVSSGGSGGSGGSGQVQLQESGGGSVQAGGSLRLSCTASGYVSCDYFLPSWYRQAPGKEREFVSVIDGTGSTSYAASVKGRFTASQDKGKNIAYLQMNSLKPEDTAMYYCKASCVRGRAISEYWGQGTQVTVSS

SEQ ID NO: 825 - protein, 252 aa, synthetic construct
  source 1..252: note = Description of Artificial Sequence: Synthetic polypeptide
QVQLQESGGGSVQAGGSLRLSCTAPGFTSNSCGMDWYRQAPGKEREFVSSISTDGTTGYADSVKGRFTISKDKAKDTVYLQMNSLKPEDTGMYSCKTKDGTIATMELCDFGYWGQGTQVTVSSGGSGGSGGSGQVQLQESGGGLVQPGGSLRLSCAASGFSFSSYAMKWVRQAPGKGLEWVSTISSGGSSTNYADSVKGRFTISRDNAKNTLYLQLNSLKIEDTAMYYCAKAIVPTGATMERGQGTQVTVSS

SEQ ID NO: 826 - protein, 256 aa, synthetic construct
  source 1..256: note = Description of Artificial Sequence: Synthetic polypeptide
QVQLQESGGGSVQAGGSLRLSCTAPGFTSNSCGMDWYRQAPGKEREFVSSISTDGTTGYADSVKGRFTISKDKAKDTVYLQMNSLKPEDTGMYSCKTKDGTIATMELCDFGYWGQGTQVTVSSGGSGGSGGSGQVQLQESGGGLVQPGGSLRLSCAASGFTFSSYPMSWVRQAPGKGLEWISTISAGGDTTLYADSVKGRFTSSRDNAKNTLYLQLNSLKTEDTAIYYCAKRIDCNSGYCYRRNYWGQGTQVTVSS

SEQ ID NO: 827 - protein, 256 aa, synthetic construct
  source 1..256: note = Description of Artificial Sequence: Synthetic polypeptide
QVQLQESGGGSVQAGGSLRLSCTAPGFTSNSCGMDWYRQAPGKEREFVSSISTDGTTGYADSVKGRFTISKDKAKDTVYLQMNSLKPEDTGMYSCKTKDGTIATMELCDFGYWGQGTQVTVSSGGSGGSGGSGQVQLQESGGGSVQVGGSLRLSCAASGFTFSSYPMSWVRQAPGKGLEWISTISAGGDTTLYADSVKGRFTSSRDNAKNTLYLQLNSLKTEDTAIYYCAKRIDCNSGYCYRRNYWGQGTQVTVSS

SEQ ID NO: 828 - protein, 261 aa, synthetic construct
  source 1..261: note = Description of Artificial Sequence: Synthetic polypeptide
QVQLQESGGGSVQAGGSLRLSCTAPGFTSNSCGMDWYRQAPGKEREFVSSISTDGTTGYADSVKGRFTISKDKAKDTVYLQMNSLKPEDTGMYSCKTKDGTIATMELCDFGYWGQGTQVTVSSGGSGGSGGSGQVQLQESGGGSVQSGGSLRLSCAASGFTYSTSNSWMAWFRQAPGKEREGVAAIYTVGGSIFYADSVRGRFTISQDATKNMFYLQMNTLKPEDTAMYYCAAASGRLRGKWFWPYEYNYWGQGTQVTVSS

SEQ ID NO: 829 - protein, 262 aa, synthetic construct
  source 1..262: note = Description of Artificial Sequence: Synthetic polypeptide
QVQLQESGGGSVQAGGSLRLSCTAPGFTSNSCGMDWYRQAPGKEREFVSSISTDGTTGYADSVKGRFTISKDKAKDTVYLQMNSLKPEDTGMYSCKTKDGTIATMELCDFGYWGQGTQVTVSSGGSGGSGGSGQVQLQESGGGSVQAGGSLRLSCRASGSTYSNYCLGWFRQITGKEREGVAVINWVGGMLYFADSVKGRFTVSQDQAKNTLYLQMNSLKPEDTAMYYCAAESVSSFSCGGWLTRPDRVPYWGQGTQVTVSS

SEQ ID NO: 830 - protein, 262 aa, synthetic construct
  source 1..262: note = Description of Artificial Sequence: Synthetic polypeptide
QVQLQESGGGSVQAGGSLRLSCTAPGFTSNSCGMDWYRQAPGKEREFVSSISTDGTTGYADSVKGRFTISKDKAKDTVYLQMNSLKPEDTGMYSCKTKDGTIATMELCDFGYWGQGTQVTVSSGGSGGSGGSGQVQLQESGGGSVQAGGSLRLSCRASGSTYSNYCLGWFRQSTGKEREGVAVINWVGGMLYFADSVKGRFTVSQDHAKNTVTLQMNSLKPEDTAMYYCAAESVSSFSCGGWLTRPGRVPYWGQGTQVTVSS

SEQ ID NO: 831 - protein, 262 aa, synthetic construct
  source 1..262: note = Description of Artificial Sequence: Synthetic polypeptide
QVQLQESGGGSVQAGGSLRLSCTAPGFTSNSCGMDWYRQAPGKEREFVSSISTDGTTGYADSVKGRFTISKDKAKDTVYLQMNSLKPEDTGMYSCKTKDGTIATMELCDFGYWGQGTQVTVSSGGSGGSGGSGQVQLQESGGGSVQAGESLRLSCRASGSTYSNYCLGWFRQITGKEREGVAVINWVGGMLYFADSVKGRFTVSQDQAKNTVYLEMNSLKPEDTAMYYCATESVSSFSCGGWLTRPDRVPYWGQGTQVTVSS

SEQ ID NO: 832 - protein, 253 aa, synthetic construct
  source 1..253: note = Description of Artificial Sequence: Synthetic polypeptide
QVQLQESGGGSVQAGGSLRLSCTAPGFTSNSCGMDWYRQAPGKEREFVSSISTDGTTGYADSVKGRFTISKDKAKDTVYLQMNSLKPEDTGMYSCKTKDGTIATMELCDFGYWGQGTQVTVSSGGSGGSGGSGQVQLQESGGGSVQAGGSLRLSCVASGYVSCDYFLPSWYRQAPGKEREFVSIIDGTGSTSYAASVKGRFTASQDRGKNIAYLQMNSLKPEDTAMYYCKASCVRGRTISEYWGQGTQVTVSS

SEQ ID NO: 833 - protein, 253 aa, synthetic construct
  source 1..253: note = Description of Artificial Sequence: Synthetic polypeptide
QVQLQESGGGSVQAGGSLRLSCTAPGFTSNSCGMDWYRQAPGKEREFVSSISTDGTTGYADSVKGRFTISKDKAKDTVYLQMNSLKPEDTGMYSCKTKDGTIATMELCDFGYWGQGTQVTVSSGGSGGSGGSGQVQLQESGGGSVQAGGSLRLSCVASGYVSCDYFLPSWYRQAPGKEREFVSIIDGTGSTSYAASVKGRFTASQDKGKNIAYLQMNSLKPEDTAMYYCKASCVRGRAISEYWGQGTQVTVSS

SEQ ID NO: 834 - protein, 253 aa, synthetic construct
  source 1..253: note = Description of Artificial Sequence: Synthetic polypeptide
QVQLQESGGGSVQAGGSLRLSCTAPGFTSNSCGMDWYRQAPGKEREFVSSISTDGTTGYADSVKGRFTISKDKAKDTVYLQMNSLKPEDTGMYSCKTKDGTIATMELCDFGYWGQGTQVTVSSGGSGGSGGSGQVQLQESGGGSVQAGGSLRLSCVASGYVSCDYFLPSWYRQAPGKEREFVSIIDGTGSTSYAASVKGRFTASQDKGKNIAYLQMNTLKPEDTAMYYCKASCVRGRAISEYWGQGTQVTVSS

SEQ ID NO: 835 - protein, 262 aa, synthetic construct
  source 1..262: note = Description of Artificial Sequence: Synthetic polypeptide
QVQLQESGGGSVQAGGSLRLSCTAPGFTSNSCGMDWYRQAPGKEREFVSSISTDGTTGYADSVKGRFTISKDKAKDTVYLQMNSLKPEDTGMYSCKTKDGTIATMELCDFGYWGQGTQVTVSSGGSGGSGGSGQVQLQESGGGSVQAGGSLRLSCRASGSTYSNYCLGWFRQITGKEREGVAVINWVGGMLYFADSVKGRFTVSQDQAKNTVYLQMNSLKPEDTAMYYCAAESASSFSCGGWLTRPDRVPYWGQGTQVTVSS

SEQ ID NO: 836 - protein, 256 aa, synthetic construct
  source 1..256: note = Description of Artificial Sequence: Synthetic polypeptide
QVQLQESGGGSVQAGGSLRLSCTAPGFTSNSCGMDWYRQAPGKEREFVSSISTDGTTGYADSVKGRFTISKDKAKDTVYLQMNSLKPEDTGMYSCKTKDGTIATMELCDFGYWGQGTQVTVSSGGSGGSGGSGQVQLQESGGGLVQPGGSLRLSCAASGFTFSLSGMSWVRQAPGKGLEWVSAISSGGASTYYTDSVKGRFTISRDNAKNMLYLQLNSLKTEDTAMYYCAKGGSGYGDASRMTSPGSQGTQVTVSS

SEQ ID NO: 837 - protein, 253 aa, synthetic construct
  source 1..253: note = Description of Artificial Sequence: Synthetic polypeptide
QVQLQESGGGSVQAGGSLRLSCTAPGFTSNSCGMDWYRQAPGKEREFVSSISTDGTTGYADSVKGRFTISKDKAKDTVYLQMNSLKPEDTGMYSCKTKDGTIATMELCDFGYWGQGTQVTVSSGGSGGSGGSGQVQLQESGGGSVQAGGSLRLSCVASGYVSCDYFLPSWYRQAPGKEREFVSIIDGTGSTSYAASVKGRFTASQDKGKNIAYLQMNSLKPEDTAMYYCKASCVRGRGISEYWGQGTQVTVSS

SEQ ID NO: 838 - protein, 262 aa, synthetic construct
  source 1..262: note = Description of Artificial Sequence: Synthetic polypeptide
QVQLQESGGGSVQAGGSLRLSCTAPGFTSNSCGMDWYRQAPGKEREFVSSISTDGTTGYADSVKGRFTISKDKAKDTVYLQMNSLKPEDTGMYSCKTKDGTIATMELCDFGYWGQGTQVTVSSGGSGGSGGSGQVQLQESGGGSVQAGGSLRLSCRASGSTYSNYCLGWFRQITGKEREGVAVINWVGGMLYFADSVKGRFTVSQDQAKNTVYLQMNSLKPEDTAMYYCAAESVSSFSCGGWLTRPDRVPYWGQGTQVTVSS

SEQ ID NO: 839 - protein, 256 aa, synthetic construct
  source 1..256: note = Description of Artificial Sequence: Synthetic polypeptide
QVQLQESGGGSVQAGGSLRLSCTAPGFTSNSCGMDWYRQAPGKEREFVSSISTDGTTGYADSVKGRFTISKDKAKDTVYLQMNSLKPEDTGMYSCKTKDGTIATMELCDFGYWGQGTQVTVSSGGSGGSGGSGQVQLQESGGGLVQPGGSLRLSCAASGFTFSSYPMSWVRQAPGKGLEWVSTISSGGDTTLYADSVKGRFTSSRDNAKNTLYLQLNSLKTEDTAMYYCAKRIDCNSGYCYKRSYWGQGTQVTVSS

SEQ ID NO: 840 - protein, 256 aa, synthetic construct
  source 1..256: note = Description of Artificial Sequence: Synthetic polypeptide
QVQLQESGGGSVQAGGSLRLSCTAPGFTSNSCGMDWYRQAPGKEREFVSSISTDGTTGYADSVKGRFTISKDKAKDTVYLQMNSLKPEDTGMYSCKTKDGTIATMELCDFGYWGQGTQVTVSSGGSGGSGGSGQVQLQESGGGLVQPGGSLRLSCAASGFTFSLSSMSWVRQAPGKGLEWVSAISSGGASTYYTDSVKGRFTISRDNAKNMLYLQLNSLKTEDTAMYYCAKGGSGYGDASRMTSPGSQGTQVTVSS

SEQ ID NO: 841 - protein, 262 aa, synthetic construct
  source 1..262: note = Description of Artificial Sequence: Synthetic polypeptide
QVQLQESGGGSVQAGGSLRLSCTAPGFTSNSCGMDWYRQAPGKEREFVSSISTDGTTGYADSVKGRFTISKDKAKDTVYLQMNSLKPEDTGMYSCKTKDGTIATMELCDFGYWGQGTQVTVSSGGSGGSGGSGQVQLQESGGGSVQAGGSLRLSCRASGSTYSNYCLGWFRQTTGKEREGVAVINWVGGMLYFADSVKGRFTVSQDQAKNTVYLQMNSLKPEDTAMYYCAAESVSSFSCGGWLTRPDRVPYWGQGTQVTVSS

SEQ ID NO: 842 - protein, 262 aa, synthetic construct
  source 1..262: note = Description of Artificial Sequence: Synthetic polypeptide
QVQLQESGGGSVQAGGSLRLSCTAPGFTSNSCGMDWYRQAPGKEREFVSSISTDGTTGYADSVKGRFTISKDKAKDTVYLQMNSLKPEDTGMYSCKTKDGTIATMELCDFGYWGQGTQVTVSSGGSGGSGGSGQVQLQESGGGSVQAGGSLRLSCRASRSPYGNYCLGWFRQSTGKEREGVAVINWVGGMLYFADSVKGRFTVSQDHAKNTVTLQMNSLKPEDTAMYYCAAESVSSFSCGGWLTRPDRVPYWGQGTQVTVSS

SEQ ID NO: 843 - protein, 256 aa, synthetic construct
  source 1..256: note = Description of Artificial Sequence: Synthetic polypeptide
QVQLQESGGGSVQAGGSLRLSCTAPGFTSNSCGMDWYRQAPGKEREFVSSISTDGTTGYADSVKGRFTISKDKAKDTVYLQMNSLKPEDTGMYSCKTKDGTIATMELCDFGYWGQGTQVTVSSGGSGGSGGSGQVQLQESGGGLVQPGGSLRLSCAASGFTFSHSGMSWVRQAPGKGLEWVSTINSGGASTYYTDSVKGRFTISRDNAKNMLYLQLNSLKTEDTAMYYCAKGGSGYGDASRMTSPGSQGTQVTVSS

SEQ ID NO: 844 - protein, 261 aa, synthetic construct
  source 1..261: note = Description of Artificial Sequence: Synthetic polypeptide
QVQLQESGGGSVQAGGSLRLSCAASGYPYSNGYMGWFRQAPGKEREGVATIYTGDGRTYYADSVKGRFTISRDNAKNTVDLQMSSLKPEDTAMYYCAARAAPLYSSGSPLTRARYNVWGQGTQVTVSSGGSGGSGGSGQVQLQESGGGLVQPGGSLRLSCAASGFTFSSYPMSWVRQAPGKGLEWISTISAGGDTTLYADSVKGRFTSSRDNAKNTLYLQLNSLKTEDAAIYYCAKRIDCNSGYCYRRNYWGQGTQVTVSS

SEQ ID NO: 845 - protein, 261 aa, synthetic construct
  source 1..261: note = Description of Artificial Sequence: Synthetic polypeptide
QVQLQESGGGSVQAGGSLRLSCAASGYPYSNGYMGWFRQAPGKEREGVATIYTGDGRTYYADSVKGRFTISRDNAKNTVDLQMSSLKPEDTAMYYCAARAAPLYSSGSPLTRARYNVWGQGTQVTVSSGGSGGSGGSGQVQLQESGGGLVQPGGSLRLSCAASGFTFSLSGMSWVRQAPGKGLEWVSAISSGGASTYYTDSVKGRFTISRDNAKNILYLQLNSLKTEDTAMYYCAKGGSGYGDASRMTSPGSQGTQVTVSS

SEQ ID NO: 846 - protein, 258 aa, synthetic construct
  source 1..258: note = Description of Artificial Sequence: Synthetic polypeptide
QVQLQESGGGSVQAGGSLRLSCAASGYPYSNGYMGWFRQAPGKEREGVATIYTGDGRTYYADSVKGRFTISRDNAKNTVDLQMSSLKPEDTAMYYCAARAAPLYSSGSPLTRARYNVWGQGTQVTVSSGGSGGSGGSGQVQLQESGGGSVQAGGSLRLSCVASGYVSCDYFLPSWYRQAPGKEREFVSIIDGTGSTSYAASVKGRFTASEDKGKNIAYLQMNSLKPEDTAMYYCKASCVRGRAVSEYWGQGTQVTVSS

SEQ ID NO: 847 - protein, 262 aa, synthetic construct
  source 1..262: note = Description of Artificial Sequence: Synthetic polypeptide
QVQLQESGGGSVQAGGSLRLSCAASGYPYSNGYMGWFRQAPGKEREGVATIYTGDGRTYYADSVKGRFTISRDNAKNTVDLQMSSLKPEDTAMYYCAARAAPLYSSGSPLTRARYNVWGQGTQVTVSSGGSGGSGGSGQVQLQESGGGLVQPGESLRLSCTASGFTFSNYAMSWVRQAPGKGLEWVSGINVAYGITSYADSVKGRFTISRDNTKNTLYLQLNSLKTEDTAIYYCVKHSGTTIPRGFISYTKRGQGTQVTVSS

SEQ ID NO: 848 - protein, 258 aa, synthetic construct
  source 1..258: note = Description of Artificial Sequence: Synthetic polypeptide
QVQLQESGGGSVQAGGSLRLSCAASGYPYSNGYMGWFRQAPGKEREGVATIYTGDGRTYYADSVKGRFTISRDNAKNTVDLQMSSLKPEDTAMYYCAARAAPLYSSGSPLTRARYNVWGQGTQVTVSSGGSGGSGGSGQVQLQESGGGSVQAGGSLRLSCTASGYVSCDYFLPSWYRQAPGKEREFVSVIDGTGSTSYAASVKGRFTASQDKGKNIAYLQMNSLKPEDTAMYYCKASCVRGRAISEYWGQGTQVTVSS

SEQ ID NO: 849 - protein, 257 aa, synthetic construct
  source 1..257: note = Description of Artificial Sequence: Synthetic polypeptide
QVQLQESGGGSVQAGGSLRLSCAASGYPYSNGYMGWFRQAPGKEREGVATIYTGDGRTYYADSVKGRFTISRDNAKNTVDLQMSSLKPEDTAMYYCAARAAPLYSSGSPLTRARYNVWGQGTQVTVSSGGSGGSGGSGQVQLQESGGGLVQPGGSLRLSCAASGFSFSSYAMKWVRQAPGKGLEWVSTISSGGSSTNYADSVKGRFTISRDNAKNTLYLQLNSLKIEDTAMYYCAKAIVPTGATMERGQGTQVTVSS

SEQ ID NO: 850 - protein, 261 aa, synthetic construct
  source 1..261: note = Description of Artificial Sequence: Synthetic polypeptide
QVQLQESGGGSVQAGGSLRLSCAASGYPYSNGYMGWFRQAPGKEREGVATIYTGDGRTYYADSVKGRFTISRDNAKNTVDLQMSSLKPEDTAMYYCAARAAPLYSSGSPLTRARYNVWGQGTQVTVSSGGSGGSGGSGQVQLQESGGGLVQPGGSLRLSCAASGFTFSSYPMSWVRQAPGKGLEWISTISAGGDTTLYADSVKGRFTSSRDNAKNTLYLQLNSLKTEDTAIYYCAKRIDCNSGYCYRRNYWGQGTQVTVSS

SEQ ID NO: 851 - protein, 261 aa, synthetic construct
  source 1..261: note = Description of Artificial Sequence: Synthetic polypeptide
QVQLQESGGGSVQAGGSLRLSCAASGYPYSNGYMGWFRQAPGKEREGVATIYTGDGRTYYADSVKGRFTISRDNAKNTVDLQMSSLKPEDTAMYYCAARAAPLYSSGSPLTRARYNVWGQGTQVTVSSGGSGGSGGSGQVQLQESGGGSVQVGGSLRLSCAASGFTFSSYPMSWVRQAPGKGLEWISTISAGGDTTLYADSVKGRFTSSRDNAKNTLYLQLNSLKTEDTAIYYCAKRIDCNSGYCYRRNYWGQGTQVTVSS

SEQ ID NO: 852 - protein, 266 aa, synthetic construct
  source 1..266: note = Description of Artificial Sequence: Synthetic polypeptide
QVQLQESGGGSVQAGGSLRLSCAASGYPYSNGYMGWFRQAPGKEREGVATIYTGDGRTYYADSVKGRFTISRDNAKNTVDLQMSSLKPEDTAMYYCAARAAPLYSSGSPLTRARYNVWGQGTQVTVSSGGSGGSGGSGQVQLQESGGGSVQSGGSLRLSCAASGFTYSTSNSWMAWFRQAPGKEREGVAAIYTVGGSIFYADSVRGRFTISQDATKNMFYLQMNTLKPEDTAMYYCAAASGRLRGKWFWPYEYNYWGQGTQVTVSS

SEQ ID NO: 853 - protein, 267 aa, synthetic construct
  source 1..267: note = Description of Artificial Sequence: Synthetic polypeptide
QVQLQESGGGSVQAGGSLRLSCAASGYPYSNGYMGWFRQAPGKEREGVATIYTGDGRTYYADSVKGRFTISRDNAKNTVDLQMSSLKPEDTAMYYCAARAAPLYSSGSPLTRARYNVWGQGTQVTVSSGGSGGSGGSGQVQLQESGGGSVQAGGSLRLSCRASGSTYSNYCLGWFRQITGKEREGVAVINWVGGMLYFADSVKGRFTVSQDQAKNTLYLQMNSLKPEDTAMYYCAAESVSSFSCGGWLTRPDRVPYWGQGTQVTVSS

SEQ ID NO: 854 - protein, 267 aa, synthetic construct
  source 1..267: note = Description of Artificial Sequence: Synthetic polypeptide
QVQLQESGGGSVQAGGSLRLSCAASGYPYSNGYMGWFRQAPGKEREGVATIYTGDGRTYYADSVKGRFTISRDNAKNTVDLQMSSLKPEDTAMYYCAARAAPLYSSGSPLTRARYNVWGQGTQVTVSSGGSGGSGGSGQVQLQESGGGSVQAGGSLRLSCRASGSTYSNYCLGWFRQSTGKEREGVAVINWVGGMLYFADSVKGRFTVSQDHAKNTVTLQMNSLKPEDTAMYYCAAESVSSFSCGGWLTRPGRVPYWGQGTQVTVSS

SEQ ID NO: 855 - protein, 267 aa, synthetic construct
  source 1..267: note = Description of Artificial Sequence: Synthetic polypeptide
QVQLQESGGGSVQAGGSLRLSCAASGYPYSNGYMGWFRQAPGKEREGVATIYTGDGRTYYADSVKGRFTISRDNAKNTVDLQMSSLKPEDTAMYYCAARAAPLYSSGSPLTRARYNVWGQGTQVTVSSGGSGGSGGSGQVQLQESGGGSVQAGESLRLSCRASGSTYSNYCLGWFRQITGKEREGVAVINWVGGMLYFADSVKGRFTVSQDQAKNTVYLEMNSLKPEDTAMYYCATESVSSFSCGGWLTRPDRVPYWGQGTQVTVSS

SEQ ID NO: 856 - protein, 258 aa, synthetic construct
  source 1..258: note = Description of Artificial Sequence: Synthetic polypeptide
QVQLQESGGGSVQAGGSLRLSCAASGYPYSNGYMGWFRQAPGKEREGVATIYTGDGRTYYADSVKGRFTISRDNAKNTVDLQMSSLKPEDTAMYYCAARAAPLYSSGSPLTRARYNVWGQGTQVTVSSGGSGGSGGSGQVQLQESGGGSVQAGGSLRLSCVASGYVSCDYFLPSWYRQAPGKEREFVSIIDGTGSTSYAASVKGRFTASQDRGKNIAYLQMNSLKPEDTAMYYCKASCVRGRTISEYWGQGTQVTVSS

SEQ ID NO: 857 - protein, 258 aa, synthetic construct
  source 1..258: note = Description of Artificial Sequence: Synthetic polypeptide
QVQLQESGGGSVQAGGSLRLSCAASGYPYSNGYMGWFRQAPGKEREGVATIYTGDGRTYYADSVKGRFTISRDNAKNTVDLQMSSLKPEDTAMYYCAARAAPLYSSGSPLTRARYNVWGQGTQVTVSSGGSGGSGGSGQVQLQESGGGSVQAGGSLRLSCVASGYVSCDYFLPSWYRQAPGKEREFVSIIDGTGSTSYAASVKGRFTASQDKGKNIAYLQMNSLKPEDTAMYYCKASCVRGRAISEYWGQGTQVTVSS

SEQ ID NO: 858 - protein, 258 aa, synthetic construct
  source 1..258: note = Description of Artificial Sequence: Synthetic polypeptide
QVQLQESGGGSVQAGGSLRLSCAASGYPYSNGYMGWFRQAPGKEREGVATIYTGDGRTYYADSVKGRFTISRDNAKNTVDLQMSSLKPEDTAMYYCAARAAPLYSSGSPLTRARYNVWGQGTQVTVSSGGSGGSGGSGQVQLQESGGGSVQAGGSLRLSCVASGYVSCDYFLPSWYRQAPGKEREFVSIIDGTGSTSYAASVKGRFTASQDKGKNIAYLQMNTLKPEDTAMYYCKASCVRGRAISEYWGQGTQVTVSS

SEQ ID NO: 859 - protein, 267 aa, synthetic construct
  source 1..267: note = Description of Artificial Sequence: Synthetic polypeptide
QVQLQESGGGSVQAGGSLRLSCAASGYPYSNGYMGWFRQAPGKEREGVATIYTGDGRTYYADSVKGRFTISRDNAKNTVDLQMSSLKPEDTAMYYCAARAAPLYSSGSPLTRARYNVWGQGTQVTVSSGGSGGSGGSGQVQLQESGGGSVQAGGSLRLSCRASGSTYSNYCLGWFRQITGKEREGVAVINWVGGMLYFADSVKGRFTVSQDQAKNTVYLQMNSLKPEDTAMYYCAAESASSFSCGGWLTRPDRVPYWGQGTQVTVSS

SEQ ID NO: 860 - protein, 261 aa, synthetic construct
  source 1..261: note = Description of Artificial Sequence: Synthetic polypeptide
QVQLQESGGGSVQAGGSLRLSCAASGYPYSNGYMGWFRQAPGKEREGVATIYTGDGRTYYADSVKGRFTISRDNAKNTVDLQMSSLKPEDTAMYYCAARAAPLYSSGSPLTRARYNVWGQGTQVTVSSGGSGGSGGSGQVQLQESGGGLVQPGGSLRLSCAASGFTFSLSGMSWVRQAPGKGLEWVSAISSGGASTYYTDSVKGRFTISRDNAKNMLYLQLNSLKTEDTAMYYCAKGGSGYGDASRMTSPGSQGTQVTVSS

SEQ ID NO: 861 - protein, 258 aa, synthetic construct
  source 1..258: note = Description of Artificial Sequence: Synthetic polypeptide
QVQLQESGGGSVQAGGSLRLSCAASGYPYSNGYMGWFRQAPGKEREGVATIYTGDGRTYYADSVKGRFTISRDNAKNTVDLQMSSLKPEDTAMYYCAARAAPLYSSGSPLTRARYNVWGQGTQVTVSSGGSGGSGGSGQVQLQESGGGSVQAGGSLRLSCVASGYVSCDYFLPSWYRQAPGKEREFVSIIDGTGSTSYAASVKGRFTASQDKGKNIAYLQMNSLKPEDTAMYYCKASCVRGRGISEYWGQGTQVTVSS

SEQ ID NO: 862 - protein, 267 aa, synthetic construct
  source 1..267: note = Description of Artificial Sequence: Synthetic polypeptide
QVQLQESGGGSVQAGGSLRLSCAASGYPYSNGYMGWFRQAPGKEREGVATIYTGDGRTYYADSVKGRFTISRDNAKNTVDLQMSSLKPEDTAMYYCAARAAPLYSSGSPLTRARYNVWGQGTQVTVSSGGSGGSGGSGQVQLQESGGGSVQAGGSLRLSCRASGSTYSNYCLGWFRQITGKEREGVAVINWVGGMLYFADSVKGRFTVSQDQAKNTVYLQMNSLKPEDTAMYYCAAESVSSFSCGGWLTRPDRVPYWGQGTQVTVSS

SEQ ID NO: 863 - protein, 261 aa, synthetic construct
  source 1..261: note = Description of Artificial Sequence: Synthetic polypeptide
QVQLQESGGGSVQAGGSLRLSCAASGYPYSNGYMGWFRQAPGKEREGVATIYTGDGRTYYADSVKGRFTISRDNAKNTVDLQMSSLKPEDTAMYYCAARAAPLYSSGSPLTRARYNVWGQGTQVTVSSGGSGGSGGSGQVQLQESGGGLVQPGGSLRLSCAASGFTFSSYPMSWVRQAPGKGLEWVSTISSGGDTTLYADSVKGRFTSSRDNAKNTLYLQLNSLKTEDTAMYYCAKRIDCNSGYCYKRSYWGQGTQVTVSS

SEQ ID NO: 864 - protein, 261 aa, synthetic construct
  source 1..261: note = Description of Artificial Sequence: Synthetic polypeptide
QVQLQESGGGSVQAGGSLRLSCAASGYPYSNGYMGWFRQAPGKEREGVATIYTGDGRTYYADSVKGRFTISRDNAKNTVDLQMSSLKPEDTAMYYCAARAAPLYSSGSPLTRARYNVWGQGTQVTVSSGGSGGSGGSGQVQLQESGGGLVQPGGSLRLSCAASGFTFSLSSMSWVRQAPGKGLEWVSAISSGGASTYYTDSVKGRFTISRDNAKNMLYLQLNSLKTEDTAMYYCAKGGSGYGDASRMTSPGSQGTQVTVSS

SEQ ID NO: 865 - protein, 267 aa, synthetic construct
  source 1..267: note = Description of Artificial Sequence: Synthetic polypeptide
QVQLQESGGGSVQAGGSLRLSCAASGYPYSNGYMGWFRQAPGKEREGVATIYTGDGRTYYADSVKGRFTISRDNAKNTVDLQMSSLKPEDTAMYYCAARAAPLYSSGSPLTRARYNVWGQGTQVTVSSGGSGGSGGSGQVQLQESGGGSVQAGGSLRLSCRASGSTYSNYCLGWFRQTTGKEREGVAVINWVGGMLYFADSVKGRFTVSQDQAKNTVYLQMNSLKPEDTAMYYCAAESVSSFSCGGWLTRPDRVPYWGQGTQVTVSS

SEQ ID NO: 866 - protein, 267 aa, synthetic construct
  source 1..267: note = Description of Artificial Sequence: Synthetic polypeptide
QVQLQESGGGSVQAGGSLRLSCAASGYPYSNGYMGWFRQAPGKEREGVATIYTGDGRTYYADSVKGRFTISRDNAKNTVDLQMSSLKPEDTAMYYCAARAAPLYSSGSPLTRARYNVWGQGTQVTVSSGGSGGSGGSGQVQLQESGGGSVQAGGSLRLSCRASRSPYGNYCLGWFRQSTGKEREGVAVINWVGGMLYFADSVKGRFTVSQDHAKNTVTLQMNSLKPEDTAMYYCAAESVSSFSCGGWLTRPDRVPYWGQGTQVTVSS

SEQ ID NO: 867 - protein, 261 aa, synthetic construct
  source 1..261: note = Description of Artificial Sequence: Synthetic polypeptide
QVQLQESGGGSVQAGGSLRLSCAASGYPYSNGYMGWFRQAPGKEREGVATIYTGDGRTYYADSVKGRFTISRDNAKNTVDLQMSSLKPEDTAMYYCAARAAPLYSSGSPLTRARYNVWGQGTQVTVSSGGSGGSGGSGQVQLQESGGGLVQPGGSLRLSCAASGFTFSHSGMSWVRQAPGKGLEWVSTINSGGASTYYTDSVKGRFTISRDNAKNMLYLQLNSLKTEDTAMYYCAKGGSGYGDASRMTSPGSQGTQVTVSS

SEQ ID NO: 868 - protein, 252 aa, synthetic construct
  source 1..252: note = Description of Artificial Sequence: Synthetic polypeptide
QVQLQESGGGSVQAGGSLRLSCVASASTYCTYDMHWYRQAPGKGREFVSAIDSDGTTRYADSVKGRFTISQGTAKNTVYLQMNSLQPEDTAMYYCKTVCVVGSRWSDYWGQGTQVTVSSGGSGGSGGSGQVQLQESGGGLVQPGGSLRLSCAASGFTFSSYPMSWVRQAPGKGLEWISTISAGGDTTLYADSVKGRFTSSRDNAKNTLYLQLNSLKTEDAAIYYCAKRIDCNSGYCYRRNYWGQGTQVTVSS

SEQ ID NO: 869 - protein, 252 aa, synthetic construct
  source 1..252: note = Description of Artificial Sequence: Synthetic polypeptide
QVQLQESGGGSVQAGGSLRLSCVASASTYCTYDMHWYRQAPGKGREFVSAIDSDGTTRYADSVKGRFTISQGTAKNTVYLQMNSLQPEDTAMYYCKTVCVVGSRWSDYWGQGTQVTVSSGGSGGSGGSGQVQLQESGGGLVQPGGSLRLSCAASGFTFSLSGMSWVRQAPGKGLEWVSAISSGGASTYYTDSVKGRFTISRDNAKNILYLQLNSLKTEDTAMYYCAKGGSGYGDASRMTSPGSQGTQVTVSS

SEQ ID NO: 870 - protein, 249 aa, synthetic construct
  source 1..249: note = Description of Artificial Sequence: Synthetic polypeptide
QVQLQESGGGSVQAGGSLRLSCVASASTYCTYDMHWYRQAPGKGREFVSAIDSDGTTRYADSVKGRFTISQGTAKNTVYLQMNSLQPEDTAMYYCKTVCVVGSRWSDYWGQGTQVTVSSGGSGGSGGSGQVQLQESGGGSVQAGGSLRLSCVASGYVSCDYFLPSWYRQAPGKEREFVSIIDGTGSTSYAASVKGRFTASEDKGKNIAYLQMNSLKPEDTAMYYCKASCVRGRAVSEYWGQGTQVTVSS

SEQ ID NO: 871 - protein, 253 aa, synthetic construct
  source 1..253: note = Description of Artificial Sequence: Synthetic polypeptide
QVQLQESGGGSVQAGGSLRLSCVASASTYCTYDMHWYRQAPGKGREFVSAIDSDGTTRYADSVKGRFTISQGTAKNTVYLQMNSLQPEDTAMYYCKTVCVVGSRWSDYWGQGTQVTVSSGGSGGSGGSGQVQLQESGGGLVQPGESLRLSCTASGFTFSNYAMSWVRQAPGKGLEWVSGINVAYGITSYADSVKGRFTISRDNTKNTLYLQLNSLKTEDTAIYYCVKHSGTTIPRGFISYTKRGQGTQVTVSS

SEQ ID NO: 872 - protein, 249 aa, synthetic construct
  source 1..249: note = Description of Artificial Sequence: Synthetic polypeptide
QVQLQESGGGSVQAGGSLRLSCVASASTYCTYDMHWYRQAPGKGREFVSAIDSDGTTRYADSVKGRFTISQGTAKNTVYLQMNSLQPEDTAMYYCKTVCVVGSRWSDYWGQGTQVTVSSGGSGGSGGSGQVQLQESGGGSVQAGGSLRLSCTASGYVSCDYFLPSWYRQAPGKEREFVSVIDGTGSTSYAASVKGRFTASQDKGKNIAYLQMNSLKPEDTAMYYCKASCVRGRAISEYWGQGTQVTVSS

SEQ ID NO: 873 - protein, 248 aa, synthetic construct
  source 1..248: note = Description of Artificial Sequence: Synthetic polypeptide
QVQLQESGGGSVQAGGSLRLSCVASASTYCTYDMHWYRQAPGKGREFVSAIDSDGTTRYADSVKGRFTISQGTAKNTVYLQMNSLQPEDTAMYYCKTVCVVGSRWSDYWGQGTQVTVSSGGSGGSGGSGQVQLQESGGGLVQPGGSLRLSCAASGFSFSSYAMKWVRQAPGKGLEWVSTISSGGSSTNYADSVKGRFTISRDNAKNTLYLQLNSLKIEDTAMYYCAKAIVPTGATMERGQGTQVTVSS

SEQ ID NO: 874 - protein, 252 aa, synthetic construct
  source 1..252: note = Description of Artificial Sequence: Synthetic polypeptide
QVQLQESGGGSVQAGGSLRLSCVASASTYCTYDMHWYRQAPGKGREFVSAIDSDGTTRYADSVKGRFTISQGTAKNTVYLQMNSLQPEDTAMYYCKTVCVVGSRWSDYWGQGTQVTVSSGGSGGSGGSGQVQLQESGGGLVQPGGSLRLSCAASGFTFSSYPMSWVRQAPGKGLEWISTISAGGDTTLYADSVKGRFTSSRDNAKNTLYLQLNSLKTEDTAIYYCAKRIDCNSGYCYRRNYWGQGTQVTVSS

SEQ ID NO: 875 - protein, 252 aa, synthetic construct
  source 1..252: note = Description of Artificial Sequence: Synthetic polypeptide
QVQLQESGGGSVQAGGSLRLSCVASASTYCTYDMHWYRQAPGKGREFVSAIDSDGTTRYADSVKGRFTISQGTAKNTVYLQMNSLQPEDTAMYYCKTVCVVGSRWSDYWGQGTQVTVSSGGSGGSGGSGQVQLQESGGGSVQVGGSLRLSCAASGFTFSSYPMSWVRQAPGKGLEWISTISAGGDTTLYADSVKGRFTSSRDNAKNTLYLQLNSLKTEDTAIYYCAKRIDCNSGYCYRRNYWGQGTQVTVSS

SEQ ID NO: 876 - protein, 257 aa, synthetic construct
  source 1..257: note = Description of Artificial Sequence: Synthetic polypeptide
QVQLQESGGGSVQAGGSLRLSCVASASTYCTYDMHWYRQAPGKGREFVSAIDSDGTTRYADSVKGRFTISQGTAKNTVYLQMNSLQPEDTAMYYCKTVCVVGSRWSDYWGQGTQVTVSSGGSGGSGGSGQVQLQESGGGSVQSGGSLRLSCAASGFTYSTSNSWMAWFRQAPGKEREGVAAIYTVGGSIFYADSVRGRFTISQDATKNMFYLQMNTLKPEDTAMYYCAAASGRLRGKWFWPYEYNYWGQGTQVTVSS

SEQ ID NO: 877 - protein, 258 aa, synthetic construct
  source 1..258: note = Description of Artificial Sequence: Synthetic polypeptide
QVQLQESGGGSVQAGGSLRLSCVASASTYCTYDMHWYRQAPGKGREFVSAIDSDGTTRYADSVKGRFTISQGTAKNTVYLQMNSLQPEDTAMYYCKTVCVVGSRWSDYWGQGTQVTVSSGGSGGSGGSGQVQLQESGGGSVQAGGSLRLSCRASGSTYSNYCLGWFRQITGKEREGVAVINWVGGMLYFADSVKGRFTVSQDQAKNTLYLQMNSLKPEDTAMYYCAAESVSSFSCGGWLTRPDRVPYWGQGTQVTVSS

SEQ ID NO: 878 - protein, 258 aa, synthetic construct
  source 1..258: note = Description of Artificial Sequence: Synthetic polypeptide
QVQLQESGGGSVQAGGSLRLSCVASASTYCTYDMHWYRQAPGKGREFVSAIDSDGTTRYADSVKGRFTISQGTAKNTVYLQMNSLQPEDTAMYYCKTVCVVGSRWSDYWGQGTQVTVSSGGSGGSGGSGQVQLQESGGGSVQAGGSLRLSCRASGSTYSNYCLGWFRQSTGKEREGVAVINWVGGMLYFADSVKGRFTVSQDHAKNTVTLQMNSLKPEDTAMYYCAAESVSSFSCGGWLTRPGRVPYWGQGTQVTVSS

SEQ ID NO: 879 - protein, 258 aa, synthetic construct
  source 1..258: note = Description of Artificial Sequence: Synthetic polypeptide
QVQLQESGGGSVQAGGSLRLSCVASASTYCTYDMHWYRQAPGKGREFVSAIDSDGTTRYADSVKGRFTISQGTAKNTVYLQMNSLQPEDTAMYYCKTVCVVGSRWSDYWGQGTQVTVSSGGSGGSGGSGQVQLQESGGGSVQAGESLRLSCRASGSTYSNYCLGWFRQITGKEREGVAVINWVGGMLYFADSVKGRFTVSQDQAKNTVYLEMNSLKPEDTAMYYCATESVSSFSCGGWLTRPDRVPYWGQGTQVTVSS

SEQ ID NO: 880 - protein, 249 aa, synthetic construct
  source 1..249: note = Description of Artificial Sequence: Synthetic polypeptide
QVQLQESGGGSVQAGGSLRLSCVASASTYCTYDMHWYRQAPGKGREFVSAIDSDGTTRYADSVKGRFTISQGTAKNTVYLQMNSLQPEDTAMYYCKTVCVVGSRWSDYWGQGTQVTVSSGGSGGSGGSGQVQLQESGGGSVQAGGSLRLSCVASGYVSCDYFLPSWYRQAPGKEREFVSIIDGTGSTSYAASVKGRFTASQDRGKNIAYLQMNSLKPEDTAMYYCKASCVRGRTISEYWGQGTQVTVSS

SEQ ID NO: 881 - protein, 249 aa, synthetic construct
  source 1..249: note = Description of Artificial Sequence: Synthetic polypeptide
QVQLQESGGGSVQAGGSLRLSCVASASTYCTYDMHWYRQAPGKGREFVSAIDSDGTTRYADSVKGRFTISQGTAKNTVYLQMNSLQPEDTAMYYCKTVCVVGSRWSDYWGQGTQVTVSSGGSGGSGGSGQVQLQESGGGSVQAGGSLRLSCVASGYVSCDYFLPSWYRQAPGKEREFVSIIDGTGSTSYAASVKGRFTASQDKGKNIAYLQMNSLKPEDTAMYYCKASCVRGRAISEYWGQGTQVTVSS

SEQ ID NO: 882 - protein, 249 aa, synthetic construct
  source 1..249: note = Description of Artificial Sequence: Synthetic polypeptide
QVQLQESGGGSVQAGGSLRLSCVASASTYCTYDMHWYRQAPGKGREFVSAIDSDGTTRYADSVKGRFTISQGTAKNTVYLQMNSLQPEDTAMYYCKTVCVVGSRWSDYWGQGTQVTVSSGGSGGSGGSGQVQLQESGGGSVQAGGSLRLSCVASGYVSCDYFLPSWYRQAPGKEREFVSIIDGTGSTSYAASVKGRFTASQDKGKNIAYLQMNTLKPEDTAMYYCKASCVRGRAISEYWGQGTQVTVSS

SEQ ID NO: 883 - protein, 258 aa, synthetic construct
  source 1..258: note = Description of Artificial Sequence: Synthetic polypeptide
QVQLQESGGGSVQAGGSLRLSCVASASTYCTYDMHWYRQAPGKGREFVSAIDSDGTTRYADSVKGRFTISQGTAKNTVYLQMNSLQPEDTAMYYCKTVCVVGSRWSDYWGQGTQVTVSSGGSGGSGGSGQVQLQESGGGSVQAGGSLRLSCRASGSTYSNYCLGWFRQITGKEREGVAVINWVGGMLYFADSVKGRFTVSQDQAKNTVYLQMNSLKPEDTAMYYCAAESASSFSCGGWLTRPDRVPYWGQGTQVTVSS

SEQ ID NO: 884 - protein, 252 aa, synthetic construct
  source 1..252: note = Description of Artificial Sequence: Synthetic polypeptide
QVQLQESGGGSVQAGGSLRLSCVASASTYCTYDMHWYRQAPGKGREFVSAIDSDGTTRYADSVKGRFTISQGTAKNTVYLQMNSLQPEDTAMYYCKTVCVVGSRWSDYWGQGTQVTVSSGGSGGSGGSGQVQLQESGGGLVQPGGSLRLSCAASGFTFSLSGMSWVRQAPGKGLEWVSAISSGGASTYYTDSVKGRFTISRDNAKNMLYLQLNSLKTEDTAMYYCAKGGSGYGDASRMTSPGSQGTQVTVSS

SEQ ID NO: 885 - protein, 249 aa, synthetic construct
  source 1..249: note = Description of Artificial Sequence: Synthetic polypeptide
QVQLQESGGGSVQAGGSLRLSCVASASTYCTYDMHWYRQAPGKGREFVSAIDSDGTTRYADSVKGRFTISQGTAKNTVYLQMNSLQPEDTAMYYCKTVCVVGSRWSDYWGQGTQVTVSSGGSGGSGGSGQVQLQESGGGSVQAGGSLRLSCVASGYVSCDYFLPSWYRQAPGKEREFVSIIDGTGSTSYAASVKGRFTASQDKGKNIAYLQMNSLKPEDTAMYYCKASCVRGRGISEYWGQGTQVTVSS

SEQ ID NO: 886 - protein, 258 aa, synthetic construct
  source 1..258: note = Description of Artificial Sequence: Synthetic polypeptide
QVQLQESGGGSVQAGGSLRLSCVASASTYCTYDMHWYRQAPGKGREFVSAIDSDGTTRYADSVKGRFTISQGTAKNTVYLQMNSLQPEDTAMYYCKTVCVVGSRWSDYWGQGTQVTVSSGGSGGSGGSGQVQLQESGGGSVQAGGSLRLSCRASGSTYSNYCLGWFRQITGKEREGVAVINWVGGMLYFADSVKGRFTVSQDQAKNTVYLQMNSLKPEDTAMYYCAAESVSSFSCGGWLTRPDRVPYWGQGTQVTVSS

SEQ ID NO: 887 - protein, 252 aa, synthetic construct
  source 1..252: note = Description of Artificial Sequence: Synthetic polypeptide
QVQLQESGGGSVQAGGSLRLSCVASASTYCTYDMHWYRQAPGKGREFVSAIDSDGTTRYADSVKGRFTISQGTAKNTVYLQMNSLQPEDTAMYYCKTVCVVGSRWSDYWGQGTQVTVSSGGSGGSGGSGQVQLQESGGGLVQPGGSLRLSCAASGFTFSSYPMSWVRQAPGKGLEWVSTISSGGDTTLYADSVKGRFTSSRDNAKNTLYLQLNSLKTEDTAMYYCAKRIDCNSGYCYKRSYWGQGTQVTVSS

SEQ ID NO: 888 - protein, 252 aa, synthetic construct
  source 1..252: note = Description of Artificial Sequence: Synthetic polypeptide
QVQLQESGGGSVQAGGSLRLSCVASASTYCTYDMHWYRQAPGKGREFVSAIDSDGTTRYADSVKGRFTISQGTAKNTVYLQMNSLQPEDTAMYYCKTVCVVGSRWSDYWGQGTQVTVSSGGSGGSGGSGQVQLQESGGGLVQPGGSLRLSCAASGFTFSLSSMSWVRQAPGKGLEWVSAISSGGASTYYTDSVKGRFTISRDNAKNMLYLQLNSLKTEDTAMYYCAKGGSGYGDASRMTSPGSQGTQVTVSS

SEQ ID NO: 889 - protein, 258 aa, synthetic construct
  source 1..258: note = Description of Artificial Sequence: Synthetic polypeptide
QVQLQESGGGSVQAGGSLRLSCVASASTYCTYDMHWYRQAPGKGREFVSAIDSDGTTRYADSVKGRFTISQGTAKNTVYLQMNSLQPEDTAMYYCKTVCVVGSRWSDYWGQGTQVTVSSGGSGGSGGSGQVQLQESGGGSVQAGGSLRLSCRASGSTYSNYCLGWFRQTTGKEREGVAVINWVGGMLYFADSVKGRFTVSQDQAKNTVYLQMNSLKPEDTAMYYCAAESVSSFSCGGWLTRPDRVPYWGQGTQVTVSS

SEQ ID NO: 890 - protein, 258 aa, synthetic construct
  source 1..258: note = Description of Artificial Sequence: Synthetic polypeptide
QVQLQESGGGSVQAGGSLRLSCVASASTYCTYDMHWYRQAPGKGREFVSAIDSDGTTRYADSVKGRFTISQGTAKNTVYLQMNSLQPEDTAMYYCKTVCVVGSRWSDYWGQGTQVTVSSGGSGGSGGSGQVQLQESGGGSVQAGGSLRLSCRASRSPYGNYCLGWFRQSTGKEREGVAVINWVGGMLYFADSVKGRFTVSQDHAKNTVTLQMNSLKPEDTAMYYCAAESVSSFSCGGWLTRPDRVPYWGQGTQVTVSS

SEQ ID NO: 891 - protein, 252 aa, synthetic construct
  source 1..252: note = Description of Artificial Sequence: Synthetic polypeptide
QVQLQESGGGSVQAGGSLRLSCVASASTYCTYDMHWYRQAPGKGREFVSAIDSDGTTRYADSVKGRFTISQGTAKNTVYLQMNSLQPEDTAMYYCKTVCVVGSRWSDYWGQGTQVTVSSGGSGGSGGSGQVQLQESGGGLVQPGGSLRLSCAASGFTFSHSGMSWVRQAPGKGLEWVSTINSGGASTYYTDSVKGRFTISRDNAKNMLYLQLNSLKTEDTAMYYCAKGGSGYGDASRMTSPGSQGTQVTVSS

SEQ ID NO: 892 - protein, 250 aa, synthetic construct
  source 1..250: note = Description of Artificial Sequence: Synthetic polypeptide
QVQLQESGGGSVQAGGSLTLSCAASEYAYSTCNMGWYRQAPGKERELVSAFISDGSTYYADSVKGRFTITRDNAKNTVYLQMNSLKPEDTAIYYCSANCYRRLRNYWGQGTQVTVSSGGSGGSGGSGQVQLQESGGGLVQPGGSLRLSCAASGFTFSSYPMSWVRQAPGKGLEWISTISAGGDTTLYADSVKGRFTSSRDNAKNTLYLQLNSLKTEDAAIYYCAKRIDCNSGYCYRRNYWGQGTQVTVSS

SEQ ID NO: 893 - protein, 250 aa, synthetic construct
  source 1..250: note = Description of Artificial Sequence: Synthetic polypeptide
QVQLQESGGGSVQAGGSLTLSCAASEYAYSTCNMGWYRQAPGKERELVSAFISDGSTYYADSVKGRFTITRDNAKNTVYLQMNSLKPEDTAIYYCSANCYRRLRNYWGQGTQVTVSSGGSGGSGGSGQVQLQESGGGLVQPGGSLRLSCAASGFTFSLSGMSWVRQAPGKGLEWVSAISSGGASTYYTDSVKGRFTISRDNAKNILYLQLNSLKTEDTAMYYCAKGGSGYGDASRMTSPGSQGTQVTVSS

SEQ ID NO: 894 - protein, 247 aa, synthetic construct
  source 1..247: note = Description of Artificial Sequence: Synthetic polypeptide
QVQLQESGGGSVQAGGSLTLSCAASEYAYSTCNMGWYRQAPGKERELVSAFISDGSTYYADSVKGRFTITRDNAKNTVYLQMNSLKPEDTAIYYCSANCYRRLRNYWGQGTQVTVSSGGSGGSGGSGQVQLQESGGGSVQAGGSLRLSCVASGYVSCDYFLPSWYRQAPGKEREFVSIIDGTGSTSYAASVKGRFTASEDKGKNIAYLQMNSLKPEDTAMYYCKASCVRGRAVSEYWGQGTQVTVSS

SEQ ID NO: 895 - protein, 251 aa, synthetic construct
  source 1..251: note = Description of Artificial Sequence: Synthetic polypeptide
QVQLQESGGGSVQAGGSLTLSCAASEYAYSTCNMGWYRQAPGKERELVSAFISDGSTYYADSVKGRFTITRDNAKNTVYLQMNSLKPEDTAIYYCSANCYRRLRNYWGQGTQVTVSSGGSGGSGGSGQVQLQESGGGLVQPGESLRLSCTASGFTFSNYAMSWVRQAPGKGLEWVSGINVAYGITSYADSVKGRFTISRDNTKNTLYLQLNSLKTEDTAIYYCVKHSGTTIPRGFISYTKRGQGTQVTVSS

SEQ ID NO: 896 - protein, 247 aa, synthetic construct
  source 1..247: note = Description of Artificial Sequence: Synthetic polypeptide
QVQLQESGGGSVQAGGSLTLSCAASEYAYSTCNMGWYRQAPGKERELVSAFISDGSTYYADSVKGRFTITRDNAKNTVYLQMNSLKPEDTAIYYCSANCYRRLRNYWGQGTQVTVSSGGSGGSGGSGQVQLQESGGGSVQAGGSLRLSCTASGYVSCDYFLPSWYRQAPGKEREFVSVIDGTGSTSYAASVKGRFTASQDKGKNIAYLQMNSLKPEDTAMYYCKASCVRGRAISEYWGQGTQVTVSS

SEQ ID NO: 897 - protein, 246 aa, synthetic construct
  source 1..246: note = Description of Artificial Sequence: Synthetic polypeptide
QVQLQESGGGSVQAGGSLTLSCAASEYAYSTCNMGWYRQAPGKERELVSAFISDGSTYYADSVKGRFTITRDNAKNTVYLQMNSLKPEDTAIYYCSANCYRRLRNYWGQGTQVTVSSGGSGGSGGSGQVQLQESGGGLVQPGGSLRLSCAASGFSFSSYAMKWVRQAPGKGLEWVSTISSGGSSTNYADSVKGRFTISRDNAKNTLYLQLNSLKIEDTAMYYCAKAIVPTGATMERGQGTQVTVSS

SEQ ID NO: 898 - protein, 250 aa, synthetic construct
  source 1..250: note = Description of Artificial Sequence: Synthetic polypeptide
QVQLQESGGGSVQAGGSLTLSCAASEYAYSTCNMGWYRQAPGKERELVSAFISDGSTYYADSVKGRFTITRDNAKNTVYLQMNSLKPEDTAIYYCSANCYRRLRNYWGQGTQVTVSSGGSGGSGGSGQVQLQESGGGLVQPGGSLRLSCAASGFTFSSYPMSWVRQAPGKGLEWISTISAGGDTTLYADSVKGRFTSSRDNAKNTLYLQLNSLKTEDTAIYYCAKRIDCNSGYCYRRNYWGQGTQVTVSS

SEQ ID NO: 899 - protein, 250 aa, synthetic construct
  source 1..250: note = Description of Artificial Sequence: Synthetic polypeptide
QVQLQESGGGSVQAGGSLTLSCAASEYAYSTCNMGWYRQAPGKERELVSAFISDGSTYYADSVKGRFTITRDNAKNTVYLQMNSLKPEDTAIYYCSANCYRRLRNYWGQGTQVTVSSGGSGGSGGSGQVQLQESGGGSVQVGGSLRLSCAASGFTFSSYPMSWVRQAPGKGLEWISTISAGGDTTLYADSVKGRFTSSRDNAKNTLYLQLNSLKTEDTAIYYCAKRIDCNSGYCYRRNYWGQGTQVTVSS

SEQ ID NO: 900 - protein, 255 aa, synthetic construct
  source 1..255: note = Description of Artificial Sequence: Synthetic polypeptide
QVQLQESGGGSVQAGGSLTLSCAASEYAYSTCNMGWYRQAPGKERELVSAFISDGSTYYADSVKGRFTITRDNAKNTVYLQMNSLKPEDTAIYYCSANCYRRLRNYWGQGTQVTVSSGGSGGSGGSGQVQLQESGGGSVQSGGSLRLSCAASGFTYSTSNSWMAWFRQAPGKEREGVAAIYTVGGSIFYADSVRGRFTISQDATKNMFYLQMNTLKPEDTAMYYCAAASGRLRGKWFWPYEYNYWGQGTQVTVSS

SEQ ID NO: 901 - protein, 256 aa, synthetic construct
  source 1..256: note = Description of Artificial Sequence: Synthetic polypeptide
QVQLQESGGGSVQAGGSLTLSCAASEYAYSTCNMGWYRQAPGKERELVSAFISDGSTYYADSVKGRFTITRDNAKNTVYLQMNSLKPEDTAIYYCSANCYRRLRNYWGQGTQVTVSSGGSGGSGGSGQVQLQESGGGSVQAGGSLRLSCRASGSTYSNYCLGWFRQITGKEREGVAVINWVGGMLYFADSVKGRFTVSQDQAKNTLYLQMNSLKPEDTAMYYCAAESVSSFSCGGWLTRPDRVPYWGQGTQVTVSS

SEQ ID NO: 902 - protein, 256 aa, synthetic construct
  source 1..256: note = Description of Artificial Sequence: Synthetic polypeptide
QVQLQESGGGSVQAGGSLTLSCAASEYAYSTCNMGWYRQAPGKERELVSAFISDGSTYYADSVKGRFTITRDNAKNTVYLQMNSLKPEDTAIYYCSANCYRRLRNYWGQGTQVTVSSGGSGGSGGSGQVQLQESGGGSVQAGGSLRLSCRASGSTYSNYCLGWFRQSTGKEREGVAVINWVGGMLYFADSVKGRFTVSQDHAKNTVTLQMNSLKPEDTAMYYCAAESVSSFSCGGWLTRPGRVPYWGQGTQVTVSS

SEQ ID NO: 903 - protein, 256 aa, synthetic construct
  source 1..256: note = Description of Artificial Sequence: Synthetic polypeptide
QVQLQESGGGSVQAGGSLTLSCAASEYAYSTCNMGWYRQAPGKERELVSAFISDGSTYYADSVKGRFTITRDNAKNTVYLQMNSLKPEDTAIYYCSANCYRRLRNYWGQGTQVTVSSGGSGGSGGSGQVQLQESGGGSVQAGESLRLSCRASGSTYSNYCLGWFRQITGKEREGVAVINWVGGMLYFADSVKGRFTVSQDQAKNTVYLEMNSLKPEDTAMYYCATESVSSFSCGGWLTRPDRVPYWGQGTQVTVSS

SEQ ID NO: 904 - protein, 247 aa, synthetic construct
  source 1..247: note = Description of Artificial Sequence: Synthetic polypeptide
QVQLQESGGGSVQAGGSLTLSCAASEYAYSTCNMGWYRQAPGKERELVSAFISDGSTYYADSVKGRFTITRDNAKNTVYLQMNSLKPEDTAIYYCSANCYRRLRNYWGQGTQVTVSSGGSGGSGGSGQVQLQESGGGSVQAGGSLRLSCVASGYVSCDYFLPSWYRQAPGKEREFVSIIDGTGSTSYAASVKGRFTASQDRGKNIAYLQMNSLKPEDTAMYYCKASCVRGRTISEYWGQGTQVTVSS

SEQ ID NO: 905 - protein, 247 aa, synthetic construct
  source 1..247: note = Description of Artificial Sequence: Synthetic polypeptide
QVQLQESGGGSVQAGGSLTLSCAASEYAYSTCNMGWYRQAPGKERELVSAFISDGSTYYADSVKGRFTITRDNAKNTVYLQMNSLKPEDTAIYYCSANCYRRLRNYWGQGTQVTVSSGGSGGSGGSGQVQLQESGGGSVQAGGSLRLSCVASGYVSCDYFLPSWYRQAPGKEREFVSIIDGTGSTSYAASVKGRFTASQDKGKNIAYLQMNSLKPEDTAMYYCKASCVRGRAISEYWGQGTQVTVSS

SEQ ID NO: 906 - protein, 247 aa, synthetic construct
  source 1..247: note = Description of Artificial Sequence: Synthetic polypeptide
QVQLQESGGGSVQAGGSLTLSCAASEYAYSTCNMGWYRQAPGKERELVSAFISDGSTYYADSVKGRFTITRDNAKNTVYLQMNSLKPEDTAIYYCSANCYRRLRNYWGQGTQVTVSSGGSGGSGGSGQVQLQESGGGSVQAGGSLRLSCVASGYVSCDYFLPSWYRQAPGKEREFVSIIDGTGSTSYAASVKGRFTASQDKGKNIAYLQMNTLKPEDTAMYYCKASCVRGRAISEYWGQGTQVTVSS

SEQ ID NO: 907 - protein, 256 aa, synthetic construct
  source 1..256: note = Description of Artificial Sequence: Synthetic polypeptide
QVQLQESGGGSVQAGGSLTLSCAASEYAYSTCNMGWYRQAPGKERELVSAFISDGSTYYADSVKGRFTITRDNAKNTVYLQMNSLKPEDTAIYYCSANCYRRLRNYWGQGTQVTVSSGGSGGSGGSGQVQLQESGGGSVQAGGSLRLSCRASGSTYSNYCLGWFRQITGKEREGVAVINWVGGMLYFADSVKGRFTVSQDQAKNTVYLQMNSLKPEDTAMYYCAAESASSFSCGGWLTRPDRVPYWGQGTQVTVSS

SEQ ID NO: 908 - protein, 250 aa, synthetic construct
  source 1..250: note = Description of Artificial Sequence: Synthetic polypeptide
QVQLQESGGGSVQAGGSLTLSCAASEYAYSTCNMGWYRQAPGKERELVSAFISDGSTYYADSVKGRFTITRDNAKNTVYLQMNSLKPEDTAIYYCSANCYRRLRNYWGQGTQVTVSSGGSGGSGGSGQVQLQESGGGLVQPGGSLRLSCAASGFTFSLSGMSWVRQAPGKGLEWVSAISSGGASTYYTDSVKGRFTISRDNAKNMLYLQLNSLKTEDTAMYYCAKGGSGYGDASRMTSPGSQGTQVTVSS

SEQ ID NO: 909 - protein, 247 aa, synthetic construct
  source 1..247: note = Description of Artificial Sequence: Synthetic polypeptide
QVQLQESGGGSVQAGGSLTLSCAASEYAYSTCNMGWYRQAPGKERELVSAFISDGSTYYADSVKGRFTITRDNAKNTVYLQMNSLKPEDTAIYYCSANCYRRLRNYWGQGTQVTVSSGGSGGSGGSGQVQLQESGGGSVQAGGSLRLSCVASGYVSCDYFLPSWYRQAPGKEREFVSIIDGTGSTSYAASVKGRFTASQDKGKNIAYLQMNSLKPEDTAMYYCKASCVRGRGISEYWGQGTQVTVSS

SEQ ID NO: 910 - protein, 256 aa, synthetic construct
  source 1..256: note = Description of Artificial Sequence: Synthetic polypeptide
QVQLQESGGGSVQAGGSLTLSCAASEYAYSTCNMGWYRQAPGKERELVSAFISDGSTYYADSVKGRFTITRDNAKNTVYLQMNSLKPEDTAIYYCSANCYRRLRNYWGQGTQVTVSSGGSGGSGGSGQVQLQESGGGSVQAGGSLRLSCRASGSTYSNYCLGWFRQITGKEREGVAVINWVGGMLYFADSVKGRFTVSQDQAKNTVYLQMNSLKPEDTAMYYCAAESVSSFSCGGWLTRPDRVPYWGQGTQVTVSS

SEQ ID NO: 911 - protein, 250 aa, synthetic construct
  source 1..250: note = Description of Artificial Sequence: Synthetic polypeptide
QVQLQESGGGSVQAGGSLTLSCAASEYAYSTCNMGWYRQAPGKERELVSAFISDGSTYYADSVKGRFTITRDNAKNTVYLQMNSLKPEDTAIYYCSANCYRRLRNYWGQGTQVTVSSGGSGGSGGSGQVQLQESGGGLVQPGGSLRLSCAASGFTFSSYPMSWVRQAPGKGLEWVSTISSGGDTTLYADSVKGRFTSSRDNAKNTLYLQLNSLKTEDTAMYYCAKRIDCNSGYCYKRSYWGQGTQVTVSS

SEQ ID NO: 912 - protein, 250 aa, synthetic construct
  source 1..250: note = Description of Artificial Sequence: Synthetic polypeptide
QVQLQESGGGSVQAGGSLTLSCAASEYAYSTCNMGWYRQAPGKERELVSAFISDGSTYYADSVKGRFTITRDNAKNTVYLQMNSLKPEDTAIYYCSANCYRRLRNYWGQGTQVTVSSGGSGGSGGSGQVQLQESGGGLVQPGGSLRLSCAASGFTFSLSSMSWVRQAPGKGLEWVSAISSGGASTYYTDSVKGRFTISRDNAKNMLYLQLNSLKTEDTAMYYCAKGGSGYGDASRMTSPGSQGTQVTVSS

SEQ ID NO: 913 - protein, 256 aa, synthetic construct
  source 1..256: note = Description of Artificial Sequence: Synthetic polypeptide
QVQLQESGGGSVQAGGSLTLSCAASEYAYSTCNMGWYRQAPGKERELVSAFISDGSTYYADSVKGRFTITRDNAKNTVYLQMNSLKPEDTAIYYCSANCYRRLRNYWGQGTQVTVSSGGSGGSGGSGQVQLQESGGGSVQAGGSLRLSCRASGSTYSNYCLGWFRQTTGKEREGVAVINWVGGMLYFADSVKGRFTVSQDQAKNTVYLQMNSLKPEDTAMYYCAAESVSSFSCGGWLTRPDRVPYWGQGTQVTVSS

SEQ ID NO: 914 - protein, 256 aa, synthetic construct
  source 1..256: note = Description of Artificial Sequence: Synthetic polypeptide
QVQLQESGGGSVQAGGSLTLSCAASEYAYSTCNMGWYRQAPGKERELVSAFISDGSTYYADSVKGRFTITRDNAKNTVYLQMNSLKPEDTAIYYCSANCYRRLRNYWGQGTQVTVSSGGSGGSGGSGQVQLQESGGGSVQAGGSLRLSCRASRSPYGNYCLGWFRQSTGKEREGVAVINWVGGMLYFADSVKGRFTVSQDHAKNTVTLQMNSLKPEDTAMYYCAAESVSSFSCGGWLTRPDRVPYWGQGTQVTVSS

SEQ ID NO: 915 - protein, 250 aa, synthetic construct
  source 1..250: note = Description of Artificial Sequence: Synthetic polypeptide
QVQLQESGGGSVQAGGSLTLSCAASEYAYSTCNMGWYRQAPGKERELVSAFISDGSTYYADSVKGRFTITRDNAKNTVYLQMNSLKPEDTAIYYCSANCYRRLRNYWGQGTQVTVSSGGSGGSGGSGQVQLQESGGGLVQPGGSLRLSCAASGFTFSHSGMSWVRQAPGKGLEWVSTINSGGASTYYTDSVKGRFTISRDNAKNMLYLQLNSLKTEDTAMYYCAKGGSGYGDASRMTSPGSQGTQVTVSS

SEQ ID NO: 916 - protein, 257 aa, synthetic construct
  source 1..257: note = Description of Artificial Sequence: Synthetic polypeptide
QVQLQESGGGLVQPGGSLRLSCTASGLTFDDSVMGWFRQAPGKGREAVSCISSSGANAFYADSVKGRFTISRDNAKNTLYLQMNSLKPEDTATYYCKRGHACAGYYPIPYDDYWGQGTQVTVSSGGSGGSGGSGQVQLQESGGGLVQPGGSLRLSCAASGFTFSSYPMSWVRQAPGKGLEWISTISAGGDTTLYADSVKGRFTSSRDNAKNTLYLQLNSLKTEDAAIYYCAKRIDCNSGYCYRRNYWGQGTQVTVSS

SEQ ID NO: 917 - protein, 257 aa, synthetic construct
  source 1..257: note = Description of Artificial Sequence: Synthetic polypeptide
QVQLQESGGGLVQPGGSLRLSCTASGLTFDDSVMGWFRQAPGKGREAVSCISSSGANAFYADSVKGRFTISRDNAKNTLYLQMNSLKPEDTATYYCKRGHACAGYYPIPYDDYWGQGTQVTVSSGGSGGSGGSGQVQLQESGGGLVQPGGSLRLSCAASGFTFSLSGMSWVRQAPGKGLEWVSAISSGGASTYYTDSVKGRFTISRDNAKNILYLQLNSLKTEDTAMYYCAKGGSGYGDASRMTSPGSQGTQVTVSS

SEQ ID NO: 918 - protein, 254 aa, synthetic construct
  source 1..254: note = Description of Artificial Sequence: Synthetic polypeptide
QVQLQESGGGLVQPGGSLRLSCTASGLTFDDSVMGWFRQAPGKGREAVSCISSSGANAFYADSVKGRFTISRDNAKNTLYLQMNSLKPEDTATYYCKRGHACAGYYPIPYDDYWGQGTQVTVSSGGSGGSGGSGQVQLQESGGGSVQAGGSLRLSCVASGYVSCDYFLPSWYRQAPGKEREFVSIIDGTGSTSYAASVKGRFTASEDKGKNIAYLQMNSLKPEDTAMYYCKASCVRGRAVSEYWGQGTQVTVSS

SEQ ID NO: 919 - protein, 258 aa, synthetic construct
  source 1..258: note = Description of Artificial Sequence: Synthetic polypeptide
QVQLQESGGGLVQPGGSLRLSCTASGLTFDDSVMGWFRQAPGKGREAVSCISSSGANAFYADSVKGRFTISRDNAKNTLYLQMNSLKPEDTATYYCKRGHACAGYYPIPYDDYWGQGTQVTVSSGGSGGSGGSGQVQLQESGGGLVQPGESLRLSCTASGFTFSNYAMSWVRQAPGKGLEWVSGINVAYGITSYADSVKGRFTISRDNTKNTLYLQLNSLKTEDTAIYYCVKHSGTTIPRGFISYTKRGQGTQVTVSS

SEQ ID NO: 920 - protein, 254 aa, synthetic construct
  source 1..254: note = Description of Artificial Sequence: Synthetic polypeptide
QVQLQESGGGLVQPGGSLRLSCTASGLTFDDSVMGWFRQAPGKGREAVSCISSSGANAFYADSVKGRFTISRDNAKNTLYLQMNSLKPEDTATYYCKRGHACAGYYPIPYDDYWGQGTQVTVSSGGSGGSGGSGQVQLQESGGGSVQAGGSLRLSCTASGYVSCDYFLPSWYRQAPGKEREFVSVIDGTGSTSYAASVKGRFTASQDKGKNIAYLQMNSLKPEDTAMYYCKASCVRGRAISEYWGQGTQVTVSS

SEQ ID NO: 921 - protein, 253 aa, synthetic construct
  source 1..253: note = Description of Artificial Sequence: Synthetic polypeptide
QVQLQESGGGLVQPGGSLRLSCTASGLTFDDSVMGWFRQAPGKGREAVSCISSSGANAFYADSVKGRFTISRDNAKNTLYLQMNSLKPEDTATYYCKRGHACAGYYPIPYDDYWGQGTQVTVSSGGSGGSGGSGQVQLQESGGGLVQPGGSLRLSCAASGFSFSSYAMKWVRQAPGKGLEWVSTISSGGSSTNYADSVKGRFTISRDNAKNTLYLQLNSLKIEDTAMYYCAKAIVPTGATMERGQGTQVTVSS

SEQ ID NO: 922 - protein, 257 aa, synthetic construct
  source 1..257: note = Description of Artificial Sequence: Synthetic polypeptide
QVQLQESGGGLVQPGGSLRLSCTASGLTFDDSVMGWFRQAPGKGREAVSCISSSGANAFYADSVKGRFTISRDNAKNTLYLQMNSLKPEDTATYYCKRGHACAGYYPIPYDDYWGQGTQVTVSSGGSGGSGGSGQVQLQESGGGLVQPGGSLRLSCAASGFTFSSYPMSWVRQAPGKGLEWISTISAGGDTTLYADSVKGRFTSSRDNAKNTLYLQLNSLKTEDTAIYYCAKRIDCNSGYCYRRNYWGQGTQVTVSS

SEQ ID NO: 923 - protein, 257 aa, synthetic construct
  source 1..257: note = Description of Artificial Sequence: Synthetic polypeptide
QVQLQESGGGLVQPGGSLRLSCTASGLTFDDSVMGWFRQAPGKGREAVSCISSSGANAFYADSVKGRFTISRDNAKNTLYLQMNSLKPEDTATYYCKRGHACAGYYPIPYDDYWGQGTQVTVSSGGSGGSGGSGQVQLQESGGGSVQVGGSLRLSCAASGFTFSSYPMSWVRQAPGKGLEWISTISAGGDTTLYADSVKGRFTSSRDNAKNTLYLQLNSLKTEDTAIYYCAKRIDCNSGYCYRRNYWGQGTQVTVSS

SEQ ID NO: 924 - protein, 262 aa, synthetic construct
  source 1..262: note = Description of Artificial Sequence: Synthetic polypeptide
QVQLQESGGGLVQPGGSLRLSCTASGLTFDDSVMGWFRQAPGKGREAVSCISSSGANAFYADSVKGRFTISRDNAKNTLYLQMNSLKPEDTATYYCKRGHACAGYYPIPYDDYWGQGTQVTVSSGGSGGSGGSGQVQLQESGGGSVQSGGSLRLSCAASGFTYSTSNSWMAWFRQAPGKEREGVAAIYTVGGSIFYADSVRGRFTISQDATKNMFYLQMNTLKPEDTAMYYCAAASGRLRGKWFWPYEYNYWGQGTQVTVSS

SEQ ID NO: 925 - protein, 263 aa, synthetic construct
  source 1..263: note = Description of Artificial Sequence: Synthetic polypeptide
QVQLQESGGGLVQPGGSLRLSCTASGLTFDDSVMGWFRQAPGKGREAVSCISSSGANAFYADSVKGRFTISRDNAKNTLYLQMNSLKPEDTATYYCKRGHACAGYYPIPYDDYWGQGTQVTVSSGGSGGSGGSGQVQLQESGGGSVQAGGSLRLSCRASGSTYSNYCLGWFRQITGKEREGVAVINWVGGMLYFADSVKGRFTVSQDQAKNTLYLQMNSLKPEDTAMYYCAAESVSSFSCGGWLTRPDRVPYWGQGTQVTVSS

SEQ ID NO: 926 - protein, 263 aa, synthetic construct
  source 1..263: note = Description of Artificial Sequence: Synthetic polypeptide
QVQLQESGGGLVQPGGSLRLSCTASGLTFDDSVMGWFRQAPGKGREAVSCISSSGANAFYADSVKGRFTISRDNAKNTLYLQMNSLKPEDTATYYCKRGHACAGYYPIPYDDYWGQGTQVTVSSGGSGGSGGSGQVQLQESGGGSVQAGGSLRLSCRASGSTYSNYCLGWFRQSTGKEREGVAVINWVGGMLYFADSVKGRFTVSQDHAKNTVTLQMNSLKPEDTAMYYCAAESVSSFSCGGWLTRPGRVPYWGQGTQVTVSS

SEQ ID NO: 927 - protein, 263 aa, synthetic construct
  source 1..263: note = Description of Artificial Sequence: Synthetic polypeptide
QVQLQESGGGLVQPGGSLRLSCTASGLTFDDSVMGWFRQAPGKGREAVSCISSSGANAFYADSVKGRFTISRDNAKNTLYLQMNSLKPEDTATYYCKRGHACAGYYPIPYDDYWGQGTQVTVSSGGSGGSGGSGQVQLQESGGGSVQAGESLRLSCRASGSTYSNYCLGWFRQITGKEREGVAVINWVGGMLYFADSVKGRFTVSQDQAKNTVYLEMNSLKPEDTAMYYCATESVSSFSCGGWLTRPDRVPYWGQGTQVTVSS

SEQ ID NO: 928 - protein, 254 aa, synthetic construct
  source 1..254: note = Description of Artificial Sequence: Synthetic polypeptide
QVQLQESGGGLVQPGGSLRLSCTASGLTFDDSVMGWFRQAPGKGREAVSCISSSGANAFYADSVKGRFTISRDNAKNTLYLQMNSLKPEDTATYYCKRGHACAGYYPIPYDDYWGQGTQVTVSSGGSGGSGGSGQVQLQESGGGSVQAGGSLRLSCVASGYVSCDYFLPSWYRQAPGKEREFVSIIDGTGSTSYAASVKGRFTASQDRGKNIAYLQMNSLKPEDTAMYYCKASCVRGRTISEYWGQGTQVTVSS

SEQ ID NO: 929 - protein, 254 aa, synthetic construct
  source 1..254: note = Description of Artificial Sequence: Synthetic polypeptide
QVQLQESGGGLVQPGGSLRLSCTASGLTFDDSVMGWFRQAPGKGREAVSCISSSGANAFYADSVKGRFTISRDNAKNTLYLQMNSLKPEDTATYYCKRGHACAGYYPIPYDDYWGQGTQVTVSSGGSGGSGGSGQVQLQESGGGSVQAGGSLRLSCVASGYVSCDYFLPSWYRQAPGKEREFVSIIDGTGSTSYAASVKGRFTASQDKGKNIAYLQMNSLKPEDTAMYYCKASCVRGRAISEYWGQGTQVTVSS

SEQ ID NO: 930 - protein, 254 aa, synthetic construct
  source 1..254: note = Description of Artificial Sequence: Synthetic polypeptide
QVQLQESGGGLVQPGGSLRLSCTASGLTFDDSVMGWFRQAPGKGREAVSCISSSGANAFYADSVKGRFTISRDNAKNTLYLQMNSLKPEDTATYYCKRGHACAGYYPIPYDDYWGQGTQVTVSSGGSGGSGGSGQVQLQESGGGSVQAGGSLRLSCVASGYVSCDYFLPSWYRQAPGKEREFVSIIDGTGSTSYAASVKGRFTASQDKGKNIAYLQMNTLKPEDTAMYYCKASCVRGRAISEYWGQGTQVTVSS

SEQ ID NO: 931 - protein, 263 aa, synthetic construct
  source 1..263: note = Description of Artificial Sequence: Synthetic polypeptide
QVQLQESGGGLVQPGGSLRLSCTASGLTFDDSVMGWFRQAPGKGREAVSCISSSGANAFYADSVKGRFTISRDNAKNTLYLQMNSLKPEDTATYYCKRGHACAGYYPIPYDDYWGQGTQVTVSSGGSGGSGGSGQVQLQESGGGSVQAGGSLRLSCRASGSTYSNYCLGWFRQITGKEREGVAVINWVGGMLYFADSVKGRFTVSQDQAKNTVYLQMNSLKPEDTAMYYCAAESASSFSCGGWLTRPDRVPYWGQGTQVTVSS

SEQ ID NO: 932 - protein, 257 aa, synthetic construct
  source 1..257: note = Description of Artificial Sequence: Synthetic polypeptide
QVQLQESGGGLVQPGGSLRLSCTASGLTFDDSVMGWFRQAPGKGREAVSCISSSGANAFYADSVKGRFTISRDNAKNTLYLQMNSLKPEDTATYYCKRGHACAGYYPIPYDDYWGQGTQVTVSSGGSGGSGGSGQVQLQESGGGLVQPGGSLRLSCAASGFTFSLSGMSWVRQAPGKGLEWVSAISSGGASTYYTDSVKGRFTISRDNAKNMLYLQLNSLKTEDTAMYYCAKGGSGYGDASRMTSPGSQGTQVTVSS

SEQ ID NO: 933 - protein, 254 aa, synthetic construct
  source 1..254: note = Description of Artificial Sequence: Synthetic polypeptide
QVQLQESGGGLVQPGGSLRLSCTASGLTFDDSVMGWFRQAPGKGREAVSCISSSGANAFYADSVKGRFTISRDNAKNTLYLQMNSLKPEDTATYYCKRGHACAGYYPIPYDDYWGQGTQVTVSSGGSGGSGGSGQVQLQESGGGSVQAGGSLRLSCVASGYVSCDYFLPSWYRQAPGKEREFVSIIDGTGSTSYAASVKGRFTASQDKGKNIAYLQMNSLKPEDTAMYYCKASCVRGRGISEYWGQGTQVTVSS

SEQ ID NO: 934 - protein, 263 aa, synthetic construct
  source 1..263: note = Description of Artificial Sequence: Synthetic polypeptide
QVQLQESGGGLVQPGGSLRLSCTASGLTFDDSVMGWFRQAPGKGREAVSCISSSGANAFYADSVKGRFTISRDNAKNTLYLQMNSLKPEDTATYYCKRGHACAGYYPIPYDDYWGQGTQVTVSSGGSGGSGGSGQVQLQESGGGSVQAGGSLRLSCRASGSTYSNYCLGWFRQITGKEREGVAVINWVGGMLYFADSVKGRFTVSQDQAKNTVYLQMNSLKPEDTAMYYCAAESVSSFSCGGWLTRPDRVPYWGQGTQVTVSS

SEQ ID NO: 935 - protein, 257 aa, synthetic construct
  source 1..257: note = Description of Artificial Sequence: Synthetic polypeptide
QVQLQESGGGLVQPGGSLRLSCTASGLTFDDSVMGWFRQAPGKGREAVSCISSSGANAFYADSVKGRFTISRDNAKNTLYLQMNSLKPEDTATYYCKRGHACAGYYPIPYDDYWGQGTQVTVSSGGSGGSGGSGQVQLQESGGGLVQPGGSLRLSCAASGFTFSSYPMSWVRQAPGKGLEWVSTISSGGDTTLYADSVKGRFTSSRDNAKNTLYLQLNSLKTEDTAMYYCAKRIDCNSGYCYKRSYWGQGTQVTVSS

SEQ ID NO: 936 - protein, 257 aa, synthetic construct
  source 1..257: note = Description of Artificial Sequence: Synthetic polypeptide
QVQLQESGGGLVQPGGSLRLSCTASGLTFDDSVMGWFRQAPGKGREAVSCISSSGANAFYADSVKGRFTISRDNAKNTLYLQMNSLKPEDTATYYCKRGHACAGYYPIPYDDYWGQGTQVTVSSGGSGGSGGSGQVQLQESGGGLVQPGGSLRLSCAASGFTFSLSSMSWVRQAPGKGLEWVSAISSGGASTYYTDSVKGRFTISRDNAKNMLYLQLNSLKTEDTAMYYCAKGGSGYGDASRMTSPGSQGTQVTVSS

SEQ ID NO: 937 - protein, 263 aa, synthetic construct
  source 1..263: note = Description of Artificial Sequence: Synthetic polypeptide
QVQLQESGGGLVQPGGSLRLSCTASGLTFDDSVMGWFRQAPGKGREAVSCISSSGANAFYADSVKGRFTISRDNAKNTLYLQMNSLKPEDTATYYCKRGHACAGYYPIPYDDYWGQGTQVTVSSGGSGGSGGSGQVQLQESGGGSVQAGGSLRLSCRASGSTYSNYCLGWFRQTTGKEREGVAVINWVGGMLYFADSVKGRFTVSQDQAKNTVYLQMNSLKPEDTAMYYCAAESVSSFSCGGWLTRPDRVPYWGQGTQVTVSS

SEQ ID NO: 938 - protein, 263 aa, synthetic construct
  source 1..263: note = Description of Artificial Sequence: Synthetic polypeptide
QVQLQESGGGLVQPGGSLRLSCTASGLTFDDSVMGWFRQAPGKGREAVSCISSSGANAFYADSVKGRFTISRDNAKNTLYLQMNSLKPEDTATYYCKRGHACAGYYPIPYDDYWGQGTQVTVSSGGSGGSGGSGQVQLQESGGGSVQAGGSLRLSCRASRSPYGNYCLGWFRQSTGKEREGVAVINWVGGMLYFADSVKGRFTVSQDHAKNTVTLQMNSLKPEDTAMYYCAAESVSSFSCGGWLTRPDRVPYWGQGTQVTVSS

SEQ ID NO: 939 - protein, 257 aa, synthetic construct
  source 1..257: note = Description of Artificial Sequence: Synthetic polypeptide
QVQLQESGGGLVQPGGSLRLSCTASGLTFDDSVMGWFRQAPGKGREAVSCISSSGANAFYADSVKGRFTISRDNAKNTLYLQMNSLKPEDTATYYCKRGHACAGYYPIPYDDYWGQGTQVTVSSGGSGGSGGSGQVQLQESGGGLVQPGGSLRLSCAASGFTFSHSGMSWVRQAPGKGLEWVSTINSGGASTYYTDSVKGRFTISRDNAKNMLYLQLNSLKTEDTAMYYCAKGGSGYGDASRMTSPGSQGTQVTVSS

SEQ ID NO: 940 - protein, 9 aa, synthetic construct
  source 1..9: note = Description of Artificial Sequence: Synthetic peptide
FTFSLSGMS

SEQ ID NO: 941 - protein, 9 aa, synthetic construct
  source 1..9: note = Description of Artificial Sequence: Synthetic peptide
SPYGNYCLG

SEQ ID NO: 942 - protein, 9 aa, synthetic construct
  source 1..9: note = Description of Artificial Sequence: Synthetic peptide
FTFSHSGMS

SEQ ID NO: 943 - protein, 14 aa, synthetic construct
  source 1..14: note = Description of Artificial Sequence: Synthetic peptide
AIASGYIDSRWCMA

SEQ ID NO: 944 - protein, 16 aa, synthetic construct
  source 1..16: note = Description of Artificial Sequence: Synthetic peptide
VIDGTGSTSYAASVKG

SEQ ID NO: 945 - protein, 17 aa, synthetic construct
  source 1..17: note = Description of Artificial Sequence: Synthetic peptide
TISSGGDTTLYADSVKG

SEQ ID NO: 946 - protein, 17 aa, synthetic construct
  source 1..17: note = Description of Artificial Sequence: Synthetic peptide
TINSGGASTYYTDSVKG

SEQ ID NO: 947 - protein, 14 aa, synthetic construct
  source 1..14: note = Description of Artificial Sequence: Synthetic peptide
RIDCNSGYCYRRNY

SEQ ID NO: 948 - protein, 11 aa, synthetic construct
  source 1..11: note = Description of Artificial Sequence: Synthetic peptide
SCVRGRAVSEY

SEQ ID NO: 949 - protein, 20 aa, synthetic construct
  source 1..20: note = Description of Artificial Sequence: Synthetic peptide
ESVSSFSCGGWLTRPGRVPY

SEQ ID NO: 950 - protein, 11 aa, synthetic construct
  source 1..11: note = Description of Artificial Sequence: Synthetic peptide
SCVRGRTISEY

SEQ ID NO: 951 - protein, 20 aa, synthetic construct
  source 1..20: note = Description of Artificial Sequence: Synthetic peptide
ESASSFSCGGWLTRPDRVPY

SEQ ID NO: 952 - protein, 11 aa, synthetic construct
  source 1..11: note = Description of Artificial Sequence: Synthetic peptide
SCVRGRGISEY

SEQ ID NO: 953 - protein, 14 aa, synthetic construct
  source 1..14: note = Description of Artificial Sequence: Synthetic peptide
RIDCNSGYCYKRSY

SEQ ID NO: 954 - protein, 11 aa, synthetic construct
  source 1..11: note = Description of Artificial Sequence: Synthetic peptide
VCVVGSRWSDY

SEQ ID NO: 955 - DNA, 768 bp, synthetic construct
  source 1..768: mol_type = other DNA; note = Description of Artificial Sequence: Synthetic polynucleotide
caggttcagctccaggagagcggcgggggctccgtgcaggctggcggatcactgcgtctgtcctgtactgcgagcggcgctatcgcgagcgggtacattgatagcagatggtgtatggcttggttccgtcaggcaccaggcaaggagcgtgagggcgtggcagctatctggcctggagggggtctcaccgtgtacgccgactccgtgaagggccgtttcacaattagtagagaccatgccaagaatacgctctatcttcagatgaataacctgaaacccgaggatacggctatgtactattgtgctgcgggatcaccccggatgtgcccgtctctggagtttggattcgactattggggacaggggacccaggtcaccgtcagttccggtgggggctcccaagtccagctccaggagtccggcgggggcttggtccagcccggaggctccctccgcctgagttgtgctgccagcggattcactttttccagttaccctatgtcctgggtgagacaggcccctgggaagggcctggagtggatctctaccatcagcgcgggcggggataccactctgtatgccgactcagtgaagggcaggttcacgtcttcccgcgataacgctaagaatactctctatctgcaactcaattccctgaagacagaggacgcagctatctactattgtgctaagcgtattgattgcaacagcggatactgctaccgtaggaactattggggccagggcacccaggtgactgtgtcctcc

SEQ ID NO: 956 - DNA, 786 bp, synthetic construct
  source 1..786: mol_type = other DNA; note = Description of Artificial Sequence: Synthetic polynucleotide
caggtacagctccaggagtctggtggaggctctgtgcaagcagggggtagcctgaggctgtcatgcacagcctccggtgccatcgccagcggttacattgacagcaggtggtgtatggcttggttcaggcaggcccccggcaaagaacgtgaaggcgtggccgctatctggcccggcggtggactgactgtctatgccgatagtgtgaaaggcagattcaccatctctcgggatcacgcgaagaatacactgtaccttcagatgaataacctgaagcctgaggacaccgccatgtactattgcgctgcgggctctccgaggatgtgccccagcctggagttcgggttcgattattggggtcagggcacccaagtgactgtgagcagtgggggatctggcgggtccggtggctctggtcaggtgcagctgcaagagtctggagggggcctcgtacaacctggaggtagtctgcgcctcagttgtgctgcatctggcttcaccttcagctcctatcccatgtcttgggttcggcaggctcccggcaaggggctggagtggatctccaccatcagcgcgggcggggacacaactctgtacgccgattctgtgaaggggcgtttcacaagctcaagagataacgcaaaaaacacgctctacctccagcttaattcattgaagaccgaagacgcagctatttattactgcgctaagcgcatcgactgtaactccggctactgctatagaaggaattactggggccagggaacacaggttaccgtgagttca

SEQ ID NO: 957 - DNA, 768 bp, synthetic construct
  source 1..768: mol_type = other DNA; note = Description of Artificial Sequence: Synthetic polynucleotide
caggtgcagctccaggagtccggtggcggaagcgtccaggctggcggaagtctgaggctctcatgcaccgcctctggtgccatcgccagcggatacatcgactccagatggtgtatggcttggtttaggcaagcccctggcaaggaaagggagggggttgctgccatctggcccggcggaggcctgacggtgtatgcagacagcgtcaaagggagattcaccatttctcgcgaccacgctaagaacaccctttacttgcagatgaataacctcaagcccgaggacaccgccatgtattactgcgccgctggttcaccgaggatgtgcccgagcctggagttcggcttcgactactggggccaaggtacacaagtgactgtgtccagcggcgggggtagccaggttcagctgcaagagagcggcggtggattggtgcagccaggcggtagcctgcgcctgtcttgcgcggccagcggattcacattctccctgagcggcatgtcttgggtgcgccaagctccgggcaaaggcctggagtgggtcagcgccatctctagcggaggtgcctctacgtattacacagattccgttaagggccgcttcactatcagccgcgataacgccaagaacatcctgtatctccagttgaacagcctgaaaacggaggacacagccatgtactattgcgctaaagggggttcaggctatggtgacgcttctcgcatgacctcacccggctcacagggaacccaggtgacagtgtcaagt

SEQ ID NO: 958 - DNA, 786 bp, synthetic construct
  source 1..786: mol_type = other DNA; note = Description of Artificial Sequence: Synthetic polynucleotide
caggtgcagctgcaagagtccggcggaggtagcgttcaagccggaggctcactgagactgtcttgcaccgcctctggtgcaatcgcctctggctatattgattctcgctggtgtatggcgtggtttaggcaagcgcctgggaaagagcgtgaaggagttgcagccatctggccgggaggcggactgaccgtgtacgctgactctgtgaagggcagattcaccatcagtcgtgaccacgccaagaacactctgtaccttcagatgaataacctcaaaccagaggacacagctatgtactattgtgcggctggatctccgcgcatgtgccctagtctggagttcggttttgattactggggccagggaactcaagtgaccgtgtctagcggcggttctggaggcagtggtgggtcaggtcaggttcagctccaagagtcaggtgggggactcgtgcaaccagggggctccctgcgcctgtcttgcgctgcctccggcttcactttcagcctgagcggtatgtcctgggttcgccaggctcctggtaaagggctggagtgggttagtgctatcagctccggcggagcttctacctattacaccgactctgttaagggtcgcttcactatcagccgcgacaacgccaaaaatattttgtatctgcaactcaactccttgaagacagaggacaccgcgatgtattactgcgccaagggaggtagcggctacggcgatgctagtcgtatgacgagccccggctctcagggtacacaagtcaccgtaagctcc

SEQ ID NO: 959 - DNA, 759 bp, synthetic construct
  source 1..759: mol_type = other DNA; note = Description of Artificial Sequence: Synthetic polynucleotide
caggttcagttgcaggagtctggcggagggagcgttcaggctggcggttccctgaggctctcttgcacagcctctggcgctatcgcctcaggatatattgattcccgttggtgtatggcatggttccgtcaggcccctggcaaggaacgcgagggagtcgctgccatctggcccggcgggggcctgacagtctacgctgattcagttaagggccgcttcactatcagccgcgaccacgctaaaaacacgctgtacctgcaaatgaataacctcaaaccagaggacactgcaatgtattactgcgccgcaggctctcccagaatgtgcccgagcctggagtttggtttcgattactggggtcagggcacgcaggtaaccgtgagttctggtggaggctcccaggtgcagctccaagagtccgggggaggctctgtgcaagcaggcggaagcctgagattgtcctgcgtggccagcggttatgtgtcctgtgattacttcctgccttcttggtatcggcaggccccaggcaaggagcgcgagttcgtctccatcattgatggcaccggatcaacaagctacgctgcgtccgtgaagggtcggtttacagcaagcgaggataagggaaagaacatcgcgtacctccagatgaacagcctgaagcctgaagacactgctatgtattactgtaaggctagttgtgtgcggggccgcgcagtttctgaatattggggtcagggaacacaagtaaccgtgtcttca

SEQ ID NO: 960 - DNA, 777 bp, synthetic construct
  source 1..777: mol_type = other DNA; note = Description of Artificial Sequence: Synthetic polynucleotide
caggtccagctccaggaatcaggaggtggctccgtacaggccggagggagtctccgcctctcctgtactgccagtggtgccatcgcaagcggctatatcgacagccgttggtgcatggcctggttcaggcaggcacccggcaaagagagagaaggagtcgctgcgatctggccgggtggaggtttgaccgtctacgccgacagcgtcaagggcagatttactatcagccgtgaccacgcgaagaacaccctctatcttcagatgaataacctcaaacctgaggataccgccatgtattactgcgcagccgggagccctcggatgtgccctagcctggagttcggcttcgactactggggccaagggacacaggtaacagttagtagcggtggctccggtggctccgggggttctggtcaggtccagctccaggagtctggaggcggttcagtgcaggctggcggttcactgcgcctcagctgcgtggcctccggctacgtatcatgcgactatttcctgccctcctggtatcgccaggcccccggaaaagagagggagtttgtgtctattatcgacgggaccggaagcaccagctacgctgcctcagtgaagggtcgcttcaccgcctccgaggataagggcaagaacattgcctacttgcagatgaactcattgaaaccggaagacactgcgatgtattactgtaaggcttcttgcgttcgcggacgtgctgtgagcgagtactggggccaagggacccaagtgacggtctcttct

SEQ ID NO: 961 - DNA, 771 bp, synthetic construct
  source 1..771: mol_type = other DNA; note = Description of Artificial Sequence: Synthetic polynucleotide
caggtgcaacttcaggagtctggcggtggcagcgtgcaggccgggggctccctgcggctgtcatgtacggcctccggcgctattgccagcggttacattgactccaggtggtgcatggcctggttccgtcaggctccgggcaaggagagggaaggcgtggcagccatctggcccggcgggggcctcaccgtttatgccgattccgtgaagggacgttttacaatcagccgtgaccatgctaagaacaccctgtatttgcagatgaataacctgaaacccgaggacaccgccatgtattactgcgccgcaggcagcccccgtatgtgcccgtccctggagtttggcttcgattactggggccaggggacccaggtgacagtcagctccgggggtggctctcaggtgcaacttcaggaatccggtggaggtctggtgcagccgggagagtctctgcgtctgtcatgcactgcctcaggcttcacgtttagtaactatgctatgtcctgggtgaggcaagctcctggaaagggcctcgaatgggtgtcaggaatcaacgtggcctacggcattacttcttatgccgattctgttaagggtcgcttcactatctcaagagacaacactaaaaacactctttacttgcagctgaacagcctgaaaacagaggacacagccatttattactgcgtgaagcactctggcacaaccatcccacgcggtttcatttcatacacgaagcgcggccaggggacccaggtgactgtgagcagc

SEQ ID NO: 962 - DNA, 789 bp, synthetic construct
  source 1..789: mol_type = other DNA; note = Description of Artificial Sequence: Synthetic polynucleotide
caggtccaacttcaggaatctggaggtggctcagtacaggctggaggctccctgagactgagctgcaccgcctcaggagcaatcgcatccggctatatcgactcccgttggtgtatggcctggtttcgccaggcccccggcaaggagcgtgagggcgtggccgctatctggccaggcgggggcctgaccgtgtacgctgacagtgttaaaggaaggttcacaatttcccgcgatcacgctaagaatacattgtatcttcagatgaataacctcaagccagaggacaccgccatgtattactgcgcagccggttcaccccgcatgtgccccagcctggagttcggcttcgactactggggacagggcacccaggttaccgtgtcttccggcggttctggcggatctggtggctccgggcaggtgcagctccaggaatctggtgggggcctggttcagccgggtgaaagcctgaggctgtcttgcaccgcctctggtttcaccttcagcaactatgcgatgtcttgggtgcggcaagcaccgggtaagggcctggagtgggtgagcggcatcaacgtggcctacggtattacaagctacgccgattccgttaaaggtcgtttcaccatctctagggacaacacaaagaacacactgtacttgcagctgaactctctgaagaccgaagataccgccatctattactgtgtgaagcattccggcacaaccatccctcgcggcttcatctcctataccaagcgcggccagggcacccaggtcacggtttcctcc

SEQ ID NO: 963 - DNA, 759 bp, synthetic construct
  source 1..759: mol_type = other DNA; note = Description of Artificial Sequence: Synthetic polynucleotide
caggtgcagctgcaagagtccggtggcgggtccgtccaggccgggggctctctgcgtcttagctgcaccgcttctggggccattgcttctggctacattgattccagatggtgtatggcctggttccgccaagcgcccggcaaggagcgcgagggcgtggccgctatctggcccggtggaggccttaccgtctatgctgacagcgtgaaaggacgcttcaccatctcccgcgaccacgccaaaaacaccctgtacttgcagatgaacaatttgaagcccgaggacacggccatgtattactgcgccgctggtagcccccgcatgtgtccgtccctggagttcggtttcgactactgggggcagggcacccaggtgacagtcagctctggagggggctcccaggtgcagctccaggagagcggcggaggcagcgtgcaggccgggggaagcctcaggctgagctgcaccgcgagcggctacgtttcctgtgattattttctcccatcatggtatcgccaagcgccaggaaaggagcgtgagttcgtatccgtgattgacggtacaggttcaacatcctatgcggcctctgtgaaggggcgcttcaccgcgagccaagataaggggaagaacatcgcctatttgcagatgaactcactgaagcctgaggacaccgctatgtattactgcaaggcttcctgtgtgcgtggccgcgccatctctgagtactgggggcagggcacccaggtgaccgtgtcctcc

SEQ ID NO: 964 - DNA, 777 bp, synthetic construct
  source 1..777: mol_type = other DNA; note = Description of Artificial Sequence: Synthetic polynucleotide
caggtgcagctgcaagaatctggaggcggtagcgtacaggcaggtggcagcctgaggctgtcttgtactgcgtccggcgctatcgcatcaggatacattgactcacgttggtgcatggcctggtttcgtcaggctccaggaaaggagcgtgaaggcgtcgctgccatttggcctggtggaggcctgaccgtgtatgccgatagcgtcaagggacgtttcaccatcagccgtgaccacgctaagaataccctgtacttgcaaatgaacaatttgaagccagaggacactgcgatgtactattgcgcggcaggctcccccaggatgtgtcccagcctggagtttggtttcgattactgggggcagggcacccaggtcaccgttagctccgggggttctggaggttccggcggttcaggacaggtgcagcttcaggagtctgggggagggtccgtacaagccgggggctccttgcgcctgtcttgcacagcttccggctatgttagttgtgactacttcctgcctagctggtatcgccaagcccctggcaaggagagggagttcgtttccgtgattgatggcactgggtctacttcctacgctgccagtgtgaaggggcgcttcaccgcttctcaagacaagggcaagaacatcgcgtacctccagatgaacagcctgaagccagaagataccgcaatgtactattgtaaggcctcctgcgttcgcgggcgggccatctcagaatactggggccaggggactcaggtcaccgtgtccagt

SEQ ID NO: 965 - DNA, 756 bp, synthetic construct
  source 1..756: mol_type = other DNA; note = Description of Artificial Sequence: Synthetic polynucleotide
caggtgcagttgcaggaatctggcggaggctccgtccaggctggtggcagtttgcgtctgtcctgcacagcttcaggcgcgattgcctctggctacattgatagtagatggtgcatggcttggttcagacaggctcctggaaaggagagagagggggtggccgcgatctggcccggaggcgggctgactgtctacgccgatagcgttaagggtcgcttcacgatttctcgggatcacgccaagaacaccctgtacttgcaaatgaataacctgaaacccgaagacaccgcaatgtattactgcgccgctggttcaccaaggatgtgcccttccctggagttcggtttcgactactggggacagggcacccaggtaaccgtgagtagcggcgggggtagtcaggtgcagcttcaggagtcaggcgggggcttggtccaacctggagggagcctcaggctctcctgtgccgcttccggcttcagtttcagctcctatgccatgaagtgggtaagacaggcccctggcaagggcctggagtgggtttccaccattagtagcggaggcagctcaaccaactacgccgattccgttaagggccgctttacgatcagccgtgacaatgcaaagaacaccttgtacctccagctgaactccctgaaaattgaagacaccgcaatgtattactgcgccaaggcaatcgtccctacaggggccacaatggagcgcggtcagggaactcaggtgaccgtgtccagc

SEQ ID NO: 966 - DNA, 774 bp, synthetic construct
  source 1..774: mol_type = other DNA; note = Description of Artificial Sequence: Synthetic polynucleotide
caggttcagctccaggaatctggagggggaagtgtgcaggctggaggttccctccgcctcagctgcactgccagcggagctatcgcttccggttacattgacagccgctggtgtatggcttggtttcgccaagcgcccggcaaggaacgcgaaggggtggcggccatctggcctgggggaggcctgacagtgtacgccgacagcgtcaagggtaggtttactatcagcagagaccacgcaaagaacaccctgtatctgcaaatgaacaatctgaagccggaagacactgcaatgtattactgtgctgcgggctcccccaggatgtgtcccagcctggagttcgggtttgactactggggtcaggggacgcaggtgaccgtcagctccggcggttccgggggcagcggaggcagcggacaggtccagcttcaggagtccggtgggggcctggtccagcctgggggctctctgcggctgagctgtgcggccagcgggtttagtttctccagttacgctatgaaatgggtgcgtcaggcaccgggtaagggactcgaatgggtcagcacaatcagtagcggaggcagctccacgaactatgctgatagcgtgaagggaagattcaccattagccgcgacaacgccaagaatacattgtatcttcagctgaacagcctgaagatcgaagacaccgcgatgtattactgtgctaaggccatcgtgcccactggggccacaatggagaggggccagggcacccaggtcacggtatccagc

SEQ ID NO: 967 - DNA, 768 bp, synthetic construct
  source 1..768: mol_type = other DNA; note = Description of Artificial Sequence: Synthetic polynucleotide
caggtccagttgcaggaaagcggaggcggatctgtgcaggcaggtggctcccttcgcctgagctgcaccgcaagcggggccattgcgtctggatacatcgactccagatggtgcatggcctggttccgccaagcgccaggcaaagagcgcgaaggagtggcagccatctggcctggagggggcctcacagtttacgctgactccgttaagggcagattcaccatctcccgcgaccacgccaagaacacactctacctccagatgaataacctgaagcccgaggataccgccatgtattactgcgcagctggaagcccacgtatgtgcccgtccttggagttcggcttcgactactgggggcaaggaacccaggtgaccgtttccagcgggggcggatctcaggtccagttgcaagagtccgggggcgggctggtgcagcctgggggctctctgcgcctgtcctgcgcagcgagcggcttcaccttctcatcctatcctatgtcttgggtgcgtcaggccccaggtaagggactggagtggatttccacgatcagtgccggtggcgatactaccctctacgccgactctgtgaaaggacggttcaccagtagccgtgacaacgcgaagaacacattgtatttgcagctgaacagcctcaagaccgaagataccgccatctattactgcgccaagagaattgattgtaactctggatactgctaccgtcgcaactactggggacagggcacccaggtcaccgtcagttcc

SEQ ID NO: 968 - DNA, 786 bp, synthetic construct
  source 1..786: mol_type = other DNA; note = Description of Artificial Sequence: Synthetic polynucleotide
caggtgcagttgcaggaatccgggggaggcagtgttcaggctggcggaagcctgcgcctttcctgcacagccagcggggctattgcctccggctacattgatagtcgttggtgcatggcctggttccgccaagcaccgggtaaggagagggaaggcgtcgccgcaatctggccgggagggggtctgaccgtgtatgctgacagcgtgaagggcagattcaccatctctagggaccacgccaagaacaccctctatttgcagatgaacaatctcaaacccgaggataccgcgatgtattactgcgctgcgggtagcccacgtatgtgtccatctctggagttcggcttcgattattggggtcagggcactcaggtgaccgtcagctccgggggctccggcggttctggtgggtcaggccaggtgcagctccaggagtccggcggtggcctggtgcagcccggtgggtcccttcgtctgagctgtgcagccagcggatttacatttagctcctaccccatgtcctgggtaagacaggcccccggaaagggcctggaatggatttccaccatctctgccggtggagacaccacactgtatgctgactctgtgaagggaagattcacttcctctcgggacaacgccaagaacaccctgtacttgcagttgaacagcctgaagacagaggataccgccatttattactgtgccaagaggattgattgtaacagcggatactgttatcgcaggaactattggggacagggaactcaggtgaccgtctcttca

SEQ ID NO: 969 - DNA, 768 bp, synthetic construct
  source 1..768: mol_type = other DNA; note = Description of Artificial Sequence: Synthetic polynucleotide
caggtccagcttcaggagtccggcggaggctctgtgcaggcaggcggttcactgcgcctgtcatgcacggcgagcggagccatcgccagcggttacattgattcccgttggtgcatggcgtggttccgtcaggcacccggcaaggaacgcgagggcgtggctgccatctggcctgggggcgggcttacagtgtacgccgattccgtgaaaggtcgcttcaccatctcccgcgaccacgccaagaatactctttacctgcaaatgaataacttgaagccggaggacaccgctatgtattactgtgccgctggcagccctcgcatgtgtccctctctggagttcggctttgattactggggccagggcacccaggtgaccgtatctagcggtggaggctcccaagtgcagctgcaagaatctggaggcgggagcgtccaggtgggaggctccctgcgcctgagctgcgccgcttccggctttacctttagtagctaccccatgtcctgggtccgccaggcacccggcaaaggccttgagtggatctccacgatcagcgcagggggtgacaccactctgtacgccgacagcgttaaaggcaggttcaccagctcccgcgacaacgcgaaaaacaccctgtacttgcagctcaactcactcaagacggaggacactgctatctattactgcgccaagcgcattgattgtaacagcggttactgttaccggcgtaactactggggtcagggcactcaggtcaccgtctcctct

SEQ ID NO: 970 - DNA, 786 bp, synthetic construct
  source 1..786: mol_type = other DNA; note = Description of Artificial Sequence: Synthetic polynucleotide
caagtgcagctccaggaatccggtggaggcagcgtgcaggccggaggttccctgcgcctgtcttgcactgcctcaggagccattgcctccggttacattgattcccgttggtgcatggcctggtttcgccaggccccaggaaaagagcgcgagggggtggccgctatctggcccggcggtggcctgactgtgtacgctgattccgtaaagggccggtttaccatctccagggatcatgcaaaaaacacactctacctccagatgaataacctgaagcctgaggacaccgccatgtattactgcgccgctggctcacctcgtatgtgtcccagcctcgaatttggctttgactattggggccagggcacccaggttaccgtctcttccggtggctcaggaggttccgggggctctggtcaggtgcagttgcaggaaagtggaggtggcagtgtgcaggtagggggcagcctgcgtctgagctgtgctgccagcggctttacattcagctcctatcctatgagctgggtgagacaggcccctgggaaaggcctggagtggatcagcactatcagcgccggtggcgatacgactctctatgccgatagcgtcaagggccgcttcacgtcctcaagggacaatgctaaaaacaccttgtatctccagttgaacagtctcaagacggaggacaccgctatctactattgtgccaagagaattgattgcaacagcggctactgttacagacgtaattattgggggcagggcacccaggtaactgtgtcctca

SEQ ID NO: 971 - DNA, 783 bp, synthetic construct
  source 1..783: mol_type = other DNA; note = Description of Artificial Sequence: Synthetic polynucleotide
caggtgcagttgcaggagtcaggcggtggctccgtgcaggcaggcggaagcctgcgcctgtcttgcactgcctctggggctattgcatcagggtacattgatagccgctggtgtatggcgtggtttaggcaggctccaggaaaggaaagagagggagtggccgcgatctggcccggtggaggtctgacggtgtatgctgattcagtgaagggccggttcactatttctcgcgaccatgccaagaacaccctctaccttcagatgaataacctgaaacccgaggacaccgctatgtattactgcgctgcgggttctccccgcatgtgtcctagtcttgagttcggatttgactattggggccagggcacccaagtgacggtcagctccggcgggggtagtcaggtccaactgcaagaatccgggggcggtagcgtgcagtccggtggctccctgagactcagctgcgccgcttccgggtttacctactccacttccaactcttggatggcgtggttccgtcaggccccaggaaaggagagggagggcgtggccgctatctatacggtgggtggctccatcttctacgccgattctgtacgcggaagattcacaatctctcaggacgcaacaaaaaatatgttttacttgcagatgaacactctgaagcctgaagacactgcgatgtactattgtgcggctgcgagcggcagactgcgcggtaagtggttctggccctacgagtacaactactgggggcagggcactcaggtcacagtctctagc

SEQ ID NO: 972 - DNA, 801 bp, synthetic construct
  source 1..801: mol_type = other DNA; note = Description of Artificial Sequence: Synthetic polynucleotide
caggtgcagttgcaggaatctggcggtggcagtgtccaggccggtggctccctcaggctgtcctgcactgccagcggagccatcgcttcaggctacattgactctaggtggtgcatggcttggtttcgccaggctccgggcaaagagcgcgagggcgtcgcagccatctggccaggtgggggtttgacggtctatgctgattccgtgaaggggcggttcactatctcccgtgaccacgccaagaacaccctgtacctccagatgaataacctgaagcctgaggatacagcgatgtactattgcgctgccggtagcccgcgcatgtgccccagtcttgagttcggctttgactattggggccagggcacgcaagtgaccgtgtcctctgggggcagtggcggttctggtggctcaggtcaggtccagctccaggaaagcgggggtgggtccgtccaatctggtggctccttgcgtctgagctgcgctgcctctggcttcacttattcaacgtccaactcttggatggcctggtttcgccaagcgccaggcaaggagcgtgaaggcgtcgctgccatctataccgttggtggcagcattttctacgctgactcagtgaggggcagatttaccatttctcaggatgcaaccaagaatatgttttacttgcagatgaacacactgaagcccgaggacacagctatgtactattgtgcagccgcttctggccgtcttcgcggcaagtggttctggccctacgagtacaattattggggccagggtacgcaggtgaccgtgtccagt

SEQ ID NO: 973 - DNA, 786 bp, synthetic construct
  source 1..786: mol_type = other DNA; note = Description of Artificial Sequence: Synthetic polynucleotide
caagttcagttgcaggagtccggtggcggtagtgtgcaggcgggcggaagcctgcgcctgtcttgtaccgcctctggggccattgcctctggctacattgattctcgctggtgtatggcctggtttaggcaggcaccaggcaaggaacgcgaaggcgtggccgctatctggcctgggggcggactgaccgtgtacgctgactcagtcaaaggccgcttcactatctcacgcgaccacgccaagaatactctgtacctccagatgaataacctgaagcctgaggacaccgcgatgtattactgcgctgccggttccccaagaatgtgcccttcacttgagtttggctttgactattggggccaaggaactcaggtgaccgtaagctctggagggggcagccaggtccagctccaggagtctggagggggctccgtgcaggccggagggtctctccgcctcagctgtcgtgcctcaggctccacgtactctaactactgcctggggtggttccgccagatcacaggtaaagagcgcgaaggcgtagctgtcatcaactgggtcgggggaatgctgtacttcgccgactccgttaagggtcggttcaccgtctctcaggatcaggccaaaaataccctgtatctccagatgaacagcctgaagccggaggacaccgctatgtattactgtgccgcagagagcgtgtcctctttctcctgcggcggttggctgacccgcccggacagagtaccctactggggtcaggggactcaggtgacagtgagcagc

SEQ ID NO: 974 - DNA, 804 bp, synthetic construct
  source 1..804: mol_type = other DNA; note = Description of Artificial Sequence: Synthetic polynucleotide
caggtgcaactgcaagagtccggcggaggctctgtgcaagccggaggctctctgcgcctgtcctgtaccgctagtggagccatcgccagcggttacattgacagcagatggtgtatggcctggttccgccaggcccccggcaaagagcgcgagggcgtcgctgcaatctggcctggcgggggccttaccgtatatgccgattcagtcaaaggccgcttcacaatctcacgcgaccacgccaagaacaccctgtacttgcagatgaataacctgaagccggaggacaccgcaatgtattactgcgcagccgggtctccgcgcatgtgtcccagcttggagttcggattcgactactggggccaagggacccaggtgacggttagctctggcggttccggcgggagtgggggctctggccaggtgcagctgcaagagtctgggggaggttctgtccaggcgggaggctccctgaggctgagttgtcgtgcaagcggttctacctactccaactattgcctgggttggtttcgtcagattacggggaaggaacgcgagggggtcgccgtcataaattgggttggcggtatgctttattttgccgactctgtcaaaggtcggttcaccgtgtctcaagaccaggctaagaacactctgtacctccagatgaactccctgaaaccagaggacaccgcaatgtattactgcgctgccgaaagcgtgtccagcttcagctgtggcggttggctcacccgccctgaccgtgtgccctattggggtcaggggacacaggtgaccgtcagcagc

SEQ ID NO: 975 - DNA, 786 bp, synthetic construct
  source 1..786: mol_type = other DNA; note = Description of Artificial Sequence: Synthetic polynucleotide
caggtgcagttgcaggaaagcggagggggctccgtgcaagccggagggtctctgcgtctttcttgcactgcctctggggccatcgcttccggctacattgatagccgttggtgcatggcctggttccgtcaagcgcctggaaaggagcgcgagggcgtggccgctatttggcctggtggaggcctcactgtgtatgctgatagtgtgaagggacgtttcacaatctcccgtgaccacgcgaagaacacgctgtacctccagatgaacaatctcaaacccgaggatacagctatgtattactgtgccgctggtagtccacgcatgtgtcccagtctggagttcgggtttgattattggggacaaggcacgcaggttacagtgtcttccgggggtggctcccaagttcagcttcaagagagcggcggaggctccgtgcaggcgggtggctcactgagactgtcctgccgtgcctccgggtccacttatagtaactattgtctgggttggttccgtcaaagtactggtaaagagcgcgagggcgtggcagtaatcaactgggtcggcggaatgctgtacttcgcggattctgtgaagggaagattcactgtgtcacaggaccacgccaaaaataccgtgacccttcagatgaatagcctgaagcctgaggacacggcaatgtattactgtgccgctgaatccgtgtctagctttagctgcggaggttggctgacacgtcctggtagagtgccatattggggccaaggcactcaagtgactgtatcttcc

SEQ ID NO: 976 - DNA, 804 bp, synthetic construct
  source 1..804: mol_type = other DNA; note = Description of Artificial Sequence: Synthetic polynucleotide
caggttcagcttcaggaatccggtggaggcagtgtgcaggccggtggaagcctccgcctctcttgcacagcctccggggccatcgcatctggctatattgacagccgctggtgtatggcttggttccgccaagcgcccggtaaggagcgcgaaggggtcgctgccatttggcctggtgggggattgactgtgtatgcagatagcgtgaaaggtcgtttcactatcagccgtgaccacgccaagaacaccctgtatctgcaaatgaacaatctgaagcctgaggacaccgccatgtattactgtgcggcaggcagccctcgcatgtgcccgtccctggagttcggtttcgactactggggccagggcacacaggtgactgttagctccggcggttctggaggttctgggggctctggccaggtacagctccaggagagcggagggggctccgttcaagcaggtggctctttgcgtttgagctgccgtgccagcgggtctacctactccaattactgtctgggatggttccgccaatccaccggcaaagaacgtgagggtgtggccgttatcaactgggttgggggaatgctttactttgcggacagtgtgaaagggcgcttcaccgtgtcccaggatcatgctaagaacactgtgaccctccagatgaacagcctgaagcccgaggatacggcaatgtattactgcgccgctgaatcagtaagctccttctcatgtggcggatggctgacccgccctggccgcgtgccctattggggacagggcacccaggtgacagtcagcagc

SEQ ID NO: 977 - DNA, 786 bp, synthetic construct
  source 1..786: mol_type = other DNA; note = Description of Artificial Sequence: Synthetic polynucleotide
caggtgcagttgcaggaatccggtggcggaagtgtgcaggccgggggctccctccgtctgtcctgcaccgcgtcaggcgctatcgcctccgggtacatcgactcccgctggtgcatggcctggtttcgtcaagcgcccggcaaggagagagaaggtgtggccgcgatttggccgggcggaggcctgaccgtgtacgctgactccgttaaggggcgttttactatctcccgtgaccacgccaagaatacattgtatctgcaaatgaataacctcaagcccgaggacactgctatgtactattgtgctgccggttccccgcgcatgtgtccgagcctggagtttggcttcgactattggggtcaaggcactcaggtcaccgtctcctcaggcggagggagccaagtgcagctccaggaaagcggaggtggctccgtgcaggctggagagagcctgaggctgtcatgccgcgccagcgggtctacctactctaactactgtctgggctggtttaggcagattaccggcaaagagagagagggggtcgctgttatcaactgggtgggagggatgttgtacttcgccgacagcgtcaagggtagatttaccgtctctcaggaccaggctaagaacacagtatatctggagatgaactctcttaaacccgaggacactgctatgtactattgtgccaccgagtccgtgtcttccttctcctgcgggggctggctgactagacctgatcgggtgccctactggggtcagggtacacaggtgacagtctctagc

SEQ ID NO: 978 - DNA, 804 bp, synthetic construct
  source 1..804: mol_type = other DNA; note = Description of Artificial Sequence: Synthetic polynucleotide
caagttcagcttcaggaaagtggcggtggctccgtacaggccgggggcagtctgcgcctgagctgcaccgccagcggtgccatcgccagcggctacatcgactccaggtggtgtatggcttggttccgccaagcaccgggcaaggagcgcgaaggagttgccgctatctggcccggcgggggcctgaccgtctacgccgacagcgtgaaaggtcgcttcactatctctcgcgaccacgccaagaacaccttgtacctccaaatgaataacctgaagccagaggacactgctatgtattactgcgctgccggaagtccccgtatgtgtccctctctggagtttgggtttgattattgggggcagggcacacaggtcactgtgtcaagcgggggtagtggcggttccggcggtagcggccaggtgcagcttcaagagagcgggggcggaagcgtgcaggcgggcgaatctctccggttgtcatgtagagcgtctggctccacctactctaactactgcctggggtggttcagacagattacggggaaagagagggaaggcgtggccgttataaattgggtaggcggaatgctctacttcgctgactctgtcaagggccggttcacagtgtctcaggaccaggccaaaaatactgtgtatctggagatgaactctctgaaacccgaggacactgccatgtattactgcgccacggagagcgtctccagcttctcatgtggagggtggctgacccgcccggaccgtgtaccctactggggtcagggaacacaggtgacagtgagcagc

SEQ ID NO: 979 - DNA, 759 bp, synthetic construct
  source 1..759: mol_type = other DNA; note = Description of Artificial Sequence: Synthetic polynucleotide
caggtgcagttgcaggagagcggaggcgggagcgtccaggccggaggctcccttcgcctcagctgtaccgcgtctggagcaatcgccagcggctacattgactcccgttggtgcatggcatggttccgccaagcgccaggcaaagagagagaaggcgtggccgctatttggcctgggggtggactcacagtttatgcagactctgtgaagggccgctttaccatcagtagagaccacgccaagaacaccctgtatctgcaaatgaacaatctgaagccagaggacaccgcgatgtactattgcgctgccggttctcccaggatgtgtccctcattggagttcggctttgattactggggccagggaacccaggtcaccgtatcttccggtggcggatcacaggttcagctccaggaatcaggaggtggctctgtgcaggccgggggctccctgcggctgtcttgcgtggcctccggctacgtctcttgcgactactttctgccttcttggtatcggcaggcccctgggaaagagcgggagttcgtctctatcattgacggcaccggctccacatcctacgctgcgagcgtgaagggccgcttcacagcatcccaggacaggggaaagaacatcgcttatttgcagatgaacagcctgaagcctgaggacacagctatgtattactgtaaggcctcttgtgtgcgcggcagaaccatcagcgagtactggggacaagggacccaggtgaccgtatcttca

SEQ ID NO: 980 - DNA, 777 bp, synthetic construct
  source 1..777: mol_type = other DNA; note = Description of Artificial Sequence: Synthetic polynucleotide
caggtgcagttgcaggagtccggcgggggctctgtccaagctggaggctccttgcgtttgagctgtaccgctagtggagccatcgcgagtggctacatcgacagcagatggtgcatggcctggttccgccaagctcccggcaaggagagggaaggcgttgctgcaatctggcccggcggtggcctgaccgtgtacgcggattctgtcaaggggcgctttactatcagccgcgatcatgctaaaaacacgctttatctgcaaatgaataacctcaaaccagaagataccgcgatgtactattgcgcagctggttctccccggatgtgtcccagtttggagtttggtttcgattactggggtcagggcactcaggtgaccgtgagttccggcggatctggaggctcaggaggctccggccaggtgcagctccaggagtccggcggtggcagcgtacaagctggcgggtccctccgtctgagctgtgtggcaagcggttatgttagctgtgactactttctgccaagctggtatcgccaagcgccaggcaaggagcgcgagttcgtgagtatcattgatggcaccggcagcacctcctacgcagccagcgtgaagggacggtttaccgcctcccaggatagaggaaagaacatcgcatacctccagatgaacagcctgaagccggaggacacagccatgtattactgcaaggcctcttgcgtgaggggccgcaccatcagcgagtactgggggcagggcactcaggtaactgtcagctca

SEQ ID NO: 981 - DNA, 759 bp, synthetic construct
  source 1..759: mol_type = other DNA; note = Description of Artificial Sequence: Synthetic polynucleotide
caggtgcagcttcaggagagcggtggaggctctgtccaagctggcggttccctgagactttcctgcaccgcctccggggccatcgcttccggctacattgatagcagatggtgtatggcatggttcaggcaggcccctggtaaagagcgcgagggcgttgccgcaatctggcctggcggaggcctgaccgtgtacgccgactccgtgaagggccgtttcaccatctctcgtgaccacgccaagaatactctgtatcttcagatgaataacttgaaacctgaagacacagctatgtattactgcgcagccggaagcccacgcatgtgcccatccctggagtttggcttcgattattggggccaaggcacccaagtgacagtcagcagtggaggcggttcccaggttcagttgcaagagtccggtggcggaagcgtgcaggcaggcggtagcttgcgcttgtcctgtgtggcctccggctatgtgagttgcgactatttcctgccttcctggtatagacaggcccccggcaaggaacgcgagttcgtgtctattatcgacggcaccgggagcacatcctacgctgcgagcgtcaagggccgcttcactgcgtcacaggacaagggcaagaacatcgcttatctccagatgaactctctgaaacctgaggatacagcaatgtattactgtaaggcttcctgcgtgagaggccgcgccattagcgagtactgggggcagggcactcaggtaaccgtaagcagc

SEQ ID NO: 982 - DNA, 777 bp, synthetic construct
  source 1..777: mol_type = other DNA; note = Description of Artificial Sequence: Synthetic polynucleotide
caggttcagcttcaggagtctgggggaggcagcgtgcaggcaggtggctcccttcgcctcagctgtacggcttcaggtgccattgcttccggttacattgatagcaggtggtgtatggcctggttccggcaagcgcccggcaaagaaagagagggtgtggcagccatctggccaggcggtgggcttaccgtgtatgccgattctgttaagggcaggttcacgatctccagggaccacgccaagaataccctgtatctccaaatgaataacctgaagcccgaggacactgccatgtattactgtgctgcgggctcccctcgtatgtgtccctctctggagttcgggtttgactactggggacaaggaacacaggtgaccgtctccagcgggggcagcggaggtagcggcggaagcggacaggtacagttgcaggagtctggcggtggctccgtgcaggctggcggttcactcagactgtcctgtgtggccagcggatacgtgagctgcgattatttcttgccttcctggtatcgccaggcccctgggaaggaacgcgagttcgtgtctatcattgacggaaccggctccacgtcctatgccgcttctgtcaagggtcgctttacagcttcccaggacaagggtaaaaacatcgcttaccttcagatgaactccctgaagcctgaagataccgccatgtactattgtaaggccagctgcgtgcggggcagggctatctcagagtattggggtcagggcacgcaggtgacagtgtcctct

SEQ ID NO: 983 - DNA, 759 bp, synthetic construct
  source 1..759: mol_type = other DNA; note = Description of Artificial Sequence: Synthetic polynucleotide
caggtgcagctccaggaaagcgggggaggctccgtgcaggcgggcggtagcctccgtctgtcctgcactgcctcaggagccattgcctctggctacattgactcccgctggtgtatggcctggttccgccaagcgcccggaaaggaaagggagggcgtggctgcaatttggccaggaggtggcctgaccgtgtatgcggattctgtgaagggacgcttcaccatcagcagggaccacgctaagaacaccctgtacctgcaaatgaataacctgaaacccgaggacaccgccatgtactattgtgccgcaggctcccccagaatgtgcccttctctggagttcgggttcgactattggggtcaggggacccaggtgaccgtctcctctggtgggggtagccaggtgcaactccaggaatccggcgggggctccgtgcaggctggcgggtctctgcgcctgagctgtgtggcttccgggtatgtgtcctgcgactacttcctgccttcttggtatcgccaagcgccggggaaggaacgcgagttcgtaagcatcattgatggcactggatcaacaagctacgcggcctctgtgaaaggccgcttcacagcgagccaggataagggtaagaacatcgcgtatttgcagatgaacactctcaagccagaagacaccgcgatgtattactgcaaggccagttgtgtgcgtggccgggccatctccgagtattgggggcagggcacccaggtcaccgtgtcctcc

SEQ ID NO: 984 - DNA, 777 bp, synthetic construct
  source 1..777: mol_type = other DNA; note = Description of Artificial Sequence: Synthetic polynucleotide
caggtccaacttcaggagtctggaggcggttccgtgcaggcgggcggtagcttgcgcctgagctgtaccgcttcaggtgccatcgcgagcggatacatcgactctcgctggtgtatggcctggttccgccaggcccctggcaaggaacgtgagggtgtggctgccatttggcccggcgggggacttactgtgtacgccgactccgtgaagggccgtttcaccatctcccgtgaccacgcgaagaacaccctgtacttgcagatgaataacctcaaacccgaggataccgcgatgtattactgtgccgctggcagcccacgcatgtgtcccagtctggagttcggttttgactattgggggcagggtacacaagtcacagtgtctagcggaggctctggtggctccgggggtagcggacaggtgcagttgcaggaatctggcggtggcagtgtgcaggcgggtggcagcctgcgcctgtcctgcgttgctagtgggtatgtgagctgtgattatttcctgccatcttggtatcgccaggcccccggcaaagaaagagagttcgtgtccatcattgatggcaccggctccaccagttatgcagcgtctgtcaaaggcaggttcactgccagccaggacaagggtaagaacattgcttatttgcagatgaacaccctgaagcccgaggacacggctatgtattactgtaaggcctcatgtgtgcgtggccgggcgatttccgagtactggggacaaggcacacaagtgaccgtgtccagc

SEQ ID NO: 985 - DNA, 786 bp, synthetic construct
  source 1..786: mol_type = other DNA; note = Description of Artificial Sequence: Synthetic polynucleotide
caagtgcaactccaggagtccgggggcgggtctgtgcaagctggaggctccctgcgcctgagttgtaccgcgtccggtgccatcgcttctggttatattgatagcagatggtgtatggcttggttccgtcaagcgccagggaaagagagggagggcgtggcagctatttggccaggaggcggactgaccgtctacgcagactccgtcaaaggccggtttacaatctccagagaccacgcgaaaaacactctgtatctccagatgaataacctgaagccagaggatacagcaatgtactattgcgccgctggctcaccccgtatgtgccccagtctggagttcgggtttgactactggggccagggcacccaagtcactgtaagctccggcggtggctcccaggtgcagttgcaggaaagtggcggaggcagcgtgcaggccgggggcagcctgcgcctctcttgtcgcgcatccggcagtacctattctaactactgtttgggttggtttaggcagattaccggcaaggagagggagggggtggccgttatcaactgggtcgggggcatgttgtactttgccgactctgtgaagggtaggttcactgtttctcaggatcaggctaagaacactgtttatcttcagatgaactctctgaagccagaggacaccgctatgtattactgtgccgcagagtcagccagctcctttagttgtgggggctggctgacccgtcccgaccgcgtcccatactggggccagggtacacaagtgactgtctccagc

SEQ ID NO: 986 - DNA, 804 bp, synthetic construct
  source 1..804: mol_type = other DNA; note = Description of Artificial Sequence: Synthetic polynucleotide
caggtgcaacttcaggagagtgggggaggctctgttcaggcaggcgggtccctgcgcctgagctgcaccgcctcaggtgccatcgcctctggctatattgatagccgttggtgtatggcctggttccggcaggcacccggcaaagaacgcgaaggggtggccgctatctggcctggaggtggcctgaccgtttacgctgacagcgtgaaaggaaggttcaccatctccagggaccacgctaagaacactctgtacttgcagatgaataacctgaaacctgaagataccgccatgtattactgcgccgctggctctccacgcatgtgtccatccctggagttcggattcgattattggggacagggcacccaggtcaccgtgtcctctggcggatctggtggctcagggggctctggccaggtccagttgcaggaatccggtggaggcagtgttcaggccgggggctccctgcgcctgtcatgtcgggcctccggcagcacctactccaattactgcctcggatggttccgccagatcaccggcaaagagcgtgaaggcgtggccgtcatcaactgggtgggcgggatgctttactttgcagattccgtgaagggcagatttacggtgtctcaggaccaggcgaagaacacagtgtatctccagatgaacagcctcaagcctgaagataccgctatgtattactgcgccgcagagagcgcttcttcctttagctgcggcggttggctgaccaggcccgaccgtgttccgtactggggtcagggcacccaggtgaccgtatccagt

SEQ ID NO: 987 - DNA, 768 bp, synthetic construct
  source 1..768: mol_type = other DNA; note = Description of Artificial Sequence: Synthetic polynucleotide
caagtccagctccaggaatccggcggaggtagcgtgcaggcgggtggcagcctgcgcctgtcctgtactgcaagcggagccatcgcctctggctacatcgactcacgctggtgtatggcctggtttcgccaagcgccgggtaaggagcgcgaaggggtggccgcgatttggccgggcgggggcctgaccgtctacgctgacagtgtcaagggccgcttcaccatctctcgggatcacgccaagaacactttgtatctgcaaatgaataacctgaaacccgaagacaccgcaatgtattactgcgccgctggtagtccgcgtatgtgtccatcactggagttcggcttcgactactggggtcagggaacccaggtcaccgtgtcctctggtggcggtagccaggtccagctgcaagaatccggtggcgggctggtgcagccaggtggatctctgcgcttgtcctgtgccgcaagcggttttactttctcactgagcggcatgtcctgggtgaggcaggctccaggcaagggcctcgaatgggtctcagccattagtagcgggggcgcatccacctattacacagattccgtgaagggtagattcacgattagccgcgacaatgctaagaatatgctgtatcttcagttgaatagcctgaagacagaggacaccgctatgtattactgcgcgaagggcggatctggctacggcgacgcctccaggatgacaagtccgggttcccagggcacacaggtcacggtctctagc

SEQ ID NO: 988 - DNA, 786 bp, synthetic construct
  source 1..786: mol_type = other DNA; note = Description of Artificial Sequence: Synthetic polynucleotide
caggtgcagctccaggagtccggcggaggctcagtccaggctgggggctccctccgcctgtcctgtacggcaagtggcgctatcgcgagcggctacattgattcacgctggtgcatggcctggttcaggcaagctcctgggaaggagcgcgagggagtggctgccatctggccagggggtggcctgactgtgtacgcggacagcgtgaagggtcgcttcacaatctcaagggaccacgccaagaataccttgtatcttcagatgaataacctgaaacccgaggacacagccatgtactattgtgcagccggttccccgagaatgtgccctagtttggagttcggcttcgactactggggtcagggaacccaggtgaccgtgtccagtggcgggtctgggggttccggcgggtcaggccaggtccagcttcaggaatccgggggaggcctggttcagccaggtggaagccttcgcctgtcctgcgctgcatccgggttcacattcagcctgagtggcatgtcctgggtgagacaggccccaggaaagggtctggagtgggtctctgcaatcagctccggcggtgcttctacctattacaccgactccgtgaagggccggttcactattagtcgcgacaacgctaagaacatgctgtacctgcaactgaactccttgaagacagaagacacggccatgtattactgcgccaagggaggttcaggttacggcgacgccagccgcatgacctcccctggctctcaggggactcaggttacagtctcctcc

SEQ ID NO: 989 - DNA, 759 bp, synthetic construct
  source 1..759: mol_type = other DNA; note = Description of Artificial Sequence: Synthetic polynucleotide
caggtccagctccaggaaagcggaggcgggtccgtccaggctggcggtagtttgcgcctctcatgtaccgccagcggcgcaatcgcttctggatatatcgactctcgctggtgtatggcctggttccggcaggcccccggcaaggagagggagggagtggcagccatctggccgggtggcgggttgaccgtgtatgccgactctgtcaagggccgcttcacaatcagcagagaccatgccaagaacaccctgtaccttcagatgaataacctgaagcccgaagacaccgccatgtattactgcgccgcaggctccccaagaatgtgccctagtctggagttcggcttcgactactggggccaggggacccaggtgaccgtcagctctggtggaggtagccaggtgcaactccaggagagcggaggcggtagcgtgcaggctggcggttccctgcgcctgagctgcgtggcctctggttacgttagttgcgactattttctgcccagctggtatcgtcaggctccgggcaaggaaagagaatttgtctccatcattgacggaactggctctacaagttacgccgcaagtgtcaagggtcgcttcaccgccagccaggacaagggtaagaacatcgcctacctgcaaatgaactccctcaagccagaagacaccgcgatgtactattgcaaggccagctgtgtaaggggcaggggcattagcgagtactggggccagggaacccaggtgaccgtgtcctcc

SEQ ID NO: 990 - DNA, 777 bp, synthetic construct
  source 1..777: mol_type = other DNA; note = Description of Artificial Sequence: Synthetic polynucleotide
caggtccagctccaggagtcaggcggtggatctgtgcaggcgggcgggagcctcaggctgagctgtactgccagcggcgctattgcctccggttacattgacagccgctggtgtatggcttggtttcgccaagcccctggaaaggagagggagggcgttgctgccatctggcctggtgggggactgaccgtctatgctgattcagtgaaggggcgttttaccatctcccgcgatcacgctaagaacacactgtacctccagatgaacaatttgaagcccgaagacacagccatgtactattgcgccgctgggagtccccgcatgtgccctagcctggagtttggcttcgactattggggccagggcactcaggtcactgttagttccggtggctctggtggcagcggtggcagtggccaagtgcagctccaggagtccggcggaggctcagtacaggccggtggctcccttcgcctgtcctgcgtcgcctccggttacgttagttgcgactatttcctgcccagctggtatcgccaggcaccagggaaggagcgcgagttcgtgtccattatcgacggaacagggtctacatcttatgctgccagcgtgaaaggaaggttcaccgcctcccaggataagggaaaaaacatcgcctacctccagatgaacagcctgaagccagaggacacggctatgtactattgcaaggcctcctgcgtgcgcggcagaggtatctccgaatattggggccagggaacacaggtgaccgtgagcagc

SEQ ID NO: 991 - DNA, 786 bp, synthetic construct
  source 1..786: mol_type = other DNA; note = Description of Artificial Sequence: Synthetic polynucleotide
caggtccagctccaggaatctggtggcggaagcgtgcaggccggtgggtccctgagactgagctgtaccgcgagcggagctatcgcttctgggtacattgactcccggtggtgcatggcgtggttccgtcaggctccaggtaaggagcgggagggcgttgctgcgatctggccaggagggggattgactgtgtacgctgactctgtcaagggtcgctttactatctcccgcgaccacgcaaagaataccttgtacttgcaaatgaacaatctgaagcctgaggacaccgccatgtattactgtgccgctggtagcccacgcatgtgtcccagtctggagttcgggttcgattattggggccagggcacgcaggtgactgtgtcctctggtggaggcagccaagtgcagttgcaggagtcaggcggagggagcgtgcaggcgggaggttccctgcggctgtcctgtcgcgcgtccggttccacctactctaactattgcctcggttggttccgccagatcaccggcaaggagcgcgagggagtggcggttatcaactgggtcggcggtatgctgtactttgcagactctgttaaaggacgcttcactgtgagccaggaccaggcaaagaatactgtgtacttgcagatgaactccctgaagccagaagacaccgccatgtattactgtgctgcggaatctgtgagttccttcagttgcggtgggtggctcactagacccgatagagtcccatattggggacagggtactcaggtgactgttagctcc

SEQ ID NO: 992 - DNA, 804 bp, synthetic construct
  source 1..804: mol_type = other DNA; note = Description of Artificial Sequence: Synthetic polynucleotide
caggtgcagttgcaggagagtggcggtggcagcgtgcaggcgggcgggagcctgaggctgtcctgtactgcctctggtgcaatcgcttcaggttacattgactcacgctggtgcatggcttggtttcgccaggctccaggcaaggagcgcgagggtgtggccgctatctggccgggtggaggcctcaccgtgtacgccgatagtgtcaagggacgctttacaatctcccgtgaccatgcgaagaacacattgtatcttcagatgaataacctcaaacccgaggacaccgctatgtattactgtgcagccggaagccctcgtatgtgtccaagcctggagttcggctttgattactggggacaaggcacccaggtgacagtttctagtggaggctctggcggttcaggaggctccgggcaagtgcagttgcaggaatccgggggtggctccgtgcaggctgggggctctctgcggctgtcttgtcgtgcatctggttccacatatagcaactactgcctgggctggttccgccagattacgggcaaggaaagagaaggtgttgcagtgataaattgggtaggtggaatgctgtactttgccgactcagtgaaagggcgctttacagtgagccaggaccaggccaagaacacagtctacttgcagatgaacagcctcaagcctgaagacaccgcaatgtactattgtgctgccgagagcgtctcatccttttcctgcggaggctggctgacccgtccagaccgcgtcccctactggggccagggcacccaggtgactgtgtcctct

SEQ ID NO: 993 - DNA, 768 bp, synthetic construct
  source 1..768: mol_type = other DNA; note = Description of Artificial Sequence: Synthetic polynucleotide
caagtgcagctgcaagagtccggtggaggcagcgtacaagcgggtggctcactgcgcctgagttgtaccgcttctggtgcaatcgcaagcggctacattgattccagatggtgcatggcatggtttcgccaagccccaggcaaggaaagggagggcgtggccgcaatctggcctgggggtggactgaccgtgtatgccgacagcgtgaaggggcgctttaccatctcccgtgaccacgctaagaacacactgtacttgcagatgaataacctcaagcctgaagacactgctatgtactattgcgctgccggaagtccccgcatgtgtcctagtctggagtttggttttgattactggggccagggcacccaggtgaccgtttcaagcggagggggcagtcaggttcagctccaggaatctggaggtgggcttgtccagccagggggcagcctccgcctgtcctgtgcagcgtctggctttactttcagctcctatcccatgtcttgggttagacaggcaccaggcaagggcctggagtgggtgtccacaatctcaagcgggggcgatacaaccctctatgccgattccgtgaagggcagattcacaagctctagggacaacgccaagaataccttgtacctccagctgaactccctgaagaccgaggacactgcgatgtattactgcgctaagcgcattgattgtaactctgggtattgttacaagcgctcttattggggacagggcacgcaggtgactgtcagttcc

SEQ ID NO: 994 - DNA, 786 bp, synthetic construct
  source 1..786: mol_type = other DNA; note = Description of Artificial Sequence: Synthetic polynucleotide
caggtgcagttgcaagagagcggcggaggctccgttcaggcagggggctccttgcgcttgtcttgcaccgcatccggggccattgcctcaggctatatcgactcccgctggtgtatggcttggttccggcaagcgccgggtaaggagcgtgagggggtggcagccatctggcccggaggcggtttgaccgtgtatgccgactctgtgaagggccggttcaccatctctagggaccatgcgaagaacacactgtatctccagatgaataacctgaagcccgaagacaccgcgatgtattactgtgccgctggctcccccaggatgtgcccctcattggagttcggtttcgactattgggggcagggaactcaagtgaccgtaagctccggcgggtccggcggtagtggaggctctgggcaggtgcagttgcaggagtcaggcgggggcttggtgcagcccggcggtagcctgaggctgagttgcgctgcctcaggctttaccttttccagctaccctatgtcttgggtgcgccaggctccgggcaagggcttggagtgggtgtccaccatctccagcggaggcgatacgaccctctatgcggattccgtcaaagggcgctttacctccagccgcgataacgccaagaacaccttgtacctccagctgaactccctgaagaccgaggataccgcaatgtactattgtgcaaagcggattgattgtaacagcggctattgctacaagaggtcttactggggccagggcacccaggtgacagtctccagt

SEQ ID NO: 995 - DNA, 768 bp, synthetic construct
  source 1..768: mol_type = other DNA; note = Description of Artificial Sequence: Synthetic polynucleotide
caggtccagctccaggagagcggtggcggttccgtgcaggctggtggcagtcttcgtctctcctgtaccgcgtccggtgccatcgccagtggctacattgattctcgctggtgcatggcatggttccgccaagctcccggcaaggagcgcgagggcgtcgctgccatttggccaggtggcgggctgaccgtgtacgcggactctgtgaagggtcggtttacgatcagccgggaccatgctaagaatacgctctacctgcaaatgaacaatctgaaacccgaggacacagcaatgtactattgcgcagccggaagtcctcgcatgtgcccatctttggagtttggcttcgattattggggccagggcacccaggtcactgtgtccagtgggggcggttctcaggtgcagttgcaggaaagtggaggtggccttgtccaacctggagggagtctgcgtctctcctgcgctgcctccgggttcacctttagtctgtccagtatgtcttgggtccgccaagcgcccggaaagggtctggagtgggtcagcgcgattagctccggtggagccagtacttattacaccgacagcgtgaaaggacggtttaccatctcccgcgataatgctaagaatatgctctacttgcagctgaacagcctgaagaccgaggacacagcgatgtattactgtgccaagggaggttctggctatggtgatgccagccgcatgacctcccctggctcccagggaactcaggttactgtgtcctcc

SEQ ID NO: 996 - DNA, 786 bp, synthetic construct
  source 1..786: mol_type = other DNA; note = Description of Artificial Sequence: Synthetic polynucleotide
caagtgcagttgcaggagagcggtggcggtagcgtccaagctgggggcagtttgcgcctgagctgtactgcgtctggcgctattgcgagcggttacattgattccaggtggtgtatggcctggttcaggcaggcaccgggtaaagagcgtgagggggtggcagccatttggcctggcggtggactgaccgtctacgcggactctgtcaagggacgtttcacgatcagccgcgatcacgctaaaaacaccctctacctccagatgaataacctgaagcctgaggacacagctatgtattactgtgctgcgggcagtcccagaatgtgtcccagcctggagttcggcttcgactactgggggcaaggcacccaggtgacagtgtccagcgggggctccggcgggtctgggggcagcggccaggtgcaactgcaagagtctggcggtggacttgttcagccagggggatctctgaggctctcctgcgccgcttccggttttaccttctccctcagcagtatgtcctgggtccgtcaggctccaggcaaaggcctggaatgggtttccgctattagctctggcggtgcctccacctactatacggactcagtcaaaggccgtttcacgatctccagggacaatgctaagaatatgctctacctccagttgaactctctgaaaacggaggacaccgctatgtactattgcgccaaagggggttccggctacggcgacgcctcccggatgacatcccctgggtcccagggaacccaggtgaccgtgtccagc

SEQ ID NO: 997 - DNA, 786 bp, synthetic construct
  source 1..786: mol_type = other DNA; note = Description of Artificial Sequence: Synthetic polynucleotide
caggtgcagttgcaggagtccggcggaggctccgtgcaagctggcggtagcttgcggctgagttgcactgccagcggtgccatcgcgagcgggtacatcgacagcaggtggtgcatggcctggttccgtcaagcgccaggaaaggagagggagggcgtcgcagccatctggccgggcggaggcctgaccgtgtacgcagattccgtcaaaggccgtttcaccatctcccgcgaccacgccaagaacaccctgtatcttcagatgaataacctgaaacccgaggacaccgccatgtactattgtgctgcgggctcaccccggatgtgtccctctctggagttcggcttcgattattggggccagggcacccaggtcaccgtgtcaagtggtggcggttcccaggtgcagctgcaagagagcggcggtggcagcgtgcaggcgggcggtagcttgcgcctgagctgtcgcgcctccggcagcacttacagcaactactgcctgggctggttccgtcagactacaggtaaggagcgtgagggcgtagcggtaatcaactgggtcgggggaatgctttactttgcggacagtgtgaaaggccgtttcaccgtgtctcaggaccaggctaagaacactgtgtacctccagatgaactctctgaagcctgaggacacggccatgtattactgtgcagcggagtccgttagctccttctcttgtggcggatggctgacccggccagaccgcgtgccatattggggccaagggacccaagtgaccgtgtcatcc

SEQ ID NO: 998 - DNA, 804 bp, synthetic construct
  source 1..804: mol_type = other DNA; note = Description of Artificial Sequence: Synthetic polynucleotide
caggtgcagctccaggagtccggcggtgggtccgtgcaggctggtggatctcttagactgtcctgtaccgcttctggagcgattgcctcaggttacattgacagtaggtggtgtatggcttggttccgtcaggctccaggcaaggaacgcgagggcgttgctgccatttggccaggaggcggtctgactgtctacgctgacagcgtaaagggccgctttaccatctctcgggatcacgcgaaaaatacactgtacctccagatgaataacctgaagccggaggacaccgccatgtattactgcgctgccgggagcccccgtatgtgcccttccctggagttcggatttgactattggggccagggcacccaagtgaccgtcagctccggtggctctggcggttccgggggctctggccaagtgcagcttcaggagtcagggggtggctctgtgcaggccggtggcagcctgcgtctgagctgccgtgccagcggctctacctattccaactactgcctggggtggtttcggcagaccacaggaaaggaaagagagggtgtggcagttatcaactgggtgggagggatgttgtacttcgccgactccgtcaaggggcgcttcaccgtcagtcaggaccaggcaaagaacaccgtgtacctccagatgaactccctgaagcctgaggataccgccatgtattactgcgccgctgagtctgtgtcatctttctcatgcggtggctggctcacccgcccagaccgcgtgccttattggggccagggcacacaggtcaccgtcagctca

SEQ ID NO: 999 - DNA, 786 bp, synthetic construct
  source 1..786: mol_type = other DNA; note = Description of Artificial Sequence: Synthetic polynucleotide
caggttcaactccaggaaagcggcgggggctctgtgcaagctggcggaagtttgcgtctgtcctgcaccgcctctggagccatcgccagcggctacatcgactcaagatggtgtatggcctggttcagacaggctccaggaaaagaacgcgaaggcgtggccgctatctggcccggaggtggcctgaccgtgtacgctgactccgtcaagggccgcttcaccatctcccgtgaccacgcaaagaacacactgtacctccagatgaataacctgaagcccgaggataccgccatgtactattgcgctgcgggctcccctcggatgtgtcccagcctggagttcggcttcgactattggggacagggaactcaggtcacagtcagctccggcggaggctctcaggtccagctccaggaatcaggtggaggctctgttcaggcgggcggatctcttcgcctgtcatgccgtgcatccagatccccgtatggcaactattgcctggggtggttccgccagagtacaggtaaggagcgcgagggcgtggctgttatcaactgggtcggcggaatgctgtattttgccgattccgtgaagggtcgtttcacagtgagccaggatcacgccaagaacaccgtgaccttgcagatgaactccctgaagcctgaagataccgccatgtattactgtgctgcggagagcgtgtcctctttctcttgcggcggttggctgaccaggcctgatcgtgtcccctactgggggcagggcacccaggtgaccgtctctagc

SEQ ID NO: 1000 - DNA, 804 bp, synthetic construct
  source 1..804: mol_type = other DNA; note = Description of Artificial Sequence: Synthetic polynucleotide
caagtgcagttgcaggagtcaggcggaggctctgtccaggctggaggctctctgagactctcctgcaccgcatccggggccatcgccagcggatatatcgactccagatggtgtatggcgtggtttcgccaagctccggggaaggagcgtgagggtgtcgctgcgatctggcctggcgggggactgaccgtgtatgctgattccgtaaagggccgtttcaccatcagccgcgaccatgccaagaacacactctacctccagatgaacaatcttaaacccgaggacactgcaatgtactattgtgcggctggttctccccgcatgtgtccttccctggagttcggcttcgactactgggggcagggcacccaggtcaccgtgagtagcggcgggagcggcgggagcggtggctccggccaggtgcagcttcaagagtccgggggtggctccgtgcaagctggtggaagtcttcgcctgagttgccgcgcgtcccgctccccttacggcaattattgcctgggatggtttcgccaatccaccgggaaggagcgcgagggcgtggcagtaatcaactgggtgggcggtatgctgtactttgccgattctgtgaagggcagatttaccgtgtctcaagaccacgccaagaacactgtcaccttgcagatgaactcactgaagccagaggataccgctatgtattactgcgctgccgaatcagtcagctccttctcttgcggtggctggctgacccgccctgatagggtcccctattggggccagggcacccaggtcaccgtgtccagt

SEQ ID NO: 1001 - DNA, 768 bp, synthetic construct
  source 1..768: mol_type = other DNA; note = Description of Artificial Sequence: Synthetic polynucleotide
caggtccagctccaggagtccggcggaggttctgtccaggccggtggatcactgcgtctgtcttgcaccgccagcggcgcaatcgcgtctggctatatcgacagccgttggtgcatggcttggtttcgccaggctcccggcaaggaaagggaaggggtggccgcgatttggcctgggggcggtctgaccgtctacgccgacagcgtgaagggccgctttaccatctcccgcgaccacgccaagaacacattgtacctgcaaatgaataacctcaagcctgaggacacagcgatgtattactgtgccgctggctcaccccgcatgtgtccgtccctggagtttgggtttgattattggggccagggcacacaggtgactgtgtcatctggaggcggttcccaggtccagttgcaggagtctggcggaggtctggtgcagccaggaggcagcctgcggctgtcttgtgctgcgtctggtttcaccttctctcacagcggcatgtcttgggtgcgccaagcaccgggcaagggcctggagtgggtctccacaattaactccggcggggcctccacctattacaccgactctgtaaagggtcggtttaccattagccgcgataacgccaaaaatatgttgtatttgcagcttaactccctgaagaccgaagataccgctatgtattactgcgcaaagggtgggagcggttacggcgacgcctcccgcatgacctctccgggatctcagggaacccaagttaccgtgagtagt

SEQ ID NO: 1002 - DNA, 786 bp, synthetic construct
  source 1..786: mol_type = other DNA; note = Description of Artificial Sequence: Synthetic polynucleotide
caggtgcagctccaggaatctggaggcggttccgtgcaggcaggcggttccctgaggcttagttgtaccgcctctggggctatcgcctccggctacattgactctcgctggtgtatggcctggttcaggcaggctccaggtaaggagcgcgagggtgtcgcggctatttggcctggtggcggactgactgtgtacgccgattctgtgaagggccggtttactattagcagggatcatgcgaaaaataccctttacttgcagatgaacaatctgaagccggaggacacggccatgtactattgcgccgctggctcacctagaatgtgtcctagcttggagttcgggtttgattactggggccagggaacccaggtgaccgtctctagcggtgggagcggcgggagcgggggaagcgggcaggttcagttgcaggaatcaggaggcggactggtgcaaccgggaggctccctgcgcctgtcttgtgctgcctctggttttacttttagccatagcgggatgtcctgggttcgccaggctccaggcaagggcctggagtgggtatctaccatcaactctggaggtgccagcacctattacaccgacagcgtgaaggggaggttcaccatctcccgcgacaacgctaagaacatgctgtacctccagctcaactctctgaagaccgaggacaccgctatgtattactgcgcgaagggcggttccggttacggagacgcctcccgcatgaccagtccgggttcccaaggtacacaggtgaccgtgtctagc

SEQ ID NO: 1003 - DNA, 750 bp, synthetic construct
  source 1..750: mol_type = other DNA; note = Description of Artificial Sequence: Synthetic polynucleotide
caggttcaactccaggagtccgggggcggttccgtgcaagctggaggttcactgcgcctgagctgcactgcgccaggcttcacatcaaattcttgtggtatggattggtatcggcaagcccccggaaaagagcgggagttcgtgtccagtattagcacagacggtacgaccggatatgcggactctgtgaaaggacgcttcacgatttccaaagacaaggccaaggacaccgtgtaccttcagatgaactcactgaaaccagaggacacgggcatgtactcctgtaagacgaaggacggaacaatcgccactatggaattgtgcgatttcggctattggggccaggggacgcaggttaccgtttcttcagggggagggagtcaggttcagttgcaggagtccggcggtggcttggtgcaacctgggggaagcctgcgtctttcttgtgcagccagcggcttcaccttcagttcataccccatgagctgggtccgtcaggcccccggtaaagggctggagtggatctcaaccatctctgccggtggcgacaccacgctttacgctgactccgtcaaaggcagattcaccagtagcagagacaacgcgaagaacaccctctatttgcagcttaactccctcaagaccgaggacgcagctatctactattgtgctaagaggattgactgtaacagcggctactgttatcgtcgcaactattggggccagggcactcaggtcacagtgtcttcc

SEQ ID NO: 1004 - DNA, 768 bp, synthetic construct
  source 1..768: mol_type = other DNA; note = Description of Artificial Sequence: Synthetic polynucleotide
caggtccagctccaggagagcggcggagggtctgtgcaggcgggcggtagtttgcgcttgagctgtaccgcacccggattcacctccaacagctgcggtatggactggtatcgccaggctcctggtaaagagcgtgagttcgtgtcttcaatcagcaccgacggtacaactgggtatgccgattccgtgaaaggaagattcaccatctccaaggacaaggccaaagacacagtttatcttcagatgaacagtctgaagcccgaggacaccggcatgtattcttgtaagactaaggacgggacgattgcgacaatggaactgtgcgacttcggttactggggccaggggactcaggtaactgtgtcaagcggaggctctggcggaagtggaggctcaggacaggtgcagctccaggagtcaggagggggcctggtccagccgggcgggtctctgcgcctctcttgcgctgcctctgggttcacattcagcagttaccctatgtcctgggtacgccaggctccaggcaaaggtctggagtggatctccaccatcagtgccggaggcgataccactctgtatgccgacagcgtgaagggacgctttacctcctcacgcgataatgccaagaacactctgtacctgcaactcaatagtctgaagactgaggacgcggccatctattactgcgccaagcgcattgattgcaatagtggctactgttaccggcgcaactattggggacagggtactcaggtaacagtcagctcc

SEQ ID NO: 1005 - DNA, 750 bp, synthetic construct
  source 1..750: mol_type = other DNA; note = Description of Artificial Sequence: Synthetic polynucleotide
caggtccaactgcaagagtctggagggggctctgtgcaggccggaggctcccttcgcctgtcttgtaccgccccaggttttacctcaaactcctgcggcatggattggtatagacaggctcctgggaaagagagggagttcgtgtcttccatcagcaccgacggtacaaccggctacgcggattccgtgaaaggtcgctttaccatttcaaaggacaaagctaaagataccgtgtacctccagatgaactcactgaagcccgaggacactggcatgtactcttgtaagaccaaggatggcaccatcgccactatggagttgtgtgatttcgggtactggggccagggcacacaagtgaccgtctccagcggtggaggcagccaggtgcagcttcaagagtccggcggtgggctggtccagccaggaggctcactccgcctgtcctgtgcggcttccgggtttaccttctcactgtccggcatgtcctgggtccgccaggcccccggcaaaggccttgagtgggtgtccgctattagctccggtggagccagcacttactatactgactctgttaaaggccggtttacaatctcccgtgacaatgccaagaacatcctgtatcttcagctgaacagtctcaagacagaggatactgccatgtactattgtgctaaaggtggctccggctacggcgacgcgagccgtatgacttctcctggctcccagggcactcaggtgactgtttccagc

SEQ ID NO: 1006 - DNA, 768 bp, synthetic construct
  source 1..768: mol_type = other DNA; note = Description of Artificial Sequence: Synthetic polynucleotide
caggtccagcttcaggagagcgggggtgggagcgtgcaggccgggggctctctgcgcctgtcctgcacagcgcccggttttacgtccaactcttgcggcatggattggtatcgccaagcgcctggcaaggaaagagagtttgtcagctccatcagcaccgatggcactaccggctacgcggattctgtaaagggtcgtttcaccatcagtaaggataaggctaaggacacggtgtacctccagatgaactccctcaagcccgaggataccgggatgtactcttgcaagaccaaggacggcaccatcgccactatggagctttgcgacttcggctattggggccagggaactcaggtgactgtgtcaagtggtgggtcaggaggtagcggaggttctggccaggtgcagcttcaggaatctggcggtgggctcgtccagccgggaggctctctgcgcctgagctgcgcagcctctggctttaccttttctctgtctggcatgtcttgggtccgccaggcacctggaaaggggctggagtgggtttccgccatctcctctggtggcgcatccacatattacaccgactctgtcaagggccgcttcaccatttcacgcgataatgccaagaacatcctgtaccttcagctgaactccctgaagaccgaggacacagctatgtattactgcgctaagggagggtccggctacggggatgcgagcagaatgaccagccctggttcacaaggcacccaggtaactgttagcagt

SEQ ID NO: 1007 - DNA, 741 bp, synthetic construct
  source 1..741: mol_type = other DNA; note = Description of Artificial Sequence: Synthetic polynucleotide
caagtccaacttcaggagtccggcgggggctctgtgcaggctggagggtctctgcgcctgtcctgcactgcacctgggttcacttcaaactcttgcggcatggactggtatcgccaggccccaggcaaggaacgtgagtttgtgtccagcatttcaactgacggcacaaccgggtatgctgatagcgtgaagggtaggtttaccatctccaaggataaggccaaggataccgtgtacttgcagatgaactccctcaaacctgaggataccggaatgtatagctgcaagaccaaagatggaaccatcgctactatggagctgtgtgactttggctactgggggcagggcacccaggtgaccgtgtccagcggcggtggatctcaggtccagctccaggagagcgggggcgggtctgtgcaggcaggcgggtccctgcgtctgtcatgcgtcgcgtcaggctacgtctcctgcgattacttcctgccttcctggtatcgccaggcccctggcaaggaaagggagttcgtcagtatcattgacggaaccggctccaccagctacgctgcctccgtcaagggccgcttcaccgcctctgaggacaaagggaagaacatcgcctacctccagatgaacagtctgaaaccagaggatactgcaatgtactattgcaaggcctcctgtgtccgtggccgtgccgtttctgagtactggggccaagggactcaggtgactgtctcctcc

SEQ ID NO: 1008 - DNA, 759 bp, synthetic construct
  source 1..759: mol_type = other DNA; note = Description of Artificial Sequence: Synthetic polynucleotide
caggttcagttgcaggagagtggagggggctccgtgcaggccggtggctccctgaggctgtcctgcacagctcccggcttcaccagtaattcctgtggcatggactggtatcgccaggcccccggtaaggaaagagagtttgtgtccagtatctcaaccgacggcaccactggctatgcggactccgtcaagggcaggttcactatctccaaggataaggccaaagacacagtgtacctccaaatgaactctctcaagcccgaggacacgggcatgtattcctgtaaaaccaaggacggcaccatcgctactatggagctgtgtgatttcggatactggggccagggaacccaggtgaccgtgtcaagcggaggtagtggtggctcaggcgggtccgggcaggtccaactccaggagtctggaggcgggagtgtgcaggctggtggctccctgcggctgagctgcgtggcttccgggtatgtttcttgcgattacttcctgccgagctggtacaggcaggctcccggtaaggagcgtgagttcgtttccatcattgacggcaccgggagcacaagctacgccgctagtgtgaagggacgcttcacggcaagcgaagacaagggcaaaaacatcgcgtacttgcagatgaactccttgaagcccgaggacaccgctatgtattactgtaaagcctcatgcgtcagaggcagggctgtctcagagtactggggtcagggcacgcaagtgacagtctcttcc

SEQ ID NO: 1009 - DNA, 753 bp, synthetic construct
  source 1..753: mol_type = other DNA; note = Description of Artificial Sequence: Synthetic polynucleotide
caagtgcaactccaggagtccggcggtgggtctgtgcaggctgggggctcactgcgtctgagctgcaccgctcccggttttaccagtaactcttgtggtatggactggtatcgccaggcccccggcaaggagagggaatttgtcagttccatctctacagacggcactacaggatacgccgactccgtcaaggggcggttcaccatctcaaaagataaagcaaaggacacagtctaccttcagatgaacagcctgaaacctgaggacactggaatgtatagctgcaagacaaaggatggaacaatcgccacgatggagctgtgtgacttcggatactggggccaggggacacaggtcactgtgtcctctggaggcgggtcccaggtgcagctccaggagagcggcggaggcctggtgcagcccggcgagtcccttaggctgagctgtacggcgagcggctttactttcagcaactacgccatgagctgggtccgtcaagcgccggggaaggggctggagtgggtttctggcatcaacgtggcatacggcatcacctcctatgctgatagcgtcaagggccgcttcaccatttccagagataataccaagaataccctctacctccagctcaattccctgaagaccgaggacactgctatttattactgtgtgaagcactctggcaccacaattcctcgcggctttatcagctatacaaagagaggccagggaactcaggtcaccgtcagctct

SEQ ID NO: 1010 - DNA, 771 bp, synthetic construct
  source 1..771: mol_type = other DNA; note = Description of Artificial Sequence: Synthetic polynucleotide
caggtccagttgcaggaatctggcgggggatcagtgcaggccgggggctccctgcgtctttcttgcacagcccctggctttacctccaattcctgtggcatggattggtatcggcaggcccccggcaaggagcgcgagtttgtctctagcattagcaccgacggcaccactggttacgctgactcagtgaagggacggttcaccatttccaaggacaaggctaaagacacagtctaccttcagatgaacagtctgaagcctgaggatacagggatgtactcctgtaagaccaaggacggcaccatcgcaacgatggagctgtgcgacttcggctattgggggcaagggacccaggtgactgtgtcctctgggggctccgggggcagcggaggctccggccaagtgcaactccaggagagcggcggtggactggtgcagccaggcgagagcctccggctttcctgcaccgcaagcggcttcacttttagcaactacgctatgtcctgggtaaggcaggctccaggtaagggcctggagtgggtgagcggtattaacgtggcatacggcatcacttcctacgcggacagcgtcaagggccgttttactatcagcagggataatactaagaatactctgtacttgcagctgaacagcctgaagactgaagatactgccatctattactgcgtgaagcactctggaacaaccattccacggggcttcatcagttacaccaagcggggccagggcactcaggtcaccgtgtcttcc

SEQ ID NO: 1011 - DNA, 741 bp, synthetic construct
  source 1..741: mol_type = other DNA; note = Description of Artificial Sequence: Synthetic polynucleotide
caagtgcagctccaggagtccggcggtggaagcgtgcaggccggaggctctctgcgcttgagttgcaccgcccctggattcacatctaactcctgtggtatggattggtacaggcaggcaccaggcaaggaacgtgagttcgtgtcttccatcagtaccgacggtactaccggctacgcggactccgtcaaaggtagatttacgatcagcaaagataaggctaaggataccgtgtatctccagatgaactccctgaaacctgaggatacaggtatgtatagctgcaagaccaaggacggcactatcgcgactatggaattgtgtgactttggttactggggccaaggaacccaggtgaccgtcagtagcggtggcggttcccaagtacagctgcaagagtctggaggtggatctgtgcaggctgggggtagtcttcgcctgtcttgtaccgccagcggttacgtgtcctgtgactactttctgccctcctggtacagacaggctcctggtaaggagcgcgagttcgtgagcgtcatcgacggcacagggtccaccagttacgcggcatccgtaaagggacgtttcaccgcttcccaagataagggcaaaaacatcgcttatctccagatgaacagtttgaagcctgaggacacagcgatgtattactgtaaggcttcctgcgtgagaggccgcgctatctctgaatattggggacagggcactcaggtgactgtgtcttca

SEQ ID NO: 1012 - DNA, 759 bp, synthetic construct
  source 1..759: mol_type = other DNA; note = Description of Artificial Sequence: Synthetic polynucleotide
caggtgcagctccaggagtctgggggtggctccgtccaggctggcggaagcctgcgcctgtcctgtaccgctccgggtttcacaagtaacagttgtggaatggattggtatcgccaggcccccggaaaggaacgggagttcgtctctagcatctcaactgacggcactaccggctacgccgactccgtgaagggccgtttcaccattagcaaggacaaggccaaagacacggtgtacctccagatgaactccctgaagcccgaggataccgggatgtatagctgtaagaccaaggacggtactatcgctacgatggagctgtgtgacttcggatactggggccaggggacccaggtgactgtttccagcggtggctccggtgggtccggcggttctggccaggtgcagcttcaggagtccggcggtgggagcgtccaagctggcggttccctgcgcttgagttgcacagcatctggctatgtgtcctgtgactatttcttgccatcctggtacagacaagcgcctggtaaggagagagagttcgtgtccgtgattgatgggacgggctcaacaagctatgccgcttccgttaaaggaaggtttaccgcttctcaagataaagggaagaacatcgcttatctccagatgaatagcctcaaaccagaggatactgctatgtattactgcaaggcatcttgtgtgcgtggacgtgcaatctccgagtattggggacaaggcacccaggttacagtgtcttca

SEQ ID NO: 1013 - DNA, 738 bp, synthetic construct
  source 1..738: mol_type = other DNA; note = Description of Artificial Sequence: Synthetic polynucleotide
caggtgcagctccaggagtctggaggtggctccgttcaggctggcggaagcctgcggttgagctgtactgcccctggatttacctccaattcttgtggcatggattggtatagacaggctccagggaaagagcgcgagtttgtctccagcatttccaccgatggtacgactggttatgccgacagcgttaagggtagatttacaatcagtaaggacaaagctaaggacacagtgtatttgcagatgaactctctgaaaccggaggatacaggtatgtatagttgtaagacaaaagatggcaccattgctactatggaactttgtgacttcggctactggggacagggcactcaggtaacagtctctagcggtggaggctctcaagtgcagcttcaggagtctggcggaggcctcgtccagccgggaggctccttgcgcctgagctgtgccgcttctggtttttcatttagctcctatgctatgaaatgggtgcgccaggctcccggcaagggcctggagtgggtctccacgatttcctctgggggctcaagcaccaactacgccgacagcgtaaagggccgttttaccatctctcgggacaacgccaaaaacaccctgtaccttcagttgaactcactgaaaatcgaggatactgcaatgtattactgtgccaaggccatcgtcccaaccggagctacaatggaaaggggccaggggacccaggtcaccgtgagtagc

SEQ ID NO: 1014 - DNA, 756 bp, synthetic construct
  source 1..756: mol_type = other DNA; note = Description of Artificial Sequence: Synthetic polynucleotide
caggtgcagttgcaggaatctggtggaggcagcgtgcaagctggaggctctctgaggttgagctgcaccgcccctgggtttacaagcaactcatgtggcatggactggtatcggcaagcgcctgggaaagagcgcgaatttgtaagctctatctctactgacggcacaaccggctacgcagatagcgtgaagggcaggttcaccatctcaaaggataaagccaaggataccgtgtacctgcaaatgaactcccttaaacccgaggataccggcatgtatagctgcaagaccaaggacggcaccatcgcaacgatggagctgtgcgacttcggttattggggacagggaacccaggtgaccgttagttccggtggctcaggcggtagcggaggcagtggccaggtgcagttgcaagagagcggaggtgggctggtgcagccagggggctccctgcgtctgtcctgcgcagccagcggctttagcttttccagctatgccatgaaatgggttcggcaagcgcctgggaagggtctggaatgggtgtccactatctcctcagggggctcctctacaaactacgcagattcagtgaagggtcggtttactatttctagggacaacgcgaagaacaccctgtaccttcagttgaactccctcaagattgaggatactgccatgtactattgcgcgaaggccatcgtacccaccggcgctacaatggagaggggccagggcacccaagtaactgtctcctca

SEQ ID NO: 1015 - DNA, 750 bp, synthetic construct
  source 1..750: mol_type = other DNA; note = Description of Artificial Sequence: Synthetic polynucleotide
caagtgcagttgcaggagagcggtgggggatctgtccaggccggaggcagtctccgcctgtcctgcactgcccctggcttcacctctaacagttgtggcatggactggtatcgccaggcccctggtaaagagcgcgaatttgtcagctcaatcagtacagatggcacaactggttatgctgacagcgttaagggccgctttacgatcagcaaagacaaggctaaagatactgtgtacctccagatgaacagcctcaagcctgaagacaccggaatgtatagctgtaagaccaaggacggcaccattgcgacaatggaactgtgcgactttggctattggggccaagggacccaggtcacagtcagcagtggagggggcagccaggtgcagttgcaggaatcagggggtggccttgtgcagcctggcgggagtctgcgcctgtcatgtgcggcctccgggttcaccttcagctcctacccaatgtcttgggtgaggcaggcacctggcaagggcctggagtggatcagcactatcagcgcaggcggtgacaccactctgtacgcagacagcgtgaagggaagattcaccagtagccgcgataacgcgaagaacacactgtatctccagctcaattcactcaagaccgaggacactgccatctactattgtgccaaacgcattgattgtaattctggctactgctatcggcgtaactactggggacagggcacccaggttaccgtcagttcc

SEQ ID NO: 1016 - DNA, 768 bp, synthetic construct
  source 1..768: mol_type = other DNA; note = Description of Artificial Sequence: Synthetic polynucleotide
caggttcagcttcaagagagtggaggtgggtccgtccaggccggaggctcactgcggctgtcttgcaccgctcctggtttcactagcaactcctgcggcatggattggtataggcaagcccctggtaaggaacgtgagtttgtttcttccatctccacagatggtactaccgggtatgctgacagtgtgaaaggccgttttaccatctccaaggacaaggcaaaggacaccgtgtacctccagatgaacagtcttaaacccgaggacaccggcatgtactcttgtaagacaaaggatggcacaatcgccactatggagctgtgtgatttcgggtactggggccagggcacacaggtgactgtgtcaagcgggggaagcggaggcagcggtggctcaggccaggtccagctccaggagtccggcggtggactggttcaaccgggtggcagcctccgtctgtcctgcgccgcgagtggattcacgttcagtagctaccccatgtcttgggtcagacaggctcccggcaaaggtctcgaatggatctctacaatctctgccggtggggacacaaccctgtatgcggatagcgtgaaagggagattcaccagcagtagggacaacgctaagaacaccctgtatcttcagctgaacagcctgaaaaccgaagacacagcgatctattactgtgcaaagagaattgattgcaacagcgggtattgctaccgtcgcaactattgggggcagggaacccaagtcactgtgtcctcc

SEQ ID NO: 1017 - DNA, 750 bp, synthetic construct
  source 1..750: mol_type = other DNA; note = Description of Artificial Sequence: Synthetic polynucleotide
caggtgcagctccaggaatccggtggaggttctgtgcaggccggtggcagcctccgtcttagctgcaccgctccggggtttacctccaacagctgtggtatggattggtatcgtcaggcccctggtaaggagcgggagtttgtgtcttccatttcaactgatggcaccactggttacgccgacagcgtaaagggtcgtttcacaatcagtaaggataaggcaaaggacaccgtctatttgcagatgaacagcctgaagccggaagacacagggatgtactcttgcaagacaaaggacggcacgattgctacgatggagctgtgtgacttcggctactggggccagggtacacaggtgaccgtgtccagcggcgggggcagtcaggttcagttgcaggagtccggcggtggcagcgtccaggtgggcggtagcctgcgcctgtcctgtgctgcatccggctttaccttctctagttatccaatgagttgggtccgccaggctccagggaaaggtctggaatggatctccaccatttccgcaggtggggacaccacactgtacgccgatagcgtgaagggcagattcaccagctccagagacaatgccaaaaacactttgtacctccagctgaatagcctgaagaccgaggataccgccatctactattgtgccaagcgtattgattgtaattccggctattgttatcgcagaaactactggggccagggcacacaggtcactgtatctagc

SEQ ID NO: 1018 - DNA, 768 bp, synthetic construct
  source 1..768: mol_type = other DNA; note = Description of Artificial Sequence: Synthetic polynucleotide
caggtgcagctccaggagagcggcggtggctctgtccaggctgggggaagtctgcgtttgtcttgcactgcacccggattcacctcaaattcctgcggtatggattggtacagacaagcgcctggcaaggagcgtgaatttgtaagctccattagcaccgacgggaccactggctatgctgatagcgtgaagggccgcttcaccatttctaaggataaggctaaagacaccgtgtacctccagatgaactccttgaagccagaggataccgggatgtattcttgtaagaccaaggacggcaccatcgcaactatggaactctgtgacttcggttactgggggcagggaacccaagtgacagtctcttccgggggctccggcggttctggcggatctgggcaggtgcaacttcaggaatccggtggaggtagcgtccaggtgggaggctccctgcgcctgagttgtgccgcaagtggcttcaccttctcatcctaccccatgtcttgggtacgccaggctcccggcaagggcctggagtggatctccaccatctccgccggaggtgacactaccctgtacgccgactccgtgaagggccgctttacaagctcccgtgacaacgctaagaatacactgtacctccagcttaattcactgaagaccgaagacacggctatctactattgcgccaagcgcattgattgtaacagcgggtactgttacaggagaaactattggggacagggcacacaggtgactgtgtcctcc

SEQ ID NO: 1019 - DNA, 765 bp, synthetic construct
  source 1..765: mol_type = other DNA; note = Description of Artificial Sequence: Synthetic polynucleotide
caggttcagctccaggagagcggcggaggcagcgtgcaggctggtggcagtctgcgcctgagctgcacagcccccggcttcaccagtaacagctgtggaatggactggtatcgtcaagcgcctggcaaggaaagggagttcgtgtctagtatcagcaccgatggcaccacaggatacgccgactccgtgaagggacgcttcactatctcaaaggataaggcaaaagatacagtgtatctccagatgaactccctcaagcctgaagacacaggcatgtactcttgtaagaccaaggacggcactatcgctactatggagttgtgcgacttcggatactggggacaaggaacccaggtcaccgtatcctcagggggaggttcacaggtgcagcttcaggagtccggtggcggttctgtgcagagtggaggctccctgcgtttgagttgcgcagccagtggcttcacctactctactagcaacagctggatggcgtggttccgccaggcccccggcaaagaacgcgagggcgttgccgctatttacaccgtgggcggttccattttctacgccgattccgtgcgtggcaggtttactatctctcaggatgccactaaaaatatgttctacctgcaaatgaacacactgaagcccgaggacaccgctatgtattactgcgcagccgcttctggccgcctgagaggcaagtggttttggccctacgagtacaattactggggtcagggcacccaggtgacggtgtctagc

SEQ ID NO: 1020 - DNA, 783 bp, synthetic construct
  source 1..783: mol_type = other DNA; note = Description of Artificial Sequence: Synthetic polynucleotide
caggtgcaactccaggagtctggagggggctctgtccaggccggaggctctctccgtctgagctgcaccgctcccggcttcaccagtaatagctgcggtatggactggtacagacaggctccaggcaaggagagagaatttgtcagctccatttctactgatgggactacgggctacgccgactccgtgaagggccgctttaccatctctaaggataaggctaaggacaccgtatatttgcagatgaactccctgaagccagaagatactggcatgtatagctgcaagacgaaggatggaaccatcgccactatggaattgtgcgatttcggttactggggccagggaacacaggtgactgtgagttccgggggctcaggcgggtctggaggctctggacaggtgcaactccaggagagcggaggcggttcagtccagtctgggggctcccttcgcctgagttgcgctgccagtggctttacctacagtaccagcaactcctggatggcgtggttcagacaggcacccggaaaggaacgcgaaggcgtggctgccatctacacagtcgggggctccatcttctacgctgactccgttagaggccgcttcaccatttctcaggatgccaccaaaaatatgttctatctgcaaatgaacaccttgaagcccgaggacaccgccatgtattactgcgcagctgccagcggacggcttcgcggtaagtggttctggccgtatgagtataactactggggacagggcacccaggtcacggtgagttct

SEQ ID NO: 1021 - DNA, 768 bp, synthetic construct
  source 1..768: mol_type = other DNA; note = Description of Artificial Sequence: Synthetic polynucleotide
caagtgcagttgcaggaaagtggaggcggttccgtgcaggcaggaggcagtctgaggctgagttgtaccgcgcctggctttacctcaaacagttgcggcatggactggtataggcaggccccaggcaaggagcgcgagtttgtctcaagcatctccaccgatggaaccactggctacgccgactccgtcaagggaaggttcactatctccaaggataaggccaaggacaccgtgtatctccagatgaactcattgaagccagaagacaccgggatgtactcctgtaaaaccaaggacggcacgattgcgacaatggaactgtgtgatttcggttactggggtcagggaacgcaggtgaccgtgtctagcgggggcggttcccaggttcagctccaggagagcggtgggggctctgtgcaggccggtggaagtctgcgtctgagctgtcgcgcctctggctccacatactccaactattgcctgggatggtttcggcaaatcacgggtaaagaaagagagggcgtggctgtcatcaactgggtgggcggaatgctgtacttcgccgatagtgtgaaggggcgcttcaccgtttcccaggatcaagctaaaaacacactttaccttcagatgaacagtctgaaacccgaagacaccgcaatgtattactgtgccgctgagagtgtcagttccttctcatgcggaggttggcttacgaggcctgatcgcgtgccgtattggggccaggggacccaggtgaccgtgagttct

SEQ ID NO: 1022 - DNA, 786 bp, synthetic construct
  source 1..786: mol_type = other DNA; note = Description of Artificial Sequence: Synthetic polynucleotide
caggtgcagttgcaggaatccggcggaggctccgtgcaggctgggggaagcctgagacttagctgcactgctccgggatttacgagcaacagctgtggcatggactggtacagacaggcccctgggaaggagcgcgagttcgtgtcaagcatcagcactgacggcacaactgggtacgctgatagcgtgaagggccgttttaccatctccaaggataaggccaaagacactgtctacctgcaaatgaactccctcaagcctgaggacaccggaatgtactcctgtaagactaaggacgggaccattgccacgatggagctttgtgacttcggctattggggacagggaacccaggtcaccgtctctagtggaggcagcggcggtagtggcgggtccggccaggttcagctccaggagtccggtggcggatctgtgcaagcaggaggcagcctgcgccttagctgccgtgcgagcggcagcacttacagcaattattgtctgggttggtttcgtcagatcactggtaaagaacgggagggcgtggccgtcatcaactgggtcggcggtatgctgtacttcgcggacagcgtcaaaggccggtttaccgtgtctcaggaccaggcgaagaacacattgtacctccagatgaatagcctgaagcctgaggatacagctatgtattactgtgcagcggagtccgtctcttcattcagctgtggtggatggctcacgagaccggatagagtgccttactggggccagggcacccaggtgaccgtgtccagc

SEQ ID NO: 1023 - DNA, 768 bp, synthetic construct
  source 1..768: mol_type = other DNA; note = Description of Artificial Sequence: Synthetic polynucleotide
caggtgcagttgcaggagtctggtggcggttccgttcaggcaggcggttccctgagactgtcctgcaccgcccctggttttacctccaactcctgtggcatggattggtatcgccaggcaccaggcaaggaacgcgagttcgtatcttccattagcactgacggcacaactggttacgccgattcagtcaaggggcgctttacaatcagtaaggacaaggctaaggataccgtttacttgcagatgaatagcctgaaaccagaggacaccggaatgtactcttgcaaaactaaagacggcaccattgcaactatggaactctgtgactttgggtattggggtcaaggcactcaagtgaccgtctcctctggcgggggctctcaggtccagttgcaggaaagcggcggagggagcgtgcaggctggaggtagtctcaggctgtcttgccgcgccagcggaagcacctactcaaactactgccttggctggtttagacagagcactggtaaggagcgggagggagtggccgtcatcaactgggtcggtgggatgctgtatttcgctgatagcgtaaagggaagatttacggtaagccaggatcacgcaaagaacaccgtgaccctccagatgaactctctgaagcccgaggacactgccatgtactattgcgcagccgaatccgtcagttccttctcctgcggcggatggctgacccgccccggaagagttccatattggggtcaggggacccaggtgacagtttcttct

SEQ ID NO: 1024 - DNA, 786 bp, synthetic construct
  source 1..786: mol_type = other DNA; note = Description of Artificial Sequence: Synthetic polynucleotide
caggtgcaactccaggagagcggtggaggtagcgtgcaggctggcggttccctgcggctgtcctgcaccgctccgggttttacctccaactcctgcgggatggattggtacagacaggcccccggaaaggagcgcgagtttgtgtcttccattagcaccgacggcacaaccggctatgcagacagtgtcaagggacggttcacaatctccaaggacaaagctaaagacacggtgtatcttcagatgaacagcttgaagcctgaagatactggtatgtattcctgcaaaaccaaggatggtactatcgccactatggaactctgcgatttcggatattggggacaggggacccaggtgacggtgtctagcgggggctctggtgggtctggaggctctggtcaggtgcaactccaggagagcgggggcggaagcgttcaggccgggggcagcctgcggctgtcctgccgggctagtggatctacgtactccaactactgcctgggatggtttcgccaatctactggaaaggagcgtgagggggtggccgtcatcaactgggtgggcggaatgttgtattttgccgattctgtcaaaggaaggttcactgtgtctcaggaccatgccaagaacaccgtcaccctccagatgaactctttgaagccggaagataccgctatgtattactgcgcggcagaaagcgtgagtagcttctcttgcggtgggtggctgacacgtccgggtagggtgccgtactggggccagggaactcaggtaaccgtctcatcc

SEQ ID NO: 1025 - DNA, 768 bp, synthetic construct
  source 1..768: mol_type = other DNA; note = Description of Artificial Sequence: Synthetic polynucleotide
caggtccaactccaggaatccggcgggggctccgtacaggcaggtggcagtctgaggctttcctgcactgcccctggtttcaccagcaacagctgtgggatggactggtatcgccaggctcccggcaaagagcgggagttcgtcagctctatctcaaccgacggcacaaccgggtatgccgactccgttaaaggccggttcaccatcagcaaagacaaggccaaggatacagtctacctccagatgaacagcctgaagcctgaggataccggaatgtatagttgcaaaactaaggatggcactatcgccactatggagttgtgcgatttcggatactggggacagggcacccaggttaccgtctcatctggagggggctcccaggtgcagctgcaagaatccggcggaggcagtgtccaggctggcgaatccctccgcttgagctgtcgtgccagcggtagtacctactccaattactgcctgggttggtttcgccagatcaccggcaaggaacgtgaaggcgtggccgtcatcaactgggtagggggtatgctctacttcgctgactccgtgaagggacgcttcacggtgagtcaggaccaggctaaaaacaccgtgtaccttgaaatgaactccttgaagcccgaggacaccgctatgtattactgcgccacagagtctgtttcttccttctcatgcggaggctggctgactcgtccagaccgcgtgccctactggggccaggggacccaggtgaccgtgtcctca

SEQ ID NO: 1026 - DNA, 786 bp, synthetic construct
  source 1..786: mol_type = other DNA; note = Description of Artificial Sequence: Synthetic polynucleotide
caagttcagttgcaggagagtggaggcggttctgtccaggctgggggtagtttgcggttgagttgcaccgcgcctgggttcacctccaacagctgtggtatggattggtatcgccaggcccccggcaaggagcgcgagttcgtgagttccatcagcaccgacggcaccactggttacgcagactcagtgaagggaagattcaccatcagcaaggacaaagccaaggacactgtgtatcttcagatgaatagcctcaagccggaggatactggcatgtattcctgcaagaccaaggacggcaccatcgctacgatggagttgtgtgatttcgggtactggggacagggaacccaggtaactgtgagtagcggaggtagcgggggaagcggcgggtcagggcaggtacagcttcaggagtccggcggtgggtccgttcaggccggtgagtccttgcgcctgagctgccgcgccagcggttccacctacagtaactattgtctgggctggtttcgtcagatcacaggcaaggagcgcgagggcgttgctgtcattaactgggttggcggaatgctgtattttgccgacagcgtgaagggtcgtttcacggtatcccaagaccaagcaaagaacactgtctatcttgaaatgaacagtctgaaaccagaagacaccgccatgtactattgtgccaccgagtccgtatccagtttctcctgcggcggatggctgaccagacctgaccgtgtgccatactggggacaggggacacaggtgactgtgtccagc

SEQ ID NO: 1027 - DNA, 741 bp, synthetic construct
  source 1..741: mol_type = other DNA; note = Description of Artificial Sequence: Synthetic polynucleotide
caggtgcagctccaggagtccgggggaggctctgtgcaggccgggggttccctgagactttcatgtactgcaccaggctttacctcaaattcttgcgggatggactggtacaggcaggcccccggtaaggagcgggagtttgtgtcttccatttccaccgatggtacaaccggctacgcggactctgtgaagggccgctttaccatttctaaggacaaggctaaagacaccgtctatctccagatgaactctttgaagcctgaagacacaggcatgtatagctgcaagacaaaggatggcaccattgccacgatggagttgtgcgactttggctattggggtcagggcacccaggtcactgtgtcttccggcgggggctctcaggtccaactccaggagagcgggggagggtctgttcaggctggtggctcactgcgcctcagttgcgtggcctctggatacgtgtcctgtgactactttctgccctcttggtacagacaggccccaggcaaagagcgcgagttcgtgagcatcattgacggtactggctctacaagctacgcggcctccgtcaagggccgtttcactgcctcccaagacagaggtaaaaacatcgcttatctccagatgaacagcctgaagcccgaggatacggctatgtactattgcaaggccagctgtgtacgtggacgcactatctctgagtactggggccaggggacacaagtgacggtgtcctcc

SEQ ID NO: 1028 - DNA, 759 bp, synthetic construct
  source 1..759: mol_type = other DNA; note = Description of Artificial Sequence: Synthetic polynucleotide
caggtgcagcttcaagagagcggaggcgggtctgtgcaggctggtgggtccctccgcctgtcatgcactgcccccggcttcacttctaacagctgcggcatggactggtatcgccaggccccaggcaaagagcgcgagtttgtatcatccatctccaccgacggcacgactggctacgccgactccgtgaagggccggttcaccatcagcaaggacaaagccaaggataccgtgtacctccagatgaactccctcaaacctgaagacactgggatgtactcatgcaagacaaaagacggtacgattgccactatggagctgtgtgatttcggatactggggacagggaactcaggtgaccgtttcctctggaggcagtggagggagcggaggctccggccaggtgcagctgcaagagagcggtggcggtagcgtgcaagccggaggctccctccgtctttcttgtgtcgcgagcggctacgtgagctgtgattactttctgcccagctggtatcgtcaagcgccaggcaaagagcgcgaatttgtgtctattatcgacggcaccggcagcacgagctacgcagcctccgtgaagggacgtttcactgcttcacaggatcgcggcaaaaacattgcttacctccagatgaactccctgaagcctgaggacacagcaatgtattactgtaaggcctcctgtgtgcgtggacgcaccatctcagagtactggggacagggaacccaggtgaccgtatcttcc

SEQ ID NO: 1029 - DNA, 741 bp, synthetic construct
  source 1..741: mol_type = other DNA; note = Description of Artificial Sequence: Synthetic polynucleotide
caggttcagcttcaggagtccgggggtggctccgtccaagctggtggctcactgcgcctgtcctgcaccgcccctggcttcacctccaattcctgcggaatggactggtatcgccaggccccaggcaaagaacgcgagttcgtcagtagcatctctactgatggaaccacaggctacgcggacagcgtgaaggggcgtttcactatctccaaggacaaggccaaggacaccgtgtaccttcaaatgaactccctgaagcccgaggatactggaatgtactcctgtaagaccaaggacgggactatcgccactatggagctgtgtgacttcggatattggggccagggcacgcaggtgaccgtcagctctgggggcgggtcccaggtccagcttcaggaaagtggaggcgggtccgtgcaggccggaggttccctccgcctgtcatgtgtcgcaagcggctacgtgtcttgcgactacttcctgccctcctggtatcgccaggctccgggcaaggagagagagttcgtaagcatcattgatggcaccggctctacttcttacgccgctagtgtgaagggccgcttcacagcgtcccaggataagggtaaaaacatcgcttacttgcagatgaatagcctgaagcctgaggacacggcaatgtattactgtaaggcctcctgtgttagaggccgcgctatttctgaatactggggacagggcactcaggtgacagtctcctcc

SEQ ID NO: 1030 - DNA, 759 bp, synthetic construct
  source 1..759: mol_type = other DNA; note = Description of Artificial Sequence: Synthetic polynucleotide
caggtgcagcttcaggagtccggtgggggctctgtgcaggctggaggttcccttcgcctgtcatgtactgcccctgggttcacttctaactcctgtggtatggactggtatcgtcaggcccctgggaaggagcgtgagttcgtcagctccatctctactgatggcactaccggctatgccgattctgtgaaggggcgttttaccatcagcaaggacaaggccaaggataccgtgtacctgcaaatgaacagcttgaagcctgaggacactggcatgtattcttgtaaaaccaaagacggcaccatcgccacaatggagctgtgtgactttggctactggggccagggcactcaagtgaccgtgtcctcaggcgggtctggcggatctgggggaagcggacaggtgcagcttcaggagagcggaggtggctctgtccaggccggtgggtccctgagactgtcttgcgtggccagtgggtacgtgagctgcgattacttcctccccagttggtataggcaggcccctggaaaggaacgtgagttcgtaagcatcattgacggcaccggctctacttcttatgcggcctccgtaaagggccgcttcactgcttcccaggacaagggtaagaatatcgcctaccttcagatgaacagcctgaaacccgaagacacggctatgtattactgcaaggcttcctgcgtaagagggagagcaatctccgagtattggggccagggcacccaggtgactgtgtcttca

SEQ ID NO: 1031 - DNA, 741 bp, synthetic construct
  source 1..741: mol_type = other DNA; note = Description of Artificial Sequence: Synthetic polynucleotide
caggtgcagctccaggagagcggcgggggctccgtacaagcgggcggttccctccgtctgtcttgtaccgccccaggcttcaccagtaactcctgtggcatggactggtacagacaggctcctggcaaagaaagagagttcgtatccagcatctccaccgacggcaccacaggctacgcggattcagttaagggcagatttacgatctccaaggataaggctaaagatactgtgtacctccagatgaatagcctgaagccggaagacaccggcatgtatagctgtaagactaaggatggcaccattgccacaatggagctgtgcgacttcggctactggggtcagggaacacaggtgacggtgtcctctggtggcggtagccaggttcagttgcaggaatctggaggtggctctgtgcaggccggtggatctctgcgtctgtcttgcgtggcctccggctacgtgagttgcgactatttccttcccagctggtatcgccaggctccaggcaaggaacgcgagtttgtgtccattatcgacggaacaggcagcacatcctacgcagctagtgttaagggtagattcactgcgagccaggacaagggcaaaaacatcgcttatcttcagatgaataccctcaaacctgaggacaccgccatgtattactgcaaggccagctgtgtgcgtggccgcgctatctctgaatattggggccagggcacccaggtgacagtttcctct

SEQ ID NO: 1032 - DNA, 759 bp, synthetic construct
  source 1..759: mol_type = other DNA; note = Description of Artificial Sequence: Synthetic polynucleotide
caggtgcagctccaggagagcggcggaggctcagtgcaggccgggggttcattgaggctgtcctgcaccgccccagggtttactagcaactcttgtgggatggattggtatcgtcaggcccctgggaaggaacgtgagttcgtttctagtatctcaaccgatggtacaaccggctatgcagactccgtaaagggccggttcacgatctccaaagataaggctaaggacactgtttatctgcaaatgaactccctgaagcctgaggacaccggcatgtactcctgtaagactaaggacggcaccatcgctacgatggagttgtgcgacttcggatattggggtcagggaacccaggttactgtgtctagcgggggcagcggtggcagcgggggatctggccaggtgcagttgcaggaatccgggggcggttcagtgcaggcaggaggctctcttcggttgtcctgcgtcgcgagtggctatgtgtcttgtgattacttcctgccatcctggtatcgtcaggccccagggaaggaacgtgagttcgtgtccatcattgatggcactggcagtacttcctacgccgcttccgtgaagggtaggtttacagcgagtcaggataagggtaagaacatcgcctatctccagatgaacaccctgaaaccggaggacacagccatgtactattgcaaggcctcttgtgtgcgtggccgcgcaattagcgagtactggggacagggtacacaggttaccgtctcctcc

SEQ ID NO: 1033 - DNA, 768 bp, synthetic construct
  source 1..768: mol_type = other DNA; note = Description of Artificial Sequence: Synthetic polynucleotide
caggtccagctccaggagagtggtgggggcagcgtgcaggccggaggctctcttagactctcttgcaccgcccccggcttcacatccaactcctgtggcatggactggtatcgccaggctcccggcaaggagagggaatttgtgtccagcatttctaccgacggaaccacaggctacgctgacagcgttaagggacgtttcactatcagcaaggataaggccaaggacaccgtatacctccagatgaactccctcaaacccgaggacaccggcatgtatagctgtaaaaccaaggatggaaccatcgcgactatggagctgtgcgatttcggctactggggccagggcactcaagtgactgtttctagcggcgggggcagccaggtgcagcttcaggagtctggcggaggcagcgtccaagctggaggtagcctgcggctctcctgtcgcgcttctggctctacgtacagtaattattgcctgggttggttcagacagatcaccggcaaagaacgcgagggtgttgcagtcatcaactgggttgggggaatgctgtattttgccgacagtgtgaagggcaggttcacggtcagccaagaccaggccaagaataccgtctacctccagatgaactctttgaaacccgaagacaccgccatgtactattgtgctgcggagtcagcttcatctttctcttgcggaggctggctgacccgtccagaccgcgtaccttactggggccaggggacccaggtgaccgtctcctcc

SEQ ID NO: 1034 - DNA, 786 bp, synthetic construct
  source 1..786: mol_type = other DNA; note = Description of Artificial Sequence: Synthetic polynucleotide
caagtccagctgcaagagagtggagggggcagcgttcaggccggaggctctctgcgtctttcatgcaccgcgcccggtttcacttccaactcctgcggcatggactggtatcggcaggccccaggcaaggaaagggagttcgtaagctccatctccactgatggaacaaccggctatgccgattccgtcaagggccgcttcaccatcagcaaggataaggcaaaagacactgtctatctgcaaatgaactctctgaagcccgaagacaccggaatgtactcttgtaaaactaaggacggcaccattgccactatggagctgtgtgatttcgggtactggggccagggcacccaggtgacggtctctagcgggggctcagggggctctggtggctctggtcaggtgcagctccaggagtccggtggcggaagcgtgcaggctggaggtagtctgcgcctgtcttgtcgtgccagcggcagcacatatagcaattactgccttggctggtttagacagattactggtaaggagcgggagggcgtggccgtaataaattgggttggcgggatgctctattttgcagactcagtcaagggccgcttcacagtgtcccaggatcaggccaagaacaccgtgtatctccagatgaactccctgaagccggaagacaccgccatgtactattgtgccgcagagtccgcttcctctttctcttgcggcggatggctgacacgtcctgatcgtgtgccctattggggacagggcacacaggtcaccgtgtcctcc

SEQ ID NO: 1035 - DNA, 750 bp, synthetic construct
  source 1..750: mol_type = other DNA; note = Description of Artificial Sequence: Synthetic polynucleotide
caggttcagctgcaagagagcggcggtggctctgtgcaggctggtggcagcttgagactgtcctgtactgcgcctggcttcacttccaattcttgcggcatggactggtatagacaagctccgggaaaagaacgcgaatttgtgtcttccattagcaccgacggaactacaggctatgctgacagcgtgaagggacgctttaccatctccaaggacaaggcgaaggataccgtctatttgcagatgaacagtctgaaaccagaagacaccggcatgtattcctgcaaaaccaaagatggcacaatcgccactatggaactctgtgattttggctactggggccaagggacccaagttaccgtgtcttccggcggaggcagccaagtccagttgcaagagtcaggtggcggtctggtccagcccggaggctctctgaggctgagttgtgccgcttccggtttcacattctccctgagcggtatgtcctgggtacgccaggctcccggcaagggcctcgaatgggtgtccgcgatcagctctggcggggcctccacttattacacagacagcgttaaggggcgcttcacaatcagccgcgataacgcaaagaatatgttgtacttgcaactcaattctctcaagacagaagacaccgcgatgtattactgtgctaaagggggttccggctatggcgatgcctctcgtatgacttcacccggtagccagggaacccaggtgaccgtctctagc

SEQ ID NO: 1036 - DNA, 768 bp, synthetic construct
  source 1..768: mol_type = other DNA; note = Description of Artificial Sequence: Synthetic polynucleotide
caggtgcagctccaagagtctgggggcggttctgtgcaggcaggcgggtccttgagactctcttgcaccgccccaggctttaccagcaattcctgtggaatggattggtacaggcaagcgcccggtaaagaacgcgagttcgtcagctctattagcacagacggaaccactggctatgctgactcagttaagggccggttcaccatcagtaaggataaagccaaggacaccgtgtaccttcagatgaactctctgaagcccgaggacactggcatgtatagctgtaagacaaaagacggaacaatcgcgactatggagttgtgtgacttcggatactggggtcagggaacgcaggtgaccgtgtccagcggcggttctgggggtagcgggggcagcggacaagttcagctccaggaaagcggaggcgggctcgtgcagcctgggggctccctccgcctgtcctgtgcagcctcaggcttcacgttttcactgtctggcatgagctgggttcgccaggctcccggcaaaggactcgaatgggtgtccgccatctcttccggcggagcctccacctattacacagattccgtcaaaggacgcttcactatctcacgtgataacgcgaagaatatgttgtaccttcagttgaactccctgaaaaccgaggatacagccatgtattactgcgctaagggcggaagcggatacggagacgcctcccgcatgacatcccctggttcccaggggacacaggtgaccgtgtcctca

SEQ ID NO: 1037 - DNA, 741 bp, synthetic construct
  source 1..741: mol_type = other DNA; note = Description of Artificial Sequence: Synthetic polynucleotide
caggtccagctccaggaatccgggggcgggtccgtgcaggcgggtggctcccttaggctctcctgtaccgcccccggcttcaccagcaactcctgtgggatggattggtatcggcaagcaccgggcaaggagcgcgagtttgtgtcctctatcagcaccgacggcactaccggctacgcagacagcgtaaagggtcgtttcacaatctccaaggataaggcaaaggacacagtgtatcttcagatgaacagcctgaagcccgaggatactggcatgtattcctgcaagaccaaagacggaaccatcgccactatggaactctgtgatttcggctactgggggcaaggcacccaggtgacggtgtctagcggcggtggcagccaggtgcagttgcaggagtctggagggggctccgtgcaggctggaggcagcctgcgcctgtcttgcgttgcttccgggtatgtctcttgcgattacttcctgcctagctggtacagacaggcccctgggaaggagcgcgagttcgtttcaatcattgatgggacgggctccacctcctatgctgcatccgttaaggggcgctttacagcctctcaggataagggaaaaaatatcgcctacctccagatgaactctctgaagcctgaggacactgccatgtactattgcaaggcctcatgtgttcgcgggcgcggtattagtgagtactgggggcagggcacccaggtgactgtctccagc

SEQ ID NO: 1038 - DNA, 759 bp, synthetic construct
  source 1..759: mol_type = other DNA; note = Description of Artificial Sequence: Synthetic polynucleotide
caagttcagctccaggagagcggaggtgggtcagtccaggctggtggcagtctgcgtctgtcctgcactgcccccggtttcacctccaacagctgcggcatggattggtacaggcaggcacctggcaaagaaagggagttcgtgtcctctatttccactgacggaacgaccggctacgccgacagtgtgaagggaaggttcacaatctccaaggacaaggccaaggacaccgtgtatcttcagatgaactcactgaagcccgaagacaccgggatgtatagctgcaagacaaaggacgggactatcgctactatggagctgtgtgatttcggttactgggggcaaggcactcaggtgaccgttagctccggcggtagcggcggatcaggaggctctgggcaagtgcagcttcaagagtctggcggtggctccgtacaagcgggcggaagcctgagactgagttgcgtggcttccggctacgttagctgcgactactttctgccaagctggtatcgccaagctcccggcaaggagcgggagttcgtgtcaattatcgacggcactggttctacctcttacgccgcttctgtaaagggacgctttaccgccagccaggataagggcaaaaacatcgcataccttcagatgaactctctgaagccagaggacacagcaatgtattactgtaaggcttcctgcgttcgcggtcgcggtatctctgaatattggggccaggggacccaggtaactgtgtcttct

SEQ ID NO: 1039 - DNA, 768 bp, synthetic construct
  source 1..768: mol_type = other DNA; note = Description of Artificial Sequence: Synthetic polynucleotide
caggtgcaacttcaggaatctggagggggatcagtccaggccgggggtagtctgagattgtcttgcaccgctcccggatttacgtcaaactcttgcggtatggactggtatcgccaggctcccggcaaggaacgtgagttcgtgtccagcattagtaccgatggcaccacgggctatgctgacagtgtgaagggtcggtttaccatctccaaggacaaggccaaggacaccgtgtatcttcagatgaacagcctgaagcccgaagacaccggcatgtattcctgcaagaccaaggatggcaccatcgctacgatggaactgtgcgatttcggttactggggtcagggaacccaggtcaccgtgtctagcggaggcggttctcaagtgcagctccaggaatctggcgggggctccgtgcaggctggcgggtctctgcgcctgtcctgtcgggcgagcggttccacctactccaattattgtctgggctggtttagacagatcacaggcaaggaaagagagggcgtggccgttatcaactgggtcggaggtatgctttacttcgccgacagcgtcaagggcaggttcaccgtctctcaggaccaagctaagaataccgtgtaccttcagatgaactccctgaagcctgaggataccgcgatgtattactgtgcagctgagtccgtcagctctttctcttgtggaggttggttgactaggcctgatcgggtgccatactggggccaggggacacaggtcaccgtatctagc

SEQ ID NO: 1040 - DNA, 786 bp, synthetic construct
  source 1..786: mol_type = other DNA; note = Description of Artificial Sequence: Synthetic polynucleotide
caggtacagttgcaggaaagcggcggtggatctgtccaggccgggggtagcctccgcctgtcctgcacagcccctgggttcaccagcaactcatgtggcatggactggtatcgccaggctccgggtaaagagcgtgagttcgtgtcctctatctccacagatggaacgacaggctatgcagacagcgtcaaagggaggtttacaatctccaaggacaaggccaaggatacggtttaccttcagatgaactctctgaagcccgaggacaccggcatgtactcctgtaagactaaggacggaaccatcgccactatggaactctgcgatttcggctattggggacagggaacccaggtgacggtgtccagcggaggctcaggagggtccggtggcagcggacaggtccaactccaggagtctggtggaggctccgtccaggccggaggttctctgagactgtcttgtcgggcatctggatctacttacagcaactactgcctgggatggttcagacaaatcacaggaaaggagcgcgaaggtgtggccgtgattaactgggtgggcggtatgctgtatttcgcagactccgtcaagggccgcttcaccgtgtctcaggatcaggctaaaaacactgtttatctccagatgaactccctcaagcctgaggatactgccatgtattactgtgccgcagagtccgtaagctccttctcttgcgggggctggctgactcgccccgaccgtgtaccgtactggggccagggaacacaggtcacagtgtcctct

SEQ ID NO: 1041 - DNA, 750 bp, synthetic construct
  source 1..750: mol_type = other DNA; note = Description of Artificial Sequence: Synthetic polynucleotide
caggtgcagctccaggaatctggcggtggctccgtgcaggccggtggctccctcagactgtcctgcacagcgccaggcttcacgtccaactcttgcggcatggattggtatcggcaagcaccgggcaaggaaagagagttcgtttcttccatctccacggacggcacgacaggctatgcggactcagtcaaaggccgtttcactatttctaaggataaagccaaggatacagtctaccttcagatgaactccttgaaaccagaggacaccggaatgtatagttgcaagactaaggacggcacaatcgccactatggaactgtgcgacttcgggtactggggccagggcacacaggtcactgttagctccggtggcggttcacaggtccagctccaggagagcggcggtgggctggttcagccgggagggagcctgcgcctgtcctgtgccgcttccgggttcacgttttcttcctaccctatgtcttgggttcgccaggcccctggtaagggtcttgaatgggtctctacaatttctagtggtggcgacacaacgctgtatgccgactccgtcaagggtcgctttacctcaagcagggataatgctaagaacaccctctatttgcagttgaactctcttaaaactgaggataccgcaatgtattactgtgcaaaacgtatcgactgtaatagcggttattgctataagcgtagctactggggtcagggcacccaggtgacggtgtctagt

SEQ ID NO: 1042 - DNA, 768 bp, synthetic construct
  source 1..768: mol_type = other DNA; note = Description of Artificial Sequence: Synthetic polynucleotide
caggtgcaactccaggaatccggcgggggcagcgttcaggcgggaggctctctccgtctgtcctgcaccgcccccggcttcacaagtaattcctgcggcatggactggtatcgtcaggcccctggcaaagaacgggagttcgtaagctccatctcaaccgatggcacaaccggctatgcagactccgtgaaggggcgcttcaccatctcaaaggacaaggccaaagatacagtgtaccttcagatgaacagccttaaaccggaggatacaggcatgtattcttgcaagaccaaggacggcaccatcgcaacaatggagctgtgcgacttcggatactggggtcaaggcacccaggtgactgtctcatctgggggtagcggagggagcggaggcagtggtcaggtgcagcttcaggagagcggtggagggctcgtgcaacccggcggtagcctgcgcctgtcctgcgcagcttctgggtttacgttttcttcctaccctatgagctgggtgaggcaggcccctggcaaggggctggagtgggtctcaaccatttccagcggtggggataccacactctacgccgattccgtcaagggacgcttcaccagttcccgcgataatgccaagaacaccctgtaccttcagctgaacagcctgaagactgaggacactgccatgtactattgtgcgaagcggattgactgcaattctgggtactgttataagcgttcttactgggggcaaggaacccaggtgaccgtgtccagt

SEQ ID NO: 1043 - DNA, 750 bp, synthetic construct
  source 1..750: mol_type = other DNA; note = Description of Artificial Sequence: Synthetic polynucleotide
caagtgcagcttcaagaaagcgggggcggttccgtgcaggcaggcgggagcctgcgcttgagttgcaccgctccgggctttacaagtaacagctgcgggatggattggtatcgccaggcacctggaaaggagcgcgagttcgtgtcctctatttccacggacgggactaccgggtatgccgattccgtgaagggccggtttactatctccaaggacaaagccaaggacaccgtttaccttcagatgaacagcctcaagcctgaagataccggaatgtatagttgtaagaccaaggacggcaccatcgccacgatggagctgtgtgatttcggatactggggtcagggcacacaggttactgtgtccagtggaggcggtagccaggtgcagttgcaggaatctggcgggggcttggtccagcctgggggctctctgcgcctcagctgcgcggcctccggcttcacgtttagcctgagtagcatgtcttgggttcggcaagcaccgggtaagggcctggagtgggtctccgctatttccagcggcggtgctagtacctattacaccgactctgtgaaaggccgcttcacgatttcccgcgacaacgcaaagaacatgctttatctccagctgaactcactgaagacagaggacacagcaatgtattactgtgccaagggaggttccggctacggggatgcgtcacgtatgacatcccctggttcacagggcacccaggtgacggtgagcagc

SEQ ID NO: 1044 - DNA, 768 bp, synthetic construct
  source 1..768: mol_type = other DNA; note = Description of Artificial Sequence: Synthetic polynucleotide
caagtccagctccaggagtccggcgggggttccgtccaggctggcggtagcctgaggctgtcctgtaccgcccccggtttcacatctaactcctgcggcatggactggtatcgccaggctcccggaaaagaacgcgagttcgtgagttccatctccacagacggcaccactggctatgcagacagtgtgaagggaaggttcaccatctctaaggataaagctaaggacaccgtttacttgcagatgaactctctcaagccagaggacaccggaatgtactcctgtaagaccaaagatgggaccatcgcgacaatggagctgtgtgactttggatactggggacaagggacccaggtgactgtttcatccggcggttctggcgggtctggtgggtccggtcaggtgcagctccaggagtccggcgggggactggtgcagcctgggggatcactgcgcctcagctgcgctgcctcaggtttcacatttagtcttagctctatgagctgggtgcgccaggcacccggaaaggggctggaatgggtcagcgcaatcagctcaggcggggcttctacgtattacacggatagcgtgaaagggcgcttcaccatcagccgtgacaacgccaagaacatgctgtaccttcagctgaactcactgaagacggaagatactgccatgtactattgtgccaagggtggatctgggtatggtgatgcctcccgtatgacctcacctggaagccagggtacacaggtcaccgtctcctcc

SEQ ID NO: 1045 - DNA, 768 bp, synthetic construct
  source 1..768: mol_type = other DNA; note = Description of Artificial Sequence: Synthetic polynucleotide
caggtgcagttgcaggagagcggcgggggcagcgtgcaagccggtggcagcctgcggctgtcttgtaccgcccccggttttactagcaattcttgcggcatggattggtatcgccaggccccaggcaaggaaagagagttcgtgtcctctatcagcactgacggcacaaccggctacgccgattcagtgaagggccgcttcaccatctcaaaggataaggccaaggacaccgtgtaccttcagatgaactctcttaaaccggaggacactggtatgtactcttgcaagaccaaagacgggaccatcgcgactatggagctgtgcgatttcgggtactggggccagggaacacaggtcactgtctcttccggcggaggttctcaggttcagttgcaggagagcggtgggggtagcgttcaggctggcggaagcctgcggttgagttgtcgcgcatctggctctacctatagcaactattgcctgggatggttcagacagacaaccggcaaggagcgcgagggtgtggccgtcatcaactgggtcgggggtatgctgtattttgctgattccgtgaagggccgtttcaccgtgagccaggaccaggctaagaacacagtttatctccagatgaacagcctgaaacccgaggatactgccatgtactattgtgcggcagaatccgtgtcctcttttagctgtggtggctggctcacacgccctgaccgcgtcccgtactggggtcagggaacccaagtgaccgtgagttca

SEQ ID NO: 1046 - DNA, 786 bp, synthetic construct
  source 1..786: mol_type = other DNA; note = Description of Artificial Sequence: Synthetic polynucleotide
caagtgcagcttcaggagtctggcgggggctccgtacaggctgggggcagccttagattgtcatgcactgcccctggattcacaagcaacagctgtggcatggattggtatcgccaagcacctgggaaggagcgggagttcgtctccagcatttctactgatggtacgaccggctacgctgacagtgtgaagggacgcttcactatctccaaggacaaggccaaagataccgtgtatttgcagatgaacagtctcaagccggaggacaccggaatgtattcctgcaagactaaggacgggactatcgccactatggaactttgcgactttggctattggggccagggcacccaggtgaccgtaagttccgggggttccggcggaagcggcggtagcggccaggttcaacttcaggagtccgggggaggctctgtgcaggccgggggctctctgagactgtcctgccgggcctccggctccacatactctaactactgcctgggatggttccgtcagactacaggcaaggagcgcgagggtgttgcagtcatcaactgggtagggggaatgctgtatttcgccgattcagtcaaaggacgcttcactgtgtcccaagaccaggccaagaacacagtctatcttcagatgaacagcctcaagcccgaggataccgctatgtactattgcgcagctgagagcgtgtccagcttctcttgcggaggctggctgaccaggccggatcgggtgccctattggggtcaaggcacacaggtgacagtttcaagt

SEQ ID NO: 1047 - DNA, 768 bp, synthetic construct
  source 1..768: mol_type = other DNA; note = Description of Artificial Sequence: Synthetic polynucleotide
caggtgcagctccaggagagtggaggtgggtccgtgcaggcgggaggtagcctgcggctgtcctgtactgcgcccggctttaccagtaacagctgcggcatggactggtatagacaggcccccggaaaggaacgcgagtttgtcagcagtatctctactgatggcaccactggatatgcggactccgtgaagggtcggttcaccattagcaaggacaaggcaaaggataccgtgtatttgcagatgaacagtctcaaaccagaggacacaggcatgtatagttgcaaaaccaaggacgggaccatcgccactatggaactctgtgattttgggtattggggccaggggactcaggtgaccgtcagctccgggggcggttcccaagttcagttgcaagagtctggaggcggatcagtgcaggccgggggctctctgcggcttagctgccgtgcttctcgcagcccttatgggaactactgtcttggctggttcaggcagagtacaggtaaggaacgcgaaggggtggccgtcatcaactgggtgggcggaatgctctatttcgctgactctgtgaagggccgtttcacagtgtcccaggaccatgctaagaacactgtcaccctccagatgaacagcctgaagccagaggacaccgctatgtattactgcgcagccgagtctgtgtccagtttctcatgcggtgggtggctgaccagacctgatcgcgttccatactggggacaagggactcaggtcacagtgtcctct

SEQ ID NO: 1048 - DNA, 786 bp, synthetic construct
  source 1..786: mol_type = other DNA; note = Description of Artificial Sequence: Synthetic polynucleotide
caggtgcagctccaggagtccgggggtggctccgttcaggcgggaggctctttgcgtttgtcctgcaccgcacccggtttcacaagtaactcctgcggcatggactggtatcgtcaggctccaggcaaggagcgcgagttcgtgagttctatctccacagacggcaccacgggctacgccgacagtgttaagggtcgctttactatctcaaaggataaggcgaaggacaccgtataccttcagatgaactccctcaagcctgaagacaccggaatgtatagctgtaagaccaaggacggcaccatcgccacaatggagctgtgcgactttggatactgggggcagggaacacaggtgacagtatccagcgggggctctggcggttccggcggttccggccaggtccagttgcaggagtctggtggcggtagcgtccaggctgggggcagcctgcggctgtcctgtcgcgcatcaagaagcccttacggcaattattgtttgggctggttccgccaatcaactggtaaggagagagaaggagtcgctgtcattaactgggtgggcggtatgctttattttgccgatagcgtgaaggggcgcttcacggtgtctcaggaccatgccaagaataccgttacgttgcagatgaacagcctgaaacccgaagacaccgcaatgtattactgtgccgctgagtccgtatcctctttctcctgtggaggctggctgacacgccccgaccgcgtgccttattggggccaagggacccaggttaccgtgtcctcc

SEQ ID NO: 1049 - DNA, 750 bp, synthetic construct
  source 1..750: mol_type = other DNA; note = Description of Artificial Sequence: Synthetic polynucleotide
caggtgcagttgcaggaaagtggtggaggcagcgtgcaggcaggaggctctctgcgcctgagctgcacagcgcctggctttacctccaacagctgtggaatggactggtatcgccaggctcccggtaaggagcgggaatttgtcagctccatttccaccgacggcaccactggctacgccgattccgtcaagggcaggttcacaatctcaaaggacaaagccaaggacacagtgtatctccagatgaactccctgaagcctgaggacacaggtatgtatagctgcaagactaaggacggcacaatcgccacgatggaattgtgcgacttcggatattggggacaaggtactcaggtgaccgtctcctctggagggggctcccaggtgcagctccaggagtctggcggtggcctggtgcagcccggtgggtctctgcggctgagttgtgctgcgtctggattcaccttttcccacagcgggatgtcatgggtgaggcaggcacccggcaagggcctggagtgggtgagcacaattaactccgggggtgcttccacgtactataccgatagcgtgaagggcaggtttaccatctcacgcgacaacgcgaagaacatgctgtatcttcagctgaatagtttgaagaccgaggacaccgctatgtattactgcgccaaaggcggttctggctacggggacgcctcccgcatgacaagccctgggtctcagggcacacaggtgaccgtgtcttct

SEQ ID NO: 1050 - DNA, 768 bp, synthetic construct
  source 1..768: mol_type = other DNA; note = Description of Artificial Sequence: Synthetic polynucleotide
caagttcagcttcaggaatcaggtggcggtagcgtgcaggctgggggctccttgagattgtcctgcacggccccaggattcaccagcaactcttgcgggatggattggtatcgccaggctccggggaaggagagggagttcgtaagctccatttcaaccgatgggaccactggatacgctgactccgttaagggtaggttcacgatcagtaaggacaaggccaaggatacagtgtatcttcaaatgaactcactgaagcccgaggacaccgggatgtactcctgtaagaccaaagatggcactatcgcaacgatggagctgtgcgacttcggctattggggccagggaacccaggttactgtgtccagcggaggcagcggcggttctggaggctctggacaggtccaactccaggaatctgggggcggtctcgtgcagccaggtgggtcactgcgcttgtcatgtgcggcctccggtttcaccttcagccattctggaatgagctgggtgcgtcaagcaccgggcaaaggcctcgaatgggtctctactattaacagcggaggtgcatctacctactatacagacagcgttaaggggaggttcaccatctctcgcgataatgctaaaaacatgctgtatttgcagcttaattcactgaagacggaggacacggccatgtactattgtgccaagggtgggtccgggtacggtgacgcctctcgcatgacctccccaggaagtcagggcacccaggtgaccgtgtcatcc

SEQ ID NO: 1051 - DNA, 765 bp, synthetic construct
  source 1..765: mol_type = other DNA; note = Description of Artificial Sequence: Synthetic polynucleotide
caggtgcagctccaggaatctggcggtggcagcgtgcaggccggtggctccctgaggctgtcctgtgctgcctctggatacccatactccaacgggtacatgggctggttccgtcaggcccctggaaaggaacgtgagggcgtggccactatttacaccggcgacggtcgtacttattacgccgactccgtgaaaggccgcttcaccatttctagggataacgctaagaacacagttgacctccagatgtctagcctgaaacctgaggataccgccatgtattactgcgctgccagggctgccccactctacagctctggttctcccctgacacgcgccaggtataacgtgtggggacaggggacccaggtcacagtgagttctggcgggggttctcaggtgcaactccaggaatctggcggaggcctggtccagcctggtggctcccttcgcctgagctgtgcagcctctggcttcacattcagctcctatcctatgtcctgggtgcgccaggcccctgggaagggcctggagtggatctccaccatctctgcgggtggcgacactacactctacgccgacagcgtgaagggccgctttacctccagtcgcgataacgctaagaatacactgtacctccagcttaacagcctgaagacagaggacgctgcaatctattactgtgccaagaggatcgactgcaacagcggatattgctaccgtaggaattattggggccagggaacccaggttaccgtatcatcc

SEQ ID NO: 1052 - DNA, 783 bp, synthetic construct
  source 1..783: mol_type = other DNA; note = Description of Artificial Sequence: Synthetic polynucleotide
caagttcagttgcaggaatccggtggcggtagcgtgcaggctggtggcagcctgcgtctgagctgcgctgcatccgggtatccgtacagcaacggttacatgggatggttccgccaagctcctgggaaggagcgcgaaggcgtggcgaccatttacaccggagacggacgcacttattacgccgactcagtgaagggccgctttacgatctctcgggacaacgctaagaataccgtggacttgcagatgagttccctgaagcctgaggacaccgcaatgtattactgtgccgcacgcgctgcgcccctctacagctctggttctcccctgacccgtgcccgttacaatgtatggggacaaggcacccaggtgaccgtgagtagcgggggaagcggaggcagcgggggatctggccaggtgcagctccaggaaagcggcgggggcctggtccagcccggtggcagcctgcgcctgtcctgtgctgccagtggattcaccttttcttcctatcctatgtcatgggtccgccaggcacctggcaagggcctggagtggatttccactatctcagctggcggagacacaactctctacgcggactctgtaaagggtcggtttacgtcttcccgcgacaacgccaagaataccctgtaccttcagttgaactcccttaaaaccgaagatgcagctatctactattgtgcgaagcgtattgattgcaactccggttactgctaccggcgtaactactggggtcaaggcacacaggtcacagtctcctcc

SEQ ID NO: 1053 - DNA, 765 bp, synthetic construct
  source 1..765: mol_type = other DNA; note = Description of Artificial Sequence: Synthetic polynucleotide
caagtccagctccaagagagtgggggcggttccgtgcaggctggaggctccctcagattgagttgtgcggctagtggctatccctatagcaacggctacatgggctggttccgccaggcccccggcaaggaaagggagggtgttgcaaccatctacacaggagatggccgcacttactatgcagactccgttaagggtcgtttcaccatttcccgcgataacgctaagaatacagtggatcttcagatgtccagcctcaaaccagaggatactgcaatgtattactgcgcagcgcgggccgcgcccctgtactcttccggctctccactgacccgcgctcgctacaacgtgtggggccaaggcacgcaggtcacagtttcttccggcgggggcagccaggtccagctccaggaaagtggcgggggcctggttcagcccggcggttccctgcgcctcagctgtgctgcctctgggtttaccttcagcctgtcaggcatgagctgggtgcggcaggctcctggcaagggtctggaatgggtttccgccatttcaagcggcggggcctctacctattacacagactccgtgaagggccgtttcacgatcagtcgcgacaacgcgaaaaacattctctatctccagctgaacagcttgaagaccgaggacactgcgatgtattactgtgccaaagggggatcaggatacggcgatgcgtctcgcatgacttccccaggttcacagggcactcaggttaccgtctcttcc

SEQ ID NO: 1054 - DNA, 783 bp, synthetic construct
  source 1..783: mol_type = other DNA; note = Description of Artificial Sequence: Synthetic polynucleotide
caggtacagcttcaagaaagcggcgggggaagcgtgcaagctggcgggagccttaggctgagttgcgcggcctcaggttacccctatagcaacggatatatgggatggttccggcaggcaccggggaaggaacgcgagggagtggccaccatttacaccggggacgggaggacctactatgccgactctgtgaagggccgtttcactatctctagggataacgcgaagaacacagtggacttgcagatgtcatctctcaagccggaggacactgccatgtattactgtgcggctcgtgccgctcctctctacagctccgggagtccactgacccgcgcaaggtacaacgtgtggggtcagggaactcaggtgaccgtttcatccgggggcagcggtggctccggtggctctggtcaggttcagctccaggaaagcgggggcgggctggtgcagcccggaggctccctgcgtctttcttgcgctgccagtggctttaccttttccctgagtggaatgagctgggtgaggcaagcgccaggcaagggactggaatgggtgagcgcaatcagttcaggcggggccagtacttattacactgactccgtcaagggtcggtttaccatctctcgggataacgctaagaacatcctttatttgcagctcaactccttgaagacggaagacaccgctatgtattactgcgctaaaggagggagtggatacggagacgcatctcgcatgaccagtccaggttcccagggaacccaggtgactgtgtcaagc

SEQ ID NO: 1055 - DNA, 756 bp, synthetic construct
  source 1..756: mol_type = other DNA; note = Description of Artificial Sequence: Synthetic polynucleotide
caggtccagcttcaggaaagcggcggtgggtctgtccaggcaggtggctctctgagactgtcctgtgctgccagcgggtatccgtactcaaatggctacatgggctggttccgccaggcccctggaaaggagcgcgagggcgtggccacgatctataccggggacggacgcacctattacgctgacagtgtcaaaggtagattcactatcagccgggacaacgcgaagaacaccgttgaccttcagatgtcaagcctgaagcctgaggacactgccatgtattactgcgctgcaagggctgcccctctttacagctccggctctccccttacaagagcccggtacaacgtctggggccagggaactcaggtgaccgttagctccggcgggggctcccaggtgcagctccaggagtccggtggcggaagtgttcaggcgggcggaagtctgcgcctgtcttgcgtggcctctggatacgtctcctgtgactatttcttgcccagctggtatcgccaggctccgggaaaagagagagagttcgtgagcatcattgacggcactggctccaccagctacgcagcctccgttaagggtcgctttaccgcctcagaggataagggtaagaacatcgcatacttgcagatgaacagtctcaagcccgaggataccgctatgtattactgcaaggccagctgcgtccggggtcgcgctgtctccgaatactggggacagggcacccaggtgaccgtatctagt

SEQ ID NO: 1056 - DNA, 774 bp, synthetic construct
  source 1..774: mol_type = other DNA; note = Description of Artificial Sequence: Synthetic polynucleotide
caggttcagctccaggagagtggcggagggagtgtgcaagctggcggttctttgcgcctctcttgtgctgcctccggttatccctacagtaacggctatatgggctggtttcgccaagcaccagggaaggaacgggagggggtcgccaccatttatactggcgatggccgcacctattacgccgactccgtgaaaggtcgcttcaccatcagtcgggacaatgcaaagaacactgtagacttgcaaatgtcttccctcaagcctgaggatactgctatgtactattgcgctgcaagggcagctcccctgtactctagtggctctcctctgacccgcgctcggtacaacgtctggggtcagggaacccaggttaccgtctctagcgggggctcaggtggcagcggcggttccggccaggtccaactccaggagtccggcggtggctccgttcaagccggaggcagtctgagactgagctgcgtggcgtccggttacgtctcctgtgactacttcctgcctagctggtatcggcaagcgcctggtaaggaaagagagttcgtgagtatcattgatgggaccggctccacctcctacgccgcatctgttaaggggcgcttcacagcttccgaagacaagggaaagaacatcgcttatcttcagatgaactctctcaaacctgaagacacggctatgtactattgcaaggcctcctgtgtacggggtcgcgccgtgtccgagtactgggggcaggggacacaggttaccgtatccagc

SEQ ID NO: 1057 - DNA, 768 bp, synthetic construct
  source 1..768: mol_type = other DNA; note = Description of Artificial Sequence: Synthetic polynucleotide
caggtgcagctgcaagagagcggcggaggcagcgtgcaagctggaggctctctccggctttcatgcgctgccagcggctatccttatagcaacggctacatgggctggttccgccaagcgcccggcaaggagcgcgagggggtggcgacgatttatacgggggacggcaggacttattacgcagactccgtcaaagggcgcttcaccatctcccgcgacaacgccaaaaataccgtcgatcttcagatgtcaagcctcaagcccgaggatacagccatgtactattgcgcagcccgcgccgcacccctctattcctcaggatctccactcacacgcgcccggtacaatgtgtggggtcaaggaacccaggtgaccgtatccagcgggggcggttctcaagtccagcttcaggagtccggcggaggccttgtgcagcccggagaatctctgagactgtcctgtactgccagcgggttcaccttttctaactacgcgatgagctgggtacggcaagcgcccggaaagggtctggaatgggtcagcggaatcaatgttgcctacggcatcacttcttacgccgacagtgttaagggccgcttcactattagtcgtgacaacaccaaaaacactctgtatctccagctcaacagcctgaaaacagaggatactgcgatttactattgtgtcaaacactctggcaccactatcccaagggggttcatctcctacactaagcgcggtcagggaacccaggtgaccgtgtcatcc

SEQ ID NO: 1058 - DNA, 786 bp, synthetic construct
  source 1..786: mol_type = other DNA; note = Description of Artificial Sequence: Synthetic polynucleotide
caggtgcagttgcaggagagtggtggcggaagcgtgcaagctggcggaagcctgagactgagctgcgctgcgagcggctacccttactcaaatggctacatggggtggttccgtcaggcccccggcaaggagcgtgagggggtggccacgatctacactggagatggccgcacttattacgccgattctgttaaggggagattcacaatcagccgcgacaatgctaagaacaccgtggaccttcagatgtccagcctcaaaccggaagacactgcaatgtattactgtgcggcccgtgccgcgccgctttactcttcagggtcacctctgacccgcgctcggtacaatgtatggggccagggtacacaggtgaccgtgtctagcggaggcagcggtggctcaggaggttctgggcaagtccagctccaagagtcaggtggcggtctggtgcagccaggtgaaagcctgcgtctttcctgcactgccagcggctttaccttctccaactatgccatgtcctgggtgcgccaagctccggggaagggcctggaatgggtatccggcattaacgtggcctatgggatcacaagttacgctgactctgtgaagggcagatttactattagcagagacaacaccaagaataccttgtacttgcaactgaactccctcaagaccgaggatacagccatctactattgcgtgaaacacagcggcactacaatcccgcgcggctttattagttatacgaagaggggacaaggtacgcaggtgaccgtgtccagc

SEQ ID NO: 1059 - DNA, 756 bp, synthetic construct
  source 1..756: mol_type = other DNA; note = Description of Artificial Sequence: Synthetic polynucleotide
caggtgcagttgcaggagtccggcgggggcagcgttcaggctgggggctctctcagactgtcctgtgccgcgagcggctatccatacagtaacggatacatgggctggttccgccaagcgcccggcaaggagagggagggtgtcgccactatctacacgggggatggccggacttattacgcggatagcgtgaaaggtcgttttaccatctcccgcgacaacgcgaagaacaccgtggatttgcagatgtctagcctcaaacccgaggacacggctatgtactattgcgcagcccgtgccgcacctttgtattcctctggttcacccctcactagggccagatataacgtgtggggacaggggacccaggtgactgtgagttctgggggtggctcccaggtgcagctccaggagagcggaggtggctccgttcaggcgggaggctccctgaggctgtcttgcaccgcctctggatacgtttcctgcgactatttcctcccctcctggtacagacaggcacccggaaaggaacgcgagtttgtgagcgtcatcgacggaacagggagcacctcctatgcggcctcagtgaagggcagattcacagcttcccaagacaagggtaagaacatcgcataccttcagatgaactccctgaaacccgaagataccgccatgtattactgcaaagcatcttgcgttcggggaagggcaatcagcgaatactggggccagggcacgcaggtgaccgtgtcctct

SEQ ID NO: 1060 - DNA, 774 bp, synthetic construct
  source 1..774: mol_type = other DNA; note = Description of Artificial Sequence: Synthetic polynucleotide
caggtgcagcttcaagagagtggtggagggtccgtccaggccgggggttctctgaggttgtcctgcgcagccagcggttacccctactccaacggctatatggggtggttccgtcaggccccaggcaaggaacgcgaaggggtcgcaacaatctacacaggtgatggccgcacttattacgctgatagcgtgaaaggtcggttcaccatttctcgggacaacgccaagaacaccgtagatttgcagatgtcttccttgaaacccgaggacactgccatgtattactgcgctgcacgggctgccccactctatagttccggctccccactcacacgcgccagatacaacgtgtgggggcaagggacacaggtcactgtgtctagtgggggctccggtggcagcggaggtagcggccaggttcagcttcaggaatctggcggaggctccgtgcaagccggtgggagcctcagactgtcttgtactgccagcgggtacgtaagctgcgactacttcctgccttcctggtatcgccaagctccagggaaggaacgtgagttcgtatctgtgatcgacggaacaggctctacatcttatgcagcttcagtgaaggggagattcacagccagccaggacaagggtaaaaacattgcttatctccagatgaactcactcaagccggaggacaccgctatgtattactgtaaagcatcctgcgtgagaggacgggctatcagcgaatactgggggcagggaacccaggtgaccgtgagcagc

SEQ ID NO: 1061 - DNA, 753 bp, synthetic construct
  source 1..753: mol_type = other DNA; note = Description of Artificial Sequence: Synthetic polynucleotide
caggtgcagttgcaggagtccgggggaggttccgtccaggccgggggaagtctgcgcttgtcatgcgctgccagcggctatccctactccaacggctatatgggctggtttaggcaggcccctgggaaggaacgcgaaggcgtcgcgacgatctacacgggcgatgggaggacctattacgcagattccgtaaagggcagatttaccatctcccgtgataacgccaagaataccgttgacctccagatgtcctctctgaaacccgaggataccgccatgtactattgcgccgctcgcgccgctcccctctacagctctggatcaccactgacccgcgctaggtataacgtgtggggtcaggggacacaggtgaccgtcagctctgggggaggctcccaggttcagctccaggagtctggagggggccttgtgcagcccggcgggtccctccgtctgagttgtgctgcctcaggctttagtttctcttcctacgctatgaaatgggtccgtcaagcgcccggcaaaggcctggagtgggtctctaccattagctccgggggttccagcacgaattatgctgactccgtcaaaggcaggttcactatcagccgcgacaacgccaagaataccctgtacttgcagctcaacagcctgaagatcgaggacaccgcgatgtattactgcgctaaagccatcgtgcctactggagcgacgatggaacgcggacagggcactcaggtcaccgtgtccagc

SEQ ID NO: 1062 - DNA, 771 bp, synthetic construct
  source 1..771: mol_type = other DNA; note = Description of Artificial Sequence: Synthetic polynucleotide
caagtgcagctgcaagaatcaggcggaggcagtgtccaagctggcggtagtctgcgcctgagctgcgccgcatcaggctacccatactctaacggctatatggggtggtttaggcaagcccccggcaaggagcgcgaaggcgtggcgaccatctacactggtgatggccgcacttactatgcggactctgtgaaaggacgcttcacaatttctcgtgacaatgctaagaacactgtggatcttcagatgagttccctgaagcccgaagacacggcgatgtattactgtgctgccagagccgctccgctgtactccagcggcagccccctcacccgcgcccgttataacgtctgggggcagggcacccaggtcactgtttcttccggtggcagtggaggctctgggggcagcggacaagtacaactccaggagtcaggcgggggcctggttcagccagggggttccctgcgcctgagctgtgccgcttctggcttttcattctcttcctatgccatgaagtgggtgcgccaggcccctgggaagggactggagtgggtgagcaccatttcaagtggaggtagctccaccaactacgcggattccgtcaaaggccgcttcaccatttccagggacaacgctaaaaacaccctgtatcttcagctcaactccctgaagatcgaagacactgctatgtactattgcgccaaggccatcgtccccacaggtgccacaatggagaggggccagggcacgcaggtgacagtcagcagt

SEQ ID NO: 1063 - DNA, 765 bp, synthetic construct
  source 1..765: mol_type = other DNA; note = Description of Artificial Sequence: Synthetic polynucleotide
caggtgcagctccaggaatccggcggaggctccgtgcaggctggcgggtcccttaggttgtcttgcgctgccagcggatacccttacagcaatggatatatgggttggttccgccaggcccctggcaaggagagagagggagtggccaccatctacacgggtgacgggcgtacctactatgccgattccgttaagggcaggttcacaatctcccgcgacaacgccaagaacaccgtggacctgcaaatgtcttcccttaaacccgaagacactgccatgtattactgcgctgcccgcgcggccccactctacagctctgggagccctttgacccgtgctcgctataacgtgtggggccagggtactcaggtgaccgtctcaagcggcggaggctctcaggtgcagctccaggagtcaggtggaggtttggtgcagccaggaggctcactgagactgagctgcgctgccagcgggttcactttctcctcttatcctatgtcctgggttcgccaggcacccggcaaaggcttggagtggatcagcaccatcagtgcgggtggcgacacaactttgtacgccgactctgtgaagggtcgttttacctccagtcgcgacaatgctaaaaacacactgtatctgcaactgaactctctgaagaccgaggacaccgccatctattactgtgccaaaagaattgactgtaacagcggatattgctatagacgcaactattggggtcagggcacacaggttaccgtgtcctca

SEQ ID NO: 1064 - DNA, 783 bp, synthetic construct
  source 1..783: mol_type = other DNA; note = Description of Artificial Sequence: Synthetic polynucleotide
caagtccagctccaggaatccggcggtggcagcgttcaagccggtggctccctgcgcctgagttgtgcagcttcaggttatccctacagcaacggatacatgggatggttccgtcaggctcccggtaaggagcgtgagggtgtggcaactatctatacgggagatggcaggacctactatgcggactctgtgaagggcaggttcacgatctctcgtgataacgctaagaacaccgtcgatctccagatgtcttccttgaagcctgaggatacggctatgtattactgcgccgcgagagctgccccgctctattcctctggcagtcctctgactcgggcacggtacaacgtgtggggccaaggcacccaggtcactgtgtcctctggcggtagcggtggctctggcggttcaggtcaggtgcagctgcaagaatccggtggaggcctggtgcagcccggcggttccctccgtctgtcctgtgctgcatctggattcactttttctagctacccaatgtcatgggtgcgccaggccccaggcaaagggctggagtggatctcaactatctccgcaggtggcgatactaccctctacgctgactccgtgaaggggcggtttaccagttcccgtgacaacgccaagaacactttgtatcttcagctgaactcattgaagactgaggacaccgccatctattactgcgctaagagaatcgactgcaactcagggtactgctatagacgcaactattggggccaggggactcaggtgaccgtgtcaagc

SEQ ID NO: 1065 - DNA, 765 bp, synthetic construct
  source 1..765: mol_type = other DNA; note = Description of Artificial Sequence: Synthetic polynucleotide
caggtgcagttgcaggaaagcggcggtggctccgtgcaggctgggggctctctgcgtttgtcatgtgccgcaagtggatacccctacagcaacggctacatgggctggttcaggcaggctcccggaaaggagcgcgaaggggtggccaccatctacactggggatggaaggacttactatgcggatagcgtaaaggggcgttttactatctccagagacaatgccaaaaacacagttgacctccagatgtctagcttgaagcctgaagacactgccatgtactattgtgcagcgcgggcagccccgctgtatagctccggctcccctctgacacgcgcccgctacaacgtgtggggacagggcacccaggttaccgtgagttccggcggtgggtcccaggtccagcttcaggagtccgggggcggttccgtccaagttggtggcagcctgcgcctgtcctgcgctgcctccgggtttactttcagttcctacccaatgtcatgggtgcgccaggctcctggtaaggggctggaatggatttctactatcagtgcaggcggagatacgaccctctacgccgatagcgtgaaggggcggttcacttcatctcgtgataacgccaagaacaccctgtaccttcagctgaactccctgaagacggaagacaccgccatttattactgcgcgaagaggatcgactgcaactccggctactgctatcgtcgcaactattggggccagggtacgcaggtgacggtcagttcc

SEQ ID NO: 1066 - DNA, 783 bp, synthetic construct
  source 1..783: mol_type = other DNA; note = Description of Artificial Sequence: Synthetic polynucleotide
caggtgcagctccaggagtcaggcggtggctctgtgcaggccggagggtctctccggttgagttgtgcagcttcaggctacccttatagcaacggctacatgggatggttcagacaggcacccggtaaggaacgcgagggcgtagccacgatctacactggtgatgggaggacctattacgctgactctgtgaaaggtcgcttcacaattagtcgcgataacgctaagaacaccgtggatctccagatgagcagtttgaagcctgaggacaccgcaatgtactattgtgctgcacgcgcggcccctctctacagttccggcagcccactgactagagcccggtacaacgtctggggccaaggcacccaggtcaccgtcagtagcggcgggagcggaggctccggtggctccggccaggtgcagctccaggagtctggaggcggatctgtccaggttggagggagcctgcgcttgagttgcgctgccagcggattcaccttttcttcataccccatgagctgggtgcgccaagcgcccggaaaggggctggagtggatctcaacgatcagcgccggaggtgatacaaccctctacgcagacagcgtcaaaggcaggtttacatctagccgcgacaacgcaaagaacaccctgtatttgcagctgaacagcctgaaaacggaagacaccgccatctattactgcgccaaaagaattgattgcaattctggttattgttacagacgcaattactggggacaggggacccaggttacagtctccagt

SEQ ID NO: 1067 - DNA, 780 bp, synthetic construct
  source 1..780: mol_type = other DNA; note = Description of Artificial Sequence: Synthetic polynucleotide
caggtccagcttcaggaaagcggcgggggtagcgtccaggcaggtggcagcctgcgtctgagctgtgcggccagcggttatccttactccaacggttacatgggctggttccgccaggcccctggcaaggagcgtgagggagtggccaccatctacactggagatggaagaacctactatgcagattcagttaagggcaggtttacaatcagccgcgataatgccaagaacacagtcgatctccagatgtcctctctgaagcccgaagacactgccatgtattactgtgctgcacgcgctgccccgctgtattcttcaggtagtcccctcacacgcgcccgctacaacgtgtgggggcagggtacacaggtaactgtgtctagcggcggtgggagccaggtccagctccaggagtctggtggcggatctgtgcagagcgggggttccctgcgcctgtcctgtgctgcctctgggttcacgtatagcacttccaacagctggatggcctggttccgtcaagcgcctggaaaggagcgtgagggggtggctgccatctatacagtgggaggttctatcttttacgcagacagcgtgcgtggacgtttcacaatctctcaagacgctactaagaatatgttttaccttcagatgaacactctcaagcccgaggacaccgcaatgtattactgcgctgcggcatctggccgcctgagaggcaagtggttttggccctacgagtataattactggggccagggcacgcaggtgacggtctctagt

SEQ ID NO: 1068 - DNA, 798 bp, synthetic construct
  source 1..798: mol_type = other DNA; note = Description of Artificial Sequence: Synthetic polynucleotide
caagttcaacttcaggagagtgggggtggctctgtgcaggccggtggctctctgagactcagttgtgctgcctccggttacccttattccaacggctacatgggctggttccgtcaggccccaggcaaggagcgcgaaggcgtcgccaccatttacacaggcgacggacgcacatactatgctgattctgtgaagggcagatttaccatcagccgggataacgccaaaaataccgtggaccttcaaatgagttctctgaagcctgaggataccgccatgtattactgcgccgcgcgggcagctcccctctacagcagtggttccccgctgacccgcgcccgctataacgtgtggggccaaggcacacaggtgaccgtgtccagcgggggctccgggggctctgggggctcaggacaggtccagttgcaggaatctggcggtggcagcgttcagagtggaggttccctgcggctctcttgtgccgcttccggcttcacctactcaacctctaatagctggatggcctggttccgtcaagcccccggcaaggagcgcgaaggcgtggctgcaatctacaccgtaggcggatctatcttctacgccgattcagtgcgcggcaggtttaccatctcacaggacgccactaagaatatgttttatttgcagatgaatactctgaagcctgaggacaccgctatgtattactgcgctgcggccagtggccgcctgaggggcaagtggttctggccatacgaatacaactactggggacaggggacccaggttacagttagtagc

SEQ ID NO: 1069 - DNA, 783 bp, synthetic construct
  source 1..783: mol_type = other DNA; note = Description of Artificial Sequence: Synthetic polynucleotide
caggtgcagttgcaggaatctgggggtggcagtgtgcaggctggaggctccctgcgcctgtcctgtgcggcctctggctatccatatagtaatggttacatgggatggtttaggcaggctccgggcaaggagcgcgagggcgtggccactatctacactggtgatggtcggacctactatgctgactctgtgaaggggcgcttcacaatttctcgggataacgccaaaaataccgtggacttgcagatgagttccctcaaaccggaagacaccgccatgtattactgtgcagctagggcggcaccgctgtatagttctggcagccctctgactcgggctcgctataatgtctggggccagggaacccaggttacagtctccagcgggggtgggtcccaagtgcagttgcaggaatccggtgggggttccgttcaggccggaggctcactgcggctgtcttgcagagcgtccggctccacttactctaactattgcctgggctggttccgtcagattactggcaaggagagggagggcgtggccgtcataaattgggtgggaggtatgctgtactttgccgattcagttaaaggacgttttacggtgagccaggaccaggctaagaacaccctttaccttcagatgaacagcctgaagcccgaagacacagccatgtactattgtgctgcggagtccgtgtctagcttttcttgcggaggctggctcacgagaccggatagagtgccatactggggccagggcacccaggtgaccgtctccagc

SEQ ID NO: 1070 - DNA, 801 bp, synthetic construct
  source 1..801: mol_type = other DNA; note = Description of Artificial Sequence: Synthetic polynucleotide
caggtgcagctccaggaaagcggaggcgggtctgtccaggcagggggctccctgagactctcttgtgctgcgagcggttatccttatagcaacgggtatatgggatggtttcgccaggctccggggaaggagcgcgagggtgtggctaccatctatacgggtgatggtcggacttactatgcagacagtgtcaagggccgcttcaccatcagcagagacaacgcaaaaaataccgtggacttgcagatgtcatccctcaagccagaggacacagcaatgtattactgcgccgcgagagctgcgcccctgtactcctctggatctcccttgaccagagcccgctataatgtctggggacagggaacccaggtaacagtgtccagcggaggttccgggggttctggaggttctggacaggttcaactccaggagtctggcgggggctcagtccaggctggcgggtctttgcgcctgtcctgtcgggccagcggctccacctactccaactactgcctcggttggttccgccagattactggcaaagagcgtgagggcgtggctgttatcaactgggtgggcggaatgctgtacttcgccgattctgttaagggacgcttcaccgtctctcaggaccaggccaagaacacgctgtatttgcagatgaacagtctgaagccagaggatacagcaatgtattactgtgctgcggagtctgttagctctttttcctgtggtggctggctgaccaggccggatcgcgtgccttactgggggcagggaacccaggtgactgtcagcagt

SEQ ID NO: 1071 - DNA, 783 bp, synthetic construct
  source 1..783: mol_type = other DNA; note = Description of Artificial Sequence: Synthetic polynucleotide
caggtgcagcttcaggagtccggcggaggcagtgtccaggcagggggctccctgcgcctctcttgtgcggcctctggatatccctactctaacggatacatgggctggtttcgtcaggccccaggaaaagagcgggagggggtggcgacaatctacactggcgatggccgcacctactatgctgattccgttaaggggcgcttcaccatcagcagagacaacgcaaagaacactgtcgatcttcagatgagttccctcaaacctgaagacacagccatgtattactgtgcagcccgcgcggcccctctttacagctctgggagccccctgacacgcgctcgctacaatgtttggggtcagggcacacaggtgacagtctcctctggcggaggctcccaagtccagcttcaggaatccggcggtgggagtgtgcaagctggtggatctctgcgcctgagctgtagggcctccggcagcacatactctaactactgcctgggctggtttaggcagtccacaggaaaagaacgcgaaggagtcgcggtaataaattgggtcgggggtatgctctacttcgccgactccgtgaaaggccgcttcacagtgtctcaggatcacgccaaaaataccgtaacccttcagatgaactccttgaagccagaggacaccgcgatgtattactgcgctgcggagtccgtatccagcttcagctgtggtggctggctgacccgcccaggacgggttccatactggggccagggtacacaggtcacagtgtctagc

SEQ ID NO: 1072 - DNA, 801 bp, synthetic construct
  source 1..801: mol_type = other DNA; note = Description of Artificial Sequence: Synthetic polynucleotide
caggtgcagctccaggagtccggcggagggtccgtccaggccggaggttccctccgtctgtcttgcgccgcgtccggttatccttacagcaacggctatatgggttggttccgtcaggcccccggaaaggaaagagaaggcgtcgccacgatctacaccggggatggcaggacctactatgctgactccgtgaagggccgcttcacaattagtcgcgacaatgccaagaacacggtggacctccagatgtcttcacttaaacccgaggacaccgctatgtattactgtgcagccagagcagctcctctgtactcctcaggctctcccctcacccgtgctcgctacaacgtgtggggacagggcacacaggtcacagtgtcatccgggggttccggtggcagtggaggcagcggacaggtacagcttcaggagtccggcgggggttctgtgcaggctggaggctctttgcgccttagctgtcgcgcgagcggttccacctactccaattactgcctgggttggttcaggcagagcaccggcaaggagcgcgaaggagtggccgtcatcaactgggtcggtgggatgctctattttgctgactctgtgaagggcaggtttactgtgagccaggaccatgccaagaacactgtgactctccagatgaatagtcttaaaccagaggacacggctatgtattactgtgcagccgaatcagtctcctctttctcttgtggtgggtggttgacgaggccgggtcgtgttccctattggggccaggggacccaggtgactgtatcctct

SEQ ID NO: 1073 - DNA, 783 bp, synthetic construct
  source 1..783: mol_type = other DNA; note = Description of Artificial Sequence: Synthetic polynucleotide
caggtgcagctccaagagtccggtggcgggagcgtgcaggcgggcggttcccttcgcctgtcttgtgctgcctccggctacccctactctaatggctacatgggctggttccgccaagctccagggaaggaaagggaaggcgtggccactatttacacgggcgacggtcgcacatattacgctgactctgttaaaggccgcttcactatctccagagacaacgcaaagaacacggtggacctccagatgtcctctctgaagcccgaagacaccgctatgtattactgcgctgcaagggctgcccctctgtactccagcggttcccctctgaccagagcccgctataacgtctggggccaaggaacacaggtcactgtcagctccggtggcgggtcacaggtgcagcttcaggagagcggcgggggcagtgtccaagctggtgagagcctcagactgagttgcagagccagcggttccacctactccaactactgcttgggttggttcaggcagatcacaggcaaggagcgtgagggcgtcgctgtcatcaactgggtgggcgggatgctctactttgctgacagcgttaagggccggttcaccgtgagccaggatcaggcgaagaacacggtttatctggagatgaactcactgaagcccgaggatacagctatgtattactgtgcaactgagtcagtttcctctttctcctgcggcgggtggctgaccaggccggatagggtgccgtattggggccaagggactcaggttaccgtctcctct

SEQ ID NO: 1074 - DNA, 801 bp, synthetic construct
  source 1..801: mol_type = other DNA; note = Description of Artificial Sequence: Synthetic polynucleotide
caagtgcagctccaagaatcaggaggcggttccgtgcaggccgggggctccctgcgcttgtcttgcgcggccagcgggtatccctactctaatggttacatgggctggttccgtcaggctcctggcaaggaacgggagggagtggccactatctatactggcgacgggaggacctactatgccgactccgtgaagggccggttcaccatcagccgcgacaacgcaaaaaataccgtggacttgcaaatgagttccctgaagcccgaggacaccgcgatgtactattgtgcggcccgcgccgcgcctctgtactccagtgggagccctctcacccgcgccagatacaacgtgtggggccagggcacccaggtcacggtgtctagcggaggcagcggtggatctggtggctctggacaagtgcaactccaggagtcaggcggtggctccgtgcaggctggcgagagcttgcggctgtcctgccgcgcgtctggcagcacgtacagcaattactgcctgggatggttccggcagatcaccgggaaagagcgtgagggagtcgccgtgattaactgggtcgggggcatgttgtattttgctgattccgtgaaagggcgctttaccgtcagccaggaccaggccaagaacacggtgtatcttgagatgaactcactcaagcctgaggacacagctatgtattactgtgcgaccgagtccgtgtcatctttttcctgtggcggttggcttacaaggcctgatcgcgttccttactggggccagggcactcaggtgaccgtgtctagc

SEQ ID NO: 1075 - DNA, 756 bp, synthetic construct
  source 1..756: mol_type = other DNA; note = Description of Artificial Sequence: Synthetic polynucleotide
caggtacagttgcaggaaagtggcggaggcagcgtgcaggccgggggcagtctccgtctgtcttgtgccgctagtggctatccctattctaacggctatatgggatggttccgccaggcacccggcaaagagagggaaggcgtcgccaccatctacacaggtgatggaaggacatactatgcagacagcgtgaagggccgcttcacgattagccgcgacaacgcgaagaacactgtggatctccaaatgagttccctcaagcctgaggacactgcgatgtattactgcgcagccagagcagctcccctttacagcagtggaagcccgctgactcgggcaagatacaacgtctggggccagggaactcaggttacggtatcttccggcggtggatctcaggttcagcttcaggaatcaggcggtggatcagtgcaggcgggcggaagtttgcgcctgtcctgtgtagcctccgggtacgtctcctgtgactatttcctgcccagctggtataggcaggcccccggcaaggagcgcgagttcgtgtccatcattgatggcaccgggtccacgtcctacgccgcttctgtgaaggggagattcacggcgagccaagatcgcggcaaaaacatcgcatacttgcagatgaactcactcaagcccgaggataccgccatgtattactgtaaggccagctgcgttcgcggtcgcactatctctgaatattggggccagggaacccaggtgacagtaagcagt

SEQ ID NO: 1076 - DNA, 774 bp, synthetic construct
  source 1..774: mol_type = other DNA; note = Description of Artificial Sequence: Synthetic polynucleotide
caagtgcagctccaggagagtggtgggggctccgtacaggcgggcggttctctgcgccttagttgcgcggccagcggctacccttattccaacggttacatgggctggttccgccaggcaccaggcaaagagagagagggggttgcaaccatctacactggcgatggtagaacttattacgccgactctgtaaaggggcgcttcacaatttcccgtgataatgccaagaacaccgttgacctccagatgagcagtctgaagccagaggatacagccatgtattactgcgccgctcgggcagccccactctacagctccggtagccccctgacccgtgcccgctacaacgtgtggggacagggcacacaggtcaccgtgtcctctggtggctccgggggcagcggcggatcaggccaggtgcagctccaggaaagcggaggcggatctgtgcaagccggaggctctctgagactctcctgtgttgccagcggctacgtgtcctgtgactacttcttgccttcttggtatcgtcaggcacctggaaaggagcgtgagttcgtgtccatcattgacggcacaggctctacctcctacgccgcgagcgtgaagggtcgtttcaccgcttcacaggatcgcggtaagaacatcgcgtatctccagatgaactccctgaaacccgaagacaccgccatgtattactgcaaagcctcctgtgtgcgcgggcgcacgatcagcgaatactgggggcagggtacacaggtcaccgtgtcctcc

SEQ ID NO: 1077 - DNA, 756 bp, synthetic construct
  source 1..756: mol_type = other DNA; note = Description of Artificial Sequence: Synthetic polynucleotide
caggtgcagttgcaggagagcggtggaggctccgttcaggcaggtggcagcctgcggctctcctgcgccgcatccggttacccatacagcaatggctacatgggatggttccgccaagcgcctggaaaagaaagggaaggtgtggccactatctacactggtgatggccggacgtactatgccgactcagtgaagggccggttcacaatcagccgggataacgctaagaacacagtggatcttcagatgagttccctgaaacccgaggacactgccatgtattactgtgcggccagggcggctcccctgtactcttccggctcccccttgacccgtgcccgttataatgtgtggggtcaaggcacacaggtcactgtgtcttccgggggaggctcccaggtccaactccaggaaagtggtggaggctctgtgcaggcaggcggttccctccgcctgagctgtgtggcctccggctacgtgtcatgtgattactttctgccaagctggtatcgtcaggctcccggtaaggagcgcgagttcgttagcattatcgacggcaccggctccaccagctatgcggccagcgtcaaggggcgcttcaccgcctctcaggacaaaggtaagaacatcgcctacctgcaaatgaactccctgaagcccgaggacacagccatgtattactgcaaggcctcctgtgtcagaggtagggcgatctcagagtactggggtcagggaacccaggtgaccgtgtcctcc

SEQ ID NO: 1078 - DNA, 774 bp, synthetic construct
  source 1..774: mol_type = other DNA; note = Description of Artificial Sequence: Synthetic polynucleotide
caagtgcagttgcaggagagcggcggaggctctgtgcaggcgggaggcagtctgagactgtcctgtgccgcttccggctacccctatagcaacggttatatgggttggttccgccaggccccaggaaaagagcgcgagggcgtagcgactatttacacgggtgatggtagaacttactatgcagattcagtaaagggccgtttcaccatttcccgtgacaacgctaagaataccgtagatttgcagatgtcttccctgaagccggaagacactgccatgtattactgcgctgcacgcgcggctcccctttattcttccgggtcaccactcacccgtgcccgctacaacgtgtggggccagggcacgcaggtcactgtatccagcggaggcagcggcggaagcgggggctctggccaagtccagctccaggagtcaggcggtggctcagtccaggctgggggctcactgcgcctgagctgcgtggcctctggctatgtcagttgtgattacttccttccgagctggtatcgccaagcgcctgggaaggagagggagttcgtgtctattatcgacgggaccggcagcaccagctatgcggctagtgtgaagggccgtttcaccgcttcccaggataagggcaagaacatcgcctatttgcaaatgaacagtcttaaaccggaggatactgctatgtactattgcaaggcctcctgcgtgcggggaagagccatcagtgagtactgggggcagggcacccaggtcacggtatcctcc

SEQ ID NO: 1079 - DNA, 756 bp, synthetic construct
  source 1..756: mol_type = other DNA; note = Description of Artificial Sequence: Synthetic polynucleotide
caggttcagcttcaggagagtggaggcggtagcgtgcaggccgggggcagcttgcgcctgtcttgcgctgcctccggttacccttatagtaacggatacatgggttggttcaggcaggcccccggcaaagagagagagggcgttgctaccatttacaccggcgatggccgcacctactatgctgactctgtgaagggtcgcttcacaatctcccgtgataacgctaaaaataccgtcgatctccagatgtcttccctgaaacccgaggatactgcaatgtattactgtgctgcccgcgccgctcctctgtactcttcaggttctcctctgacccgcgccaggtacaacgtctggggtcagggcacccaggttaccgtaagctccggtggaggctctcaagtgcagttgcaggaatcaggaggtggctccgtccaggcaggtgggagcctccgcctctcatgcgtcgcaagcggctacgtgagctgcgactacttcttgccctcatggtatcgccaggctcctgggaaggagcgtgagttcgtgagcatcattgacggcaccggctccaccagctatgccgcttccgtgaagggccggttcactgcgtcccaggataagggcaagaacatcgcgtaccttcagatgaacaccctgaagccggaggatacagctatgtactattgcaaggcatcttgcgtgaggggtagagccatcagcgagtattggggccaaggaacccaggtgactgtttcctct

SEQ ID NO: 1080 - DNA, 774 bp, synthetic construct
  source 1..774: mol_type = other DNA; note = Description of Artificial Sequence: Synthetic polynucleotide
caggtgcagttgcaggagtccggtgggggatctgtgcaggcgggagggagcctgcgtcttagctgcgccgcaagcggatacccctactccaacggatacatgggttggtttcgccaagcccctgggaaggaaagggagggcgtggccaccatctataccggagatggccgcacctattacgctgattccgtgaagggacgtttcacaatcagcagagataacgctaagaacactgtggacctccagatgtctagcctgaaacccgaagacactgccatgtattactgcgcggccagagcagcccctctgtattcctctggaagcccgttgaccagagcccgctacaatgtgtggggacagggcacccaggtcactgtgtcatccggcggaagcggcggtagtgggggctctggccaagttcagctccaggaaagcggcggaggcagcgtgcaggctggcggatcactgagattgagctgtgttgcttccggctatgtgagctgtgattatttcctccccagctggtacagacaggctcccggcaaggaacgcgagtttgtcagtatcattgatggcaccggctctaccagttacgctgcgtcagttaaaggacgcttcaccgcgtcccaagacaaaggcaagaacatcgcctatttgcagatgaacaccctgaagccagaagacactgccatgtattactgcaaggcttcttgcgtgcgcggtcgcgccatttctgaatactggggccagggcactcaagtcaccgtgtcttcc

SEQ ID NO: 1081 - DNA, 783 bp, synthetic construct
  source 1..783: mol_type = other DNA; note = Description of Artificial Sequence: Synthetic polynucleotide
caggtgcagctccaggagtctggaggcggaagtgtccaggctggcggtagcctgcggctttcatgtgccgcttccggctacccgtactcaaacggctacatgggctggttcagacaagcgcctggaaaagagagagaaggcgtggccaccatctatacaggtgatggccgtacttattacgctgactccgtcaagggccgcttcaccatcagccgggataacgctaagaataccgtcgatcttcaaatgagttccttgaagccggaagacaccgctatgtattactgtgccgcgcgggctgccccgctgtatagtagcggctctcccctcacccgcgctcgctacaacgtgtggggacaggggactcaagtaaccgtgagttccggcggtggctctcaggtgcagctgcaagaaagcggcgggggctccgtgcaggcaggcggaagcctgcgcctgtcttgcagagcctccggcagtacctacagtaactattgtctgggctggtttcgccagatcacaggtaaagagagagaaggtgttgccgttatcaactgggtaggtggaatgctgtactttgccgattccgtgaagggtcgcttcaccgtgtcccaagaccaagccaagaatactgtatatttgcagatgaactccctgaagcccgaggacacagctatgtactattgtgccgctgagtctgctagtagcttttcctgcgggggttggctgacccgcccggaccgcgtcccctactggggacagggcacccaggtaaccgtgagttct

SEQ ID NO: 1082 - DNA, 801 bp, synthetic construct
  source 1..801: mol_type = other DNA; note = Description of Artificial Sequence: Synthetic polynucleotide
caggtgcagttgcaggagtctgggggtggaagcgtgcaagccgggggatctctgcggctgagctgcgctgccagtggatatccatattccaacggctatatgggctggtttcgccaagcgcccggcaaggagcgcgaaggcgtcgccacaatctacacaggcgatggccgcacctattacgctgattccgttaaaggacggttcacgatcagccgcgacaacgccaagaacacagttgacctccagatgtccagcctgaagcccgaggatactgcgatgtattactgtgccgcgagagctgccccactctacagttccgggagcccccttactcgcgcccgttacaatgtttggggacagggcactcaagtgacagtgtccagcggaggttccggtggctccggcgggtctggacaggtgcagttgcaggagtccggcggagggagcgtacaggccgggggctctttgcgtctgtcttgcagagcttccgggtctacctattccaattattgtctgggttggttccgccagattactggcaaggagcgtgaaggggtcgccgtcatcaactgggtgggtgggatgctctatttcgcggatagtgtgaagggccgctttacagtctctcaggaccaggctaagaatactgtctatcttcagatgaactctttgaagcccgaggatacggccatgtactattgcgctgcggaaagtgcctctagcttcagctgtggcggttggctcacccgcccagaccgcgtcccctactggggccagggaacccaggtgacagtgtccagt

SEQ ID NO: 1083 - DNA, 765 bp, synthetic construct
  source 1..765: mol_type = other DNA; note = Description of Artificial Sequence: Synthetic polynucleotide
caggttcagctgcaagaatccggcggagggtccgtccaagcgggaggcagtctcagactttcctgcgcagcttctggatacccttactctaacggatatatgggttggtttagacaggcacccggcaaggagagggaaggcgtggccacgatctacactggggatggcaggacctattacgcagacagcgtgaagggccgcttcaccatttccagagataatgctaagaacaccgttgatctccagatgagttccctgaagccagaagataccgccatgtattactgcgctgcccgcgccgcgcctctttacagctctgggagcccgctgactcgtgctaggtataacgtctggggccagggaacccaggtgactgtcagctctgggggcgggagccaggtgcagctccaggagagtggcggtggccttgttcagcccggtggctccttgcggctgtcatgtgctgcctccggcttcacattttctctgagcgggatgtcctgggtgcggcaggcccccggcaagggccttgagtgggtctccgctatctccagcggcggtgcaagcacttactataccgacagcgtcaagggccgtttcactatctcacgcgataacgccaaaaacatgctgtatctccagctgaactccctcaagaccgaggataccgctatgtactattgtgccaaaggcggttccggctatggcgatgcgtcccgcatgacttctcccggctcccagggcactcaggttaccgtgtctagc

SEQ ID NO: 1084 - DNA, 783 bp, synthetic construct
  source 1..783: mol_type = other DNA; note = Description of Artificial Sequence: Synthetic polynucleotide
caagttcagcttcaggagagtggaggcggatctgtccaggcaggtggctcacttaggctgtcttgtgctgccagtggctacccctactccaacggatatatgggttggtttcgccaggcaccagggaaggagcgcgagggcgtcgctaccatctacactggcgacggacgcacctactatgcggacagcgtgaagggccggttcaccatcagccgcgacaacgccaaaaacaccgtcgatttgcagatgtcttccctgaagcctgaagacacagccatgtattactgtgccgcgcgtgctgccccactctactcctctgggagccccctcacccgtgcccgctacaacgtgtggggccagggcacacaggtgaccgtttccagtggtggcagcggtggcagcgggggttccggccaggtccagctccaggagtcagggggtgggctggtgcagcccggcggtagcctgcgcttgtcctgcgctgccagcgggttcaccttcagtctgtcaggtatgtcctgggtaaggcaggctcccggtaagggcctggagtgggtatccgccatctctagcggtggagccagcacctattacactgattcagtaaaaggacgcttcaccattagcagggacaacgccaaaaacatgctgtatcttcaactgaactccctcaagactgaggacacagccatgtactattgcgccaagggagggtctggctacggcgatgcctccaggatgacctcccccggtagccagggcactcaggtgacagtgtcaagc

SEQ ID NO: 1085 - DNA, 756 bp, synthetic construct
  source 1..756: mol_type = other DNA; note = Description of Artificial Sequence: Synthetic polynucleotide
caggtgcagctccaggagagcggtgggggaagcgtgcaggctggcggaagcctccgcctgtcctgtgcggcatctggctacccatattctaacggttatatgggctggtttcggcaagcgcctgggaaggagcgcgagggggtcgccaccatttatactggcgatggccgcacctattacgccgattctgtgaagggccgcttcacgatttctagggataacgctaaaaacaccgtggatctgcaaatgtccagcctgaagccagaagacacagccatgtactattgcgccgctcgggccgctcctttgtactcatccggctcacctctcactagagcccgttacaacgtctggggacagggtactcaggttaccgtaagctctgggggtggctcacaagtgcagttgcaggagagcggtggaggttccgttcaggctggaggctccctgcggctttcctgcgtggcttccggctacgtgtcatgcgactacttcctgcctagctggtatcgccaggctcctgggaaggagcgtgaatttgttagcatcattgatggcacaggcagcactagctacgcggcttctgttaagggacgttttacagcgtctcaggacaaagggaagaacatcgcctacctccagatgaactccctgaaaccggaggataccgccatgtactattgcaaggcctcctgcgtgcgcggtcgcggtattagcgaatactggggacagggcacccaggtcactgtgtcttca

SEQ ID NO: 1086 - DNA, 774 bp, synthetic construct
  source 1..774: mol_type = other DNA; note = Description of Artificial Sequence: Synthetic polynucleotide
caggtccagctccaggaatccggtggaggctccgtgcaggccggagggtctctcagactcagctgcgctgccagtggttatccgtactctaatgggtacatgggttggttccgccaggcccccggcaaggagagggaaggcgtggccacaatctataccggcgacgggcgtacatattacgcggatagtgtgaagggacgcttcaccatcagccgtgacaacgccaagaacaccgtggaccttcagatgtcttccttgaagccagaagacaccgcgatgtattactgcgcggctcgcgcagctcccctctattcctctggctccccactgacccgcgccagatacaatgtttggggccagggcactcaggtcactgtgtccagtggcggtagcggcggtagtggtggctccggtcaggtgcagctccaggagtcagggggtggctccgtacaggctggtggctcactccgtctgagttgtgtagccagcggttacgtctcctgcgattatttccttccttcctggtatcgccaggctcccggcaaagagcgggagttcgtttccattatcgacggaactggatcaacatcctatgccgcttctgtcaaggggcgcttcaccgcctcacaggataagggcaagaatatcgcttacctccagatgaacagcctgaaaccagaagacaccgcgatgtattactgtaaggcgagctgtgttcgcgggcgggggatctcagagtattggggccagggcacacaggtgaccgtatcctcc

SEQ ID NO: 1087 - DNA, 783 bp, synthetic construct
  source 1..783: mol_type = other DNA; note = Description of Artificial Sequence: Synthetic polynucleotide
caagtgcagctccaggagtcaggcggtggcagcgtacaggccggaggctccctgagactgagctgtgcagcctctggctacccatacagcaatggctatatgggatggttccgccaggctccgggtaaagagcgcgagggcgtggccactatttataccggggacggaagaacctattacgcggattccgtgaaaggccgcttcacaatttcccgtgacaacgcgaagaacaccgtcgatctccagatgtcttccctgaagccagaggacaccgctatgtattactgcgccgctagggcagctccgctttacagtagcggatctcccctcacccgcgcccgctacaacgtgtggggacagggaacacaagtgacagtttcctcaggcggtggctctcaggtgcagctccaggaatctgggggagggtccgtacaggccggaggctccctgagattgagctgccgcgcaagtgggtccacctacagcaactattgtctggggtggtttcgccagattactggtaaggagagggagggcgtggccgtcatcaactgggtgggcggaatgctctacttcgccgactccgtgaagggtcggttcaccgtttcacaggaccaagcaaagaacaccgtgtacctccagatgaacagtctgaagcccgaggataccgccatgtattactgtgcggctgaatccgtcagctccttctcctgcggcgggtggctgacacggccagatcgggtcccttactggggacagggcacacaggtgactgtgtcctcc

SEQ ID NO: 1088 - DNA, 801 bp, synthetic construct
  source 1..801: mol_type = other DNA; note = Description of Artificial Sequence: Synthetic polynucleotide
caggtgcagttgcaggagagtggaggtggcagcgtgcaggccggaggcagccttcgcctctcttgcgctgcgagtggctacccctacagcaatgggtacatgggctggttccgtcaggcacccggtaaagaaagagagggcgtggctactatctacactggggatggcaggacctattacgccgatagcgtcaagggccggttcacgattagccgtgacaacgccaaaaatactgtggacctccagatgtcttcactgaaacctgaggacacagcaatgtattactgcgctgcccgtgccgctcctctctacagctccggctctccattgacccgcgcccgttacaatgtttgggggcagggcacccaagtcaccgtgtcatccggcggttccggcggaagcggtggcagcggccaggtgcagcttcaggagtctggtggcggtagcgttcaggcaggtggcagtctgcgtctgagctgccgggcgagcggcagcacatactccaactattgcctgggctggtttcggcagatcactggtaaggagcgcgagggcgtggctgtcataaattgggtcggaggtatgctgtacttcgccgactcagttaaaggacgcttcaccgtgtcccaggaccaggctaagaatactgtgtatctccagatgaacagtctgaaaccagaggacacagcaatgtattactgtgctgccgaaagcgtctcatctttctcctgtgggggctggctcacacgcccggaccgtgttccgtattggggtcagggaacccaggtgaccgtaagctcc

SEQ ID NO: 1089 - DNA, 765 bp, synthetic construct
  source 1..765: mol_type = other DNA; note = Description of Artificial Sequence: Synthetic polynucleotide
caagtgcagctccaggagtccgggggcgggtctgtgcaagctggcggttctctgaggctgtcctgcgctgcatccggctacccttactccaatggctacatgggttggttcagacaagctcccggaaaggagagggagggtgtggctaccatctacaccggcgacggacgcacttattacgcagactccgtgaagggccgcttcaccatttctcgggataacgctaagaacaccgtggaccttcagatgtcttcccttaaacctgaggacactgccatgtattactgtgccgctcgggccgcgccactgtactcttccgggtccccacttacacgtgctcgttacaatgtgtggggtcaaggaacccaggtgactgtgtccagcggaggcggttcacaagtgcagcttcaggaaagcggaggcgggttggtgcagcctgggggctcactccgtctgagctgtgccgcttctggtttcaccttctcttcatatcctatgagttgggtgagacaagcgccgggcaaaggactggagtgggtctccactatttcttccggcggtgatactaccttgtatgctgactccgtgaagggtcgtttcacctccagtcgcgacaatgcgaagaataccctgtacctccagctcaactccctgaagaccgaggacacagcgatgtattactgcgctaagcgtatcgactgcaattccgggtactgctacaagagaagctactgggggcaagggactcaggtgacagtgtctagc

SEQ ID NO: 1090 - DNA, 783 bp, synthetic construct
  source 1..783: mol_type = other DNA; note = Description of Artificial Sequence: Synthetic polynucleotide
caggtccaacttcaggagtctggtggaggctccgttcaggcgggcgggtccctgcgcttgtcttgtgcagccagcggttacccatacagcaacggatatatgggctggttccggcaggcccctgggaaagaacgtgagggcgtcgcgactatctatactggagatggacgcacttattacgccgatagcgtcaagggacggtttaccatcagcagggacaacgccaaaaacaccgtggaccttcagatgtcttccctgaaacccgaggacacggctatgtactattgcgcggcccgcgctgcccctctctatagttctgggagtcccttgacaagggccagatacaacgtgtgggggcaggggactcaggttactgtctcctctggtggctccggtggcagcggaggctctggccaggtgcagttgcaggagagtgggggtggcctggtgcagcctggtggcagcctgcgcctgtcttgcgcagcctctgggtttacctttagctcttaccccatgtcctgggtccgccaggctcccggcaaaggactggagtgggtgtccaccatttctagcggaggcgatactaccctgtacgccgactctgtgaaggggcgcttcactagctcacgggacaatgctaagaacacactgtaccttcagctgaactcactgaaaaccgaagacactgctatgtattactgcgctaaacgcattgattgcaacagcggctattgttataaaagatcctactggggccagggcacccaggtcacggtctccagc

SEQ ID NO: 1091 - DNA, 765 bp, synthetic construct
  source 1..765: mol_type = other DNA; note = Description of Artificial Sequence: Synthetic polynucleotide
caagttcagctccaggagagtggagggggcagtgttcaggccggaggtagcctgcgcctcagctgtgcagccagtggctacccctactctaatggctacatgggctggttcaggcaggcccccggaaaagagcgtgagggtgtggctacaatttataccggagacggcagaacctactatgccgactccgtgaagggccgcttcacaatctctcgggacaacgctaagaacacagtggatcttcagatgagcagtctcaagccagaggataccgccatgtattactgtgccgcgcgggctgcccctttgtactcatctgggagccctctgacccgcgcccgctataatgtgtggggccaggggacccaagtgacggtatcctctgggggcggtagccaggtgcagctccaggaaagcggagggggactggtgcagcccggcgggagcctgcggcttagctgcgcagcctccggcttcaccttctccctcagttccatgagttgggttcgccaggctccagggaagggactggaatgggtgtcagccatctcctctggcggggcgtccacttattacacagactccgtgaagggtaggttcaccatttctagggataatgccaagaacatgctgtacctccagctgaacagtctgaaaacagaagacacagctatgtactattgcgccaaaggtgggtccggttatggcgatgcgtccaggatgacttcccctgggtcccagggcacacaggtcaccgtgagtagc

SEQ ID NO: 1092 - DNA, 783 bp, synthetic construct
  source 1..783: mol_type = other DNA; note = Description of Artificial Sequence: Synthetic polynucleotide
caggtgcaactccaggagagcggcggaggctctgtccaagcaggcgggtctctccgtctgtcttgcgccgcaagcggatacccctacagcaacggttatatgggttggttccgccaggcccccggaaaggagcgtgagggtgtggccaccatctacactggcgatggaagaacctattacgcagacagcgtgaagggccggtttaccatcagccgcgacaacgccaagaacaccgttgacttgcagatgtccagcctgaaacctgaggacacagctatgtactattgtgctgccagagcggctcctctctacagttctggatctccccttacacgggctaggtacaatgtttgggggcagggcacccaggtcaccgtgtcctctggcggatcaggaggcagcgggggctctggtcaagtgcagctccaggagtccggcgggggactggttcagcctggaggttccctgcgcctttcttgtgctgccagcggcttcacgttctccctgagttccatgagctgggtccggcaggcccccggcaaaggcctggagtgggtttccgctatctccagcggcggggcctccacctactataccgactccgtgaagggacggttcacaatctccagggacaatgctaagaatatgttgtaccttcagttgaactccctgaaaaccgaagacacggccatgtattactgcgccaagggaggctccggttacggcgatgccagcagaatgacctcccctggtagccaggggacacaggtgactgtatccagc

SEQ ID NO: 1093 - DNA, 783 bp, synthetic construct
  source 1..783: mol_type = other DNA; note = Description of Artificial Sequence: Synthetic polynucleotide
caggtgcagttgcaggagtccggcggaggctccgttcaggccggtggcagcctcagactgtcatgtgcagcctccggttatccctattccaatggttacatgggatggttccgtcaggcccctgggaaagagagggagggcgtcgccacgatctacaccggcgatggacgcacatattacgccgacagtgttaagggccgtttcaccatctctcgcgacaacgccaaaaacacagttgatttgcagatgagttccctcaagcccgaagacaccgctatgtactattgtgcagcccgcgccgctcctctctacagctctggctccccactgacgagggcgcggtacaacgtgtggggccagggcacccaggttaccgtttctagtggcggtggctcccaggtccagctccaggagagtggcggaggcagcgtgcaggcaggcggtagccttcgcctgagctgccgggcctccgggagcacgtactctaactactgtcttggatggttccggcagacaactgggaaggagcgcgagggagtcgccgttatcaactgggtagggggaatgctgtactttgccgattccgtcaagggacgctttaccgtctctcaggatcaggccaagaacaccgtctacctccagatgaacagtctgaagcccgaggacaccgctatgtactattgcgctgcggagagcgtttcctctttctcctgcggcggttggcttacccgccccgaccgggtgccttactggggtcagggcacacaggtgaccgtctcctcc

SEQ ID NO: 1094 - DNA, 801 bp, synthetic construct
  source 1..801: mol_type = other DNA; note = Description of Artificial Sequence: Synthetic polynucleotide
caggttcagcttcaggaaagtggagggggctccgttcaagccgggggttcccttaggctgtcctgcgccgcttctggttatccgtattcaaatgggtacatgggatggttccgccaggctcccggcaaggagcgcgagggtgtcgcaacaatctatacgggcgacggtcggacctactatgcagactctgtcaagggccggttcacaatctcccgcgataacgccaagaacacagtggacctccagatgtcatccctgaagccagaggatacagcaatgtattactgtgctgcacgtgccgctcccctgtactctagtgggagccccctcaccagagcgcggtataacgtgtggggtcaggggactcaggtaaccgtgtccagcggcggttccggcggtagcggaggctccggccaggtacagctccaggagagcggagggggctccgtccaggctggcgggtccctgcgcctgtcctgccgggcctccggtagcacatactctaactactgcctgggctggttcaggcagaccactggaaaggaacgcgagggcgtcgctgtaatcaactgggtcggaggtatgctttacttcgcagactccgtgaagggtcgcttcacagtgagccaggaccaagctaagaacactgtgtacctccagatgaactctctcaagccggaggataccgccatgtattactgtgcagccgagagtgtgtctagcttctcctgcggaggctggctgacgagacccgatagggtcccgtactgggggcagggcactcaagtcactgtgagcagc

SEQ ID NO: 1095 - DNA, 783 bp, synthetic construct
  source 1..783: mol_type = other DNA; note = Description of Artificial Sequence: Synthetic polynucleotide
caggtacaacttcaggaaagcgggggaggctccgtacaggcgggaggcagcttgcgcctgagctgtgccgcaagtggttacccgtacagcaacggctacatgggctggtttcgtcaggctcctgggaaagagagagagggcgtggctacgatctacacgggtgacggacgcacctattacgccgactccgtgaaaggaagattcaccatcagccgcgataacgctaagaacacagttgacctgcaaatgtctagcctgaaaccggaggacactgctatgtactattgtgccgcacgcgctgcccctctctattcttccggcagccccctcaccagggctcgctacaacgtctggggccaagggacccaggtgactgtgtccagcggtggagggagccaggtgcagctccaggagagcggcgggggctctgtccaggccggtggcagtctgcgcctgtcctgccgggcctcccgttccccttacgggaattattgcctgggctggttcagacagtctacgggtaaggagcgggaaggcgtggcagttatcaactgggtcggcggaatgctgtactttgccgactccgtcaaaggccgcttcactgtgtctcaggaccatgcaaagaacaccgtaaccttgcagatgaactctctgaaacccgaagacacggcgatgtattactgcgctgccgagtccgtttctagcttcagctgtggcggttggttgacaaggccagatcgcgtcccgtactggggccaaggaacccaggtaaccgtaagcagt

SEQ ID NO: 1096 - DNA, 801 bp, synthetic construct
  source 1..801: mol_type = other DNA; note = Description of Artificial Sequence: Synthetic polynucleotide
caagtccagctgcaagagagcggaggcgggagcgttcaggctggtggcagcctgcggctgagttgtgctgccagcggatacccctattccaatggttatatgggttggtttagacaggcacctggaaaggaacgcgagggcgtagctactatttacactggagacggcaggacttattacgcggatagcgtgaagggccgtttcacaatttcacgcgacaatgccaaaaacaccgtggatctgcaaatgtccagcctgaagcccgaggacaccgccatgtactattgcgccgcacgcgcggctcccctgtactcctcaggtagccctttgactcgcgcacgctataatgtgtggggccagggcacccaggtgacggtttctagcggagggagcgggggttctggtggctcaggtcaggtgcagcttcaggaatctggaggtggctccgtacaggctgggggctccctgcgtctgagctgccgggcgagcaggtccccttatggtaactactgtctcggttggttccgccaatccaccggcaaggagcgcgagggagtggccgttataaattgggtgggcggtatgctgtactttgctgacagtgttaagggacgtttcaccgtatctcaggaccacgccaagaacaccgtgacattgcagatgaactctctcaagccagaggacaccgctatgtattactgtgccgctgagtcagtgtcctctttcagctgcggcgggtggctcactcgccctgacagagtaccctattgggggcaggggacacaggtcacggtttccagc

SEQ ID NO: 1097 - DNA, 765 bp, synthetic construct
  source 1..765: mol_type = other DNA; note = Description of Artificial Sequence: Synthetic polynucleotide
caagtacagttgcaggagtccggcggtggcagtgttcaggcgggcgggtccctgcgcctcagctgcgcagccagcggatacccatactctaacggttacatgggttggttccgccaggccccaggtaaggaaagagagggagtggcgactatttataccggggatggccgcacctactatgccgattctgtaaaaggtaggttcacgatctctcgcgataacgccaaaaacacagtcgatctccagatgtcttccctgaagcccgaggacaccgccatgtattactgtgcggcacgggcagctcccctttacagctccggttccccgctgactcgtgcccgttacaacgtctgggggcagggcacacaggtaaccgtgtccagcggcggaggttcacaggtgcagctccaggagtctggtggcggactggtgcagcccggaggctccctgcgtctcagctgtgcagccagcggctttacatttagccactccggtatgagctgggtacggcaggcacctggaaagggtctggagtgggtgtccacaatcaactcaggcggagcctctacatactatactgactcagtcaagggacgtttcaccatctcccgcgacaacgctaaaaacatgctgtaccttcagttgaacagtctgaagactgaggatacagccatgtattactgtgccaaagggggctctggctacggggatgcctccagaatgactagccctggctcccagggcacccaggtgaccgtgtcttcc

SEQ ID NO: 1098 - DNA, 783 bp, synthetic construct
  source 1..783: mol_type = other DNA; note = Description of Artificial Sequence: Synthetic polynucleotide
caggtgcagttgcaagagtctggcggaggctccgtccaagcaggcgggagtcttcggctgtcttgtgcagcctccgggtatccgtactctaatggttacatgggctggttcaggcaggccccaggtaaagaacgggagggcgtggccaccatttacaccggcgatggccgcacatactatgccgactccgtgaagggtaggttcaccatttcacgtgacaatgccaagaataccgtggatctccagatgtctagcctgaagccggaggacacagccatgtattactgtgctgcccgcgctgcccctctgtactccagcggttctcctctgactagagcccggtacaacgtgtggggccagggcacccaagtcactgtgtctagtggcgggtccggcggaagcggtggctcaggccaagttcagctccaggaatcaggtgggggcctggtccagcccggtggatctctgcggctgtcctgtgctgccagcggattcacgtttagccacagcggcatgagctgggtacgccaggctccaggcaaaggattggaatgggtgtccacaattaactctggcggggccagcacctattacactgacagcgttaaagggcgctttacaatctctcgcgacaacgccaagaatatgttgtacctccagctgaactcactcaagaccgaggatactgccatgtattactgtgctaaaggcggaagcggctacggcgacgcttccaggatgaccagtcctggctcccagggcacacaggtgaccgtgtcctcc

SEQ ID NO: 1099 - DNA, 738 bp, synthetic construct
  source 1..738: mol_type = other DNA; note = Description of Artificial Sequence: Synthetic polynucleotide
caggtccagcttcaggagtccggcggaggcagcgtacaggcgggcgggtccttgcgcctgtcctgtgtggcctccgcatctacgtattgcacctatgatatgcactggtatcgtcaggcccctggcaaaggtcgggagttcgtgagcgccattgattctgatggcactacccgctacgccgacagtgtgaagggacggtttaccatttcccagggaaccgcgaagaataccgtgtacctccagatgaacagcctgcaacccgaggacacagctatgtactattgtaagaccgtgtgtgtcgtgggttcccgctggagcgactattggggacagggcacccaagtgaccgtcagctccggcgggggctctcaggtgcagttgcaggagagcgggggtggattggtgcagcccggcggatctctgcgcctgagctgcgccgcttccgggttcactttttcatcttacccaatgtcctgggtgcgccaagcgccgggcaagggactggagtggatctccacgatcagcgctggcggtgatacaaccctttacgccgactccgtgaagggccgctttaccagctcaagagacaacgcaaaaaacactctgtacttgcagctgaactctctcaagaccgaggatgcggccatttattactgcgccaagcgcattgattgtaactctgggtactgttatagacgcaactattggggtcagggcacgcaggtgaccgtgtcttcc

SEQ ID NO: 1100 - DNA, 756 bp, synthetic construct
  source 1..756: mol_type = other DNA; note = Description of Artificial Sequence: Synthetic polynucleotide
caggttcagctccaggaaagcggcggaggcagtgtgcaggcaggcggaagcctgagactgtcctgtgtagcgtcagccagtacctactgcacatacgatatgcactggtatcgccaagctcctgggaaaggaagagagttcgtttccgccatcgactctgacggcactacaagatatgccgatagcgttaaaggccgctttacaatttcccagggcaccgcgaagaacaccgtctacctgcaaatgaatagtttgcagccagaagacactgctatgtactattgcaagaccgtgtgcgtggtcgggtcaaggtggagcgattactggggccaaggtactcaggtcaccgtcagctccggtggaagcgggggctccgggggctctggacaggtccagctccaggagtctggcggaggcctcgttcagccagggggctcattgaggctttcctgtgcggcctccggcttcacattttctagctacccgatgagttgggtacgccaggctcctggaaaaggcctggaatggatcagcacaatcagcgcaggtggggacacaaccctgtacgctgatagcgtgaagggtaggtttacatcttcccgcgacaacgctaagaacaccctttacttgcagctcaattccctcaagaccgaggacgcggccatctattactgcgccaaacgtattgactgcaactctggttattgttacagaaggaattactggggccaggggacccaggtgaccgtatcttcc

SEQ ID NO: 1101 - DNA, 738 bp, synthetic construct
  source 1..738: mol_type = other DNA; note = Description of Artificial Sequence: Synthetic polynucleotide
caggtgcagctccaagaatccgggggtggcagtgtgcaggccggtggctctctgaggttgagctgcgtcgcctcagccagcacttactgcacctatgacatgcactggtacagacaggcacccggtaagggacgtgagttcgtgtctgctattgattccgatggcactaccagatatgccgattccgtgaaaggcagattcacgatttcccaaggaaccgctaagaacaccgtgtatctccaaatgaactcccttcagcccgaagacaccgctatgtattactgtaagaccgtgtgcgtagtgggcagtcgttggtcagactattggggccagggcacccaggtcaccgtcagttccggcggaggctctcaggtccaacttcaggaatctgggggaggtttggtgcagccgggtggctccctgcggctgtcctgtgcggcaagtggcttcaccttcagcctctccggcatgtcctgggtgcgccaagcgcccggtaaggggctggagtgggtgtccgccattagctctggcggtgcttctacctattacaccgactccgtcaagggtcggtttaccatctctcgcgacaacgctaagaacatcttgtaccttcagctcaattctctgaagactgaggacactgccatgtattactgtgcgaaaggtggctccggctacggagatgcctctcgcatgacctcccctgggtcccagggcacacaggttaccgtgtcctcc

SEQ ID NO: 1102 - DNA, 756 bp, synthetic construct
  source 1..756: mol_type = other DNA; note = Description of Artificial Sequence: Synthetic polynucleotide
caggtccagctccaggagtctggcggagggagcgttcaggccgggggctctctgaggctctcctgtgtggcgagcgcctctacttactgtacttacgacatgcactggtatcgccaagccccaggcaagggcagggagttcgtcagtgccatcgactccgacggcacaactcgctacgccgactccgtcaagggacgtttcacaatctctcagggcacggctaagaacactgtgtatctccaaatgaacagtctccagcctgaagatacagccatgtactattgcaaaactgtgtgtgtggtcggctcacggtggtctgactactggggtcaggggacccaggtcacagtaagctcaggaggttccggcggttctggcggttcaggacaggtgcaacttcaggaaagcggtggcggactcgtccagcccggaggttcactgcgtctcagctgtgctgccagcggttttaccttcagcctcagtggaatgagctgggtcagacaggcccctggcaaagggctggagtgggtgagtgccatttcctcaggaggtgcctctacctattacaccgactctgtcaaaggcaggtttaccatcagccgcgataacgccaagaacatcctgtatctccagcttaattccctcaagacagaagacacagctatgtattactgtgcgaaagggggctccggttacggggacgcttccagaatgacatcccctggttctcagggcacacaggtgaccgtgtcctca

SEQ ID NO: 1103 - DNA, 729 bp, synthetic construct
  source 1..729: mol_type = other DNA; note = Description of Artificial Sequence: Synthetic polynucleotide
caagttcagctccaggaatctggcggtgggtctgttcaagccggtggctccctgcgcctttcatgtgtcgcctctgcttctacatactgcacctacgacatgcactggtatcgtcaggctcccggcaagggccgcgaatttgttagtgctatcgactccgacggcactacacgctatgccgacagtgttaaaggccgcttcaccatctctcagggcacggcgaaaaacaccgtgtacctccagatgaactccctgcaacccgaggatacagccatgtattactgcaagacagtctgtgtcgtgggatctcgctggtctgactactggggacaggggacccaggttactgtctcctctggcggaggcagccaggtgcagcttcaggagtccggtgggggctccgtgcaggctggcggaagcctgcgcctgtcctgcgttgcatccggttatgttagctgcgattacttcctgccctcctggtatcgtcaagctcccggcaaggagcgcgagtttgtttccattatcgacggcaccggcagcacgtcatacgctgcgagcgttaagggccgcttcaccgcttccgaagacaagggcaagaacatcgcctacttgcagatgaactccctgaagcctgaggataccgccatgtattactgcaaggccagctgcgtccggggccgggccgtgtccgagtattgggggcagggcacccaggtgacagtgagtagc

SEQ ID NO: 1104 - DNA, 747 bp, synthetic construct
  source 1..747: mol_type = other DNA; note = Description of Artificial Sequence: Synthetic polynucleotide
caagtccaactccaggaaagtggcggtgggtccgtacaggccgggggcagtctgcggctttcctgtgtggcctctgcatctacttactgtacttacgacatgcactggtatcgccaggccccaggtaagggtcgggagtttgttagcgcaatcgactcagacgggactacccgctacgcggatagcgtcaagggccggttcaccatctctcagggcaccgccaagaacaccgtttatttgcagatgaatagcctccaacctgaagatactgcaatgtattactgcaagacagtgtgcgtggttggcagccgctggtcagactattggggtcagggcacccaggtcaccgttagctctggaggcagcggcggtagcggtggcagcggacaggtccagctccaggagtcaggagggggctctgtccaggccgggggctctctccgtctttcttgcgtcgcctcaggctacgtcagctgcgattacttcctccctagctggtatcgtcaagcgccggggaaggaacgggagtttgtgtcaatcattgacggcaccggctctacttcctatgctgccagcgtgaagggccgctttacagcctccgaagacaagggcaagaacatcgcttacctccagatgaactctctgaagcccgaagacaccgctatgtactattgcaaggccagctgcgtcagaggtagggctgtgtccgaatattggggtcagggcacgcaggttaccgtgtcttct

SEQ ID NO: 1105 - DNA, 741 bp, synthetic construct
  source 1..741: mol_type = other DNA; note = Description of Artificial Sequence: Synthetic polynucleotide
caggtccaactccaggagagcggaggcggttccgtgcaagcaggtggctccctgcgcttgagctgtgtggcctccgctagtacttactgcacttacgatatgcactggtataggcaagccccagggaaggggcgcgagttcgtgtccgccattgacagcgacggtacaacccggtatgccgactctgtgaaaggccgtttcacaatctcccagggaacagccaagaacaccgtatacctccagatgaactccttgcagcctgaggatacagccatgtactattgtaaaaccgtgtgcgtggtcggctcacgctggagtgattactggggccaaggaacccaggtcactgtctcctcagggggaggtagccaggtccagcttcaggagtccggcggtggcctggttcagcctggggaatcactgcgtctctcttgcactgccagtggattcacattttcaaactatgctatgtcttgggtgcggcaggcccctgggaaggggctcgaatgggtatccggtattaacgtggcatacggcatcacctcctacgctgattccgtgaagggcaggttcaccatctctcgcgacaacaccaagaacacactgtacttgcaacttaacagtcttaaaactgaagacactgctatctactattgcgtcaagcacagcggtacgactatcccgcgtggattcatcagctatacaaagaggggccaaggcacccaagtcactgtgagcagc

SEQ ID NO: 1106 - DNA, 759 bp, synthetic construct
  source 1..759: mol_type = other DNA; note = Description of Artificial Sequence: Synthetic polynucleotide
caggtccaacttcaggaatctggcggaggctctgtgcaggctggagggagtcttagactgtcctgtgtcgcaagcgcaagcacgtactgcacctacgacatgcactggtatcgccaggctccgggtaagggacgcgaatttgtgagcgcaatcgactccgacgggaccacaaggtacgccgatagcgttaagggacgtttcaccatcagtcagggtactgccaagaacacggtctacctccagatgaatagcctccagccggaagataccgctatgtattactgcaagacagtgtgcgtagtgggcagccgttggtccgattattggggccagggtacacaggtgacagtctccagtggaggctccggcggatctgggggcagcggtcaggtgcagttgcaggagagcggcggtggcttggtgcaacccggtgaatctttgcgtctgagctgcacagcgagcggattcacatttagcaactacgccatgtcctgggtgcgccaggctcccggtaagggtctggagtgggtgagtggtatcaatgtggcctatgggatcaccagttatgcggatagcgtgaagggccggtttaccatcagccgggacaacaccaagaacaccctgtaccttcagcttaactctctgaagaccgaagatacagccatctattactgtgtgaagcactcagggactaccatccctcgtggttttattagctacactaagcgtgggcaaggaacacaagtgacggtgtcttcc

SEQ ID NO: 1107 - DNA, 729 bp, synthetic construct
  source 1..729: mol_type = other DNA; note = Description of Artificial Sequence: Synthetic polynucleotide
caggtgcagctccaggaatccggcgggggcagcgtgcaggccggaggctccttgcgtctgtcttgcgtcgcatccgccagcacgtactgcacctacgatatgcactggtatcgtcaggctcccggtaaggggagggagtttgtcagtgctatcgacagcgatgggaccactcgctacgctgactccgtgaagggtcgttttaccatcagccagggcacagctaagaacacggtgtacttgcagatgaactctctccagccggaagacaccgcgatgtattactgcaagactgtttgcgtcgtgggctctcgttggtctgactattggggtcagggcacccaagtcacggtgagtagcggcgggggtagccaagtgcagcttcaggagtccggtggcggaagcgtgcaggctgggggcagccttcggctgtcatgtaccgcctccggttacgtgtcttgtgactacttcttgccaagctggtatcgtcaggcccctggtaaagagcgggagttcgtcagcgtgattgatggcactgggtccaccagctacgctgccagcgttaagggccgcttcaccgccagccaggacaagggaaagaatattgcatatctccagatgaactccctgaagcctgaagataccgctatgtattactgcaaggcctcatgcgtccgtggacgcgctatttccgagtattggggacagggtactcaggtcaccgtgagttct

SEQ ID NO: 1108 - DNA, 747 bp, synthetic construct
  source 1..747: mol_type = other DNA; note = Description of Artificial Sequence: Synthetic polynucleotide
caggtgcagctgcaagaaagcggtgggggctccgtccaggcgggcggtagcctgaggctgagttgcgtcgccagcgctagtacatactgtacctacgacatgcactggtatcgccaggcccccggcaaaggcagggagttcgtgtcagccatcgactctgacgggactaccagatacgccgactccgtgaaagggcggtttaccatcagtcagggtacagctaagaataccgtgtacctccagatgaactccttgcagcctgaggacactgcaatgtattactgcaagaccgtgtgtgttgtcggcagccgttggtccgactactggggacagggaacccaggtcacagtctctagcggcggaagcgggggctcaggaggctctgggcaagtgcagttgcaggagagtggcggaggcagtgtgcaggccgggggctccctccgcctgagctgtactgcgagcggctacgtcagctgtgactactttctgccatcttggtatcgtcaggctcccggaaaggaacgcgagtttgtgtctgtgatcgacgggaccggctctacctcttacgccgcttccgtcaagggccgctttaccgcttcccaagataaggggaagaatatcgcttacttgcagatgaactccctgaagccagaagacaccgccatgtactattgcaaggcttcctgtgttcgtggccgcgccattagcgagtactggggccagggcacccaggtcaccgtgtccagt

SEQ ID NO: 1109 - DNA, 726 bp, synthetic construct
  source 1..726: mol_type = other DNA; note = Description of Artificial Sequence: Synthetic polynucleotide
caggtacaactccaggagagtggtggcgggagcgtgcaagcagggggctccctgcgcctgtcctgcgtcgcgtccgccagcacatattgcacctacgatatgcactggtatcgccaggcccctgggaagggtcgcgagttcgtgtccgccatcgactcagacggcactacccgctacgcggattctgtgaagggcagattcacaatttcccaggggaccgccaagaacacggtgtatctccagatgaactctttgcagcccgaggacactgccatgtattactgcaagaccgtgtgtgtcgtgggctccaggtggagcgactattggggccaggggacacaggttaccgtgtccagcggtggcggttcccaggtacagctccaggagtctggcggtggcctggtacagcccggtggaagcctgcgcctcagctgtgccgcttccggctttagcttcagttcttatgccatgaagtgggtccgccaggcccccggcaagggcctggaatgggtctccaccatctccagtgggggtagctccaccaactatgctgatagcgtgaagggacgctttaccatcagtcgtgataacgcgaagaacaccctttaccttcagctgaactctctgaagatcgaagacaccgccatgtactattgtgccaaggctatcgtgcctaccggggccactatggaaagaggacagggcacccaggtgacagtgtcctcc

SEQ ID NO: 1110 - DNA, 744 bp, synthetic construct
  source 1..744: mol_type = other DNA; note = Description of Artificial Sequence: Synthetic polynucleotide
caggtgcagttgcaggagtctggtggcgggtcagtgcaggctggaggctccctcaggctgagttgtgtcgcaagcgcaagcacatactgcacctatgatatgcactggtatcgccaagctcctggcaaaggtcgggagtttgtgtctgctattgatagcgacggcaccacgcgctacgcggactccgtgaagggcagatttacaatctcacaagggacggcgaaaaataccgtgtacctccagatgaactctctccagcccgaggataccgctatgtattactgcaagaccgtctgcgtcgtgggtagcaggtggtccgactactggggtcagggcactcaggtgacggtgtcttcaggaggctccgggggctctggcggtagcggacaggtgcagttgcaggagagcggcgggggtctggtgcagcctgggggttccctgagactgagctgcgccgcttctggtttcagttttagttcttacgctatgaagtgggtacgccaagcccctggtaagggtctggagtgggtttctacgatttctagcgggggcagctctacaaactacgcggatagcgtgaaaggacgctttaccatctcccgcgacaatgcaaagaacactttgtacctccagcttaattcactgaagatcgaggacacggctatgtactattgcgctaaggccatcgtgccgaccggagccactatggaaagaggtcaaggcacccaggtgactgtgtcctca

SEQ ID NO: 1111 - DNA, 738 bp, synthetic construct
  source 1..738: mol_type = other DNA; note = Description of Artificial Sequence: Synthetic polynucleotide
caggtccagctccaggagtccggcggaggctctgtgcaggcagggggctctctgaggctgagctgcgtcgcctcagcctctacctactgcacctatgacatgcactggtatcgtcaggctcctggcaagggtcgcgagttcgtttctgccattgattccgacggcaccactagatacgctgactccgtcaagggccgcttcaccatctcccaggggactgctaagaacaccgtgtaccttcagatgaactctcttcagcctgaagatactgcgatgtattactgcaagactgtttgcgttgtgggaagtcgttggtccgattactggggccagggtactcaagtgactgtaagctcaggtggcggatctcaggtccagctccaggagtcaggcggtggcctcgttcagccaggcgggtctctgagactgagctgcgctgcctctggattcaccttctcatcttaccccatgtcttgggtgcgtcaagcgcctgggaaaggtctggagtggatcagcacaatttcagctggtggagataccactctctacgctgacagcgtgaaaggccggttcacctccagccgcgacaacgccaagaataccctgtacctccagcttaactccctcaagacagaggacactgcaatttactattgcgctaagcggattgattgtaactccggctactgctacaggcgtaactattggggccaggggacgcaggtgacagtgtcatcc

SEQ ID NO: 1112 - DNA, 756 bp, synthetic construct
  source 1..756: mol_type = other DNA; note = Description of Artificial Sequence: Synthetic polynucleotide
caggtccagctccaggagagtggaggcggatctgtgcaggccgggggctccctgcgtctctcatgcgtcgccagcgcatctacttactgcacatacgacatgcactggtatcgtcaggcaccgggcaagggccgtgagttcgtctctgcgattgactctgacggaactacccgctacgccgattctgtgaaagggcggttcaccatctctcagggcactgccaagaataccgtctacctgcaaatgaacagcctccagccagaggataccgccatgtactattgcaagacggtctgcgtcgtgggctccagatggtccgattactggggccagggaacacaagtgacagttagttccggtggctcaggaggttccgggggcagcggtcaagtgcagttgcaggagagcggaggcggtctggttcagcctggcggttctcttcgcctgagctgcgctgcctcaggctttacgttctcctcttaccccatgtcctgggtgcggcaagctccggggaagggcctggagtggatctccaccattagtgcaggtggcgacaccactctgtacgctgacagtgtaaagggccgcttcacatcctctcgggacaacgccaaaaatacactctatttgcagctgaatagcctgaaaaccgaggacacggccatttactattgtgcaaagagaattgattgcaacagcggatactgttatcgcaggaactactggggccagggcacccaggtgacagtgtcctct

SEQ ID NO: 1113 - DNA, 738 bp, synthetic construct
  source 1..738: mol_type = other DNA; note = Description of Artificial Sequence: Synthetic polynucleotide
caggtgcagctccaggagtccggcgggggctcagtgcaggccggaggcagcttgaggctgagttgtgtggccagtgcctccacatattgcacctacgacatgcactggtatcggcaagcccctggtaagggacgggaatttgtaagtgctattgattctgatggcactacccgttacgccgacagcgtgaaaggccgcttcactatttcacaggggactgccaaaaataccgtgtaccttcagatgaactctcttcagcccgaggacacggcgatgtactattgcaagaccgtttgtgttgtgggtagtcgctggtccgactattggggccagggtactcaggtgactgtatccagcggcggaggcagccaggtgcagttgcaggagtccggcggtggaagcgtccaggtgggtggcagtctgcgcctctcatgtgccgcatccggcttcaccttctctagttaccctatgtcctgggtccgtcaggcccctggaaagggtcttgagtggatttccacaatctctgctgggggcgacacaaccctgtatgccgactccgtgaaaggccgcttcacctccagtcgcgacaatgcgaagaacaccctttatttgcagctgaactcactgaagaccgaggacaccgcaatttactattgtgctaagcgcattgattgcaatagcggctactgttaccggcgcaattattggggccagggtactcaggtgactgtgtcctct

SEQ ID NO: 1114 - DNA, 756 bp, synthetic construct
  source 1..756: mol_type = other DNA; note = Description of Artificial Sequence: Synthetic polynucleotide
caggtgcaactgcaagagagcggcggtggcagcgtacaggccggtggctctctccgccttagctgcgtcgccagcgcttccacttactgtacttacgacatgcactggtacaggcaagcgcccggcaagggacgcgagttcgtctccgccatcgacagcgacggcaccactcgctacgccgatagcgttaagggtcgcttcaccatttcacagggcaccgccaagaacaccgtctatcttcagatgaacagcctccagccagaggatacagccatgtactattgcaagaccgtctgcgtcgtgggctctcgttggagtgactattggggccagggcactcaagtgaccgtgtcctctggaggctccgggggcagcggcgggtccggtcaggtgcaactccaggagtccggcggaggctctgtgcaggttggtggaagcctgcgtctctcctgcgcggcctccggcttcactttctcctcttaccctatgagctgggtcaggcaggcccccggcaaggggctggagtggatctctaccatttctgccggaggggacactaccctgtacgcagattctgtgaaaggccgcttcaccagctctagggacaacgccaagaataccttgtatctccagctcaactccctcaagaccgaggacacagctatctattactgtgctaagaggatcgactgtaactctggttattgttatcgcaggaactattggggacaggggacccaagtgaccgtcagctct

SEQ ID NO: 1115 - DNA, 753 bp, synthetic construct
  source 1..753: mol_type = other DNA; note = Description of Artificial Sequence: Synthetic polynucleotide
caggtgcagcttcaggagtctggcggtggcagcgtccaagctggcgggagcctgcggctgtcttgtgtggcctccgcctcaacatactgtacctatgatatgcactggtatagacaagcgcccggcaagggcagggagttcgtctccgctattgatagcgatggaaccactcgttacgcggactccgtgaagggccgctttacgatcagccagggcaccgcgaagaacaccgtgtatcttcagatgaactctttgcagcccgaggacactgccatgtattactgcaagactgtttgtgtagtgggcagcaggtggagcgactactggggccagggaacacaggtcacagtaagctctggtggagggtctcaggtgcagcttcaagaatctggtggaggctccgtgcaatccggtggcagcctgaggctgtcctgcgctgcctcaggattcacttacagcacctctaactcctggatggcctggtttcgccaagcgcccggaaaagagagggaaggcgtggccgctatttacactgtcggtggctccatcttctacgcggatagtgtaaggggccgcttcaccatctctcaggacgccacaaaaaatatgttctacctccagatgaatacccttaaaccggaggacaccgctatgtattactgtgcagcggcaagtggaaggcttcgcgggaagtggttctggccttacgaatacaactactggggtcagggaactcaggtcacagtttcctcc

SEQ ID NO: 1116 - DNA, 771 bp, synthetic construct
  source 1..771: mol_type = other DNA; note = Description of Artificial Sequence: Synthetic polynucleotide
caggtccagttgcaggaatctggtggcggttccgtccaggcgggaggttccctgcgcctctcctgcgtggcctctgcctctacgtattgtacctacgacatgcactggtatcgccaggccccaggtaagggccgcgagttcgtttccgccattgattccgatgggaccacacgctatgctgattccgtgaagggccggttcaccatcagtcaaggcaccgccaagaacacagtgtacctccagatgaactccctccagcctgaggacacagccatgtactattgtaagacagtgtgtgtagtcggttcccgctggagcgactattggggacagggaacccaggtgacggtttcatccggtggcagcggaggtagcggcggtagcggacaggtgcagttgcaagaatccggcggtggctccgtgcagagcggaggctctctgcggctctcttgtgcggccagtggcttcacctactccaccagcaactcttggatggcttggttccgccaagcccctggcaaagaacgcgaaggcgtcgctgccatctacactgttgggggaagtattttttacgctgactccgtccgtggccgttttaccatctcccaggatgccacaaaaaatatgttctacctccagatgaacaccctgaagcccgaggataccgcaatgtactattgtgctgccgcatctggtcgtctgcgcggcaagtggttctggccctacgaatacaactactggggtcaaggtacacaggtgacggtgtcttcc

SEQ ID NO: 1117 - DNA, 756 bp, synthetic construct
  source 1..756: mol_type = other DNA; note = Description of Artificial Sequence: Synthetic polynucleotide
caggtgcagcttcaggaatccggcggaggctctgtgcaggcgggcggaagccttcggctgtcttgtgttgcctccgcgagcacctactgcacctacgatatgcactggtatcgccaggctcctggcaagggccgtgagtttgtgagcgccattgattccgacggaactacgagatatgccgacagtgtgaaaggtcgtttcactatttcacagggcaccgccaagaataccgtctatctccaaatgaacagtctccagccggaggacaccgccatgtattactgtaagacggtatgtgttgtggggtctcgctggtcagactactggggccaggggacacaggtgactgtcagctccggcgggggctcacaggtgcagctgcaagagagcggcggtggcagtgttcaggcgggcggttctctccgcctgtcttgcagggcctccgggagcacttacagcaattattgtttggggtggtttagacaaatcaccggcaaggagcgcgagggggtggccgtgataaattgggtgggcggtatgctctacttcgctgactctgtgaagggccgtttcacagtgtcccaggaccaggcgaaaaacaccctttacctccagatgaactctctcaagcccgaggacaccgccatgtattactgtgctgccgagtccgtgtcctctttcagctgcggtggctggctgacccgccctgatagggtgccgtattggggtcaaggaactcaggtcacagtgtccagc

SEQ ID NO: 1118 - DNA, 774 bp, synthetic construct
  source 1..774: mol_type = other DNA; note = Description of Artificial Sequence: Synthetic polynucleotide
caagtgcagctccaggagtccggcggaggttctgtccaggccggaggctcactgcgcctgtcctgtgtcgcttctgcgtctacttactgtacttatgatatgcactggtatcgccaggctccaggtaagggcagggagttcgtgtctgctattgattccgatggcacgacccgctatgccgattcagtgaaaggccgtttcacaatctctcagggaacagccaagaacacggtgtacttgcagatgaactctctgcaacccgaggacaccgccatgtattactgtaagactgtctgcgtggtcggctcacgctggtccgactattggggccaggggacccaagttactgtttccagcggaggcagcggtggatctgggggctccggccaggtgcagctccaggaatctgggggcgggtccgtgcaggctgggggatctctgcgcctgagttgtcgcgcaagtgggagtacctacagtaattattgcctgggatggttccgccagatcacaggtaaggagcgcgagggcgtggccgtgattaactgggtgggtggcatgttgtacttcgctgattccgtcaagggacgtttcactgtctctcaggaccaggctaagaataccttgtatcttcagatgaactccctgaagcctgaagatactgctatgtattactgtgcggctgagagcgtcagttccttctcctgtgggggctggctgactcgcccggaccgtgtgccctactggggccagggcactcaggtgaccgtgagcagc

SEQ ID NO: 1119 - DNA, 756 bp, synthetic construct
  source 1..756: mol_type = other DNA; note = Description of Artificial Sequence: Synthetic polynucleotide
caggtgcagcttcaggagagcggaggcgggtccgtgcaggctggtgggtcactgagactgtcatgtgtggcttcagcttcaacgtactgtacctatgacatgcactggtacaggcaagctcctgggaaaggccgcgagttcgtgtccgctattgacagcgacggtactacccgttatgccgacagcgtcaagggcagatttaccatctcccaaggcacggccaaaaacaccgtgtatctccagatgaacagccttcagcccgaggacaccgcaatgtattactgcaagaccgtgtgtgttgtggggagccgttggtccgactactggggccagggcacccaagtgaccgtctcctctgggggtggctcccaggtccagcttcaggagtccggcggaggcagtgttcaggccggagggagcctgagactgagctgccgtgcttctggtagtacttactctaactactgtttgggctggtttcgccaatccaccggcaaagagcgtgagggggtcgcggtcatcaactgggtcggaggtatgctgtactttgccgatagcgtcaagggaagatttaccgtctcccaagaccacgccaagaacaccgtgaccctgcaaatgaacagcctgaagccagaggataccgccatgtactattgcgcggcagaatccgtctccagcttttcttgcggaggctggctcacaagaccagggcgcgtgccttactggggacaaggcacccaggtgacagtcagctca

SEQ ID NO: 1120 - DNA, 774 bp, synthetic construct
  source 1..774: mol_type = other DNA; note = Description of Artificial Sequence: Synthetic polynucleotide
caggtgcagttgcaggagtctgggggcggaagtgtccaggctggaggctccctgcgcctgagttgtgtggccagcgccagcacttactgcacttatgacatgcactggtacagacaagcccctggcaagggtagggagttcgtgtctgctattgactccgacgggaccacacgttatgccgactctgtcaagggccgtttcactatctcccagggaacggccaagaacacagtgtacttgcagatgaactctttgcaacccgaagacaccgctatgtattactgtaagactgtgtgcgtcgtgggttccaggtggtcagactactggggtcagggtactcaggtcactgttagctcagggggttctgggggctccgggggttccggccaggtgcagcttcaggagtctggaggcggttccgtccaggcgggaggctctcttagactgtcctgccgcgccagcggcagcacctactccaactactgcctcggatggtttcgtcagtccacaggtaaggagcgcgaaggcgtggctgttatcaactgggtgggcggaatgctgtactttgctgactccgtgaaaggccgcttcactgtgtcacaagaccatgcaaagaacaccgtcacattgcagatgaactctctgaaaccagaggatactgccatgtattactgcgcagctgaatctgtgtcctctttctcttgcggtggctggctgacccgccctgggagagtgccgtactggggccagggcacccaagtgacagtcagttct

SEQ ID NO: 1121 - DNA, 756 bp, synthetic construct
  source 1..756: mol_type = other DNA; note = Description of Artificial Sequence: Synthetic polynucleotide
caagtacagctccaggaatctggaggcggtagcgtgcaggccgggggctccttgcgcttgtcctgcgttgcctcagccagcacctactgcacctacgacatgcactggtatcgccaagcaccagggaagggcagagagttcgtgtctgccatcgacagtgatggcactacccgctacgccgactccgttaaggggcgctttaccatttcccagggaacagccaagaacaccgtgtacttgcagatgaacagcttgcagcctgaagacaccgccatgtattactgcaagaccgtgtgtgtagtgggttcaaggtggtccgactattggggacagggcactcaggtgactgtgtcttccggcggaggcagccaggtacagctccaggaatccggtgggggctccgttcaggctggcgagtccctgcgcctgtcctgtagggcctccggctccacgtatagtaactactgtctgggctggttccgccagatcaccggcaaggaacgcgagggagtggcggtaataaattgggttgggggaatgctgtatttcgccgacagcgtgaaaggcagattcaccgtgtcccaggaccaggcgaagaacaccgtgtatttggaaatgaactctctgaagcccgaggataccgctatgtattactgcgctaccgaaagcgtaagctccttcagctgtgggggttggctgacacgccctgatcgggttccctactggggccagggtacgcaggtcaccgtttcctcc

SEQ ID NO: 1122 - DNA, 774 bp, synthetic construct
  source 1..774: mol_type = other DNA; note = Description of Artificial Sequence: Synthetic polynucleotide
caggtccagctgcaagagtccggtggaggcagtgtgcaggcaggcggtagcctgcgtttgtcctgtgtggcatccgccagtacctactgcacttacgatatgcactggtacagacaagcccccggcaaaggccgggagttcgtttcagctatcgactctgacgggaccactaggtatgcggactctgtcaagggccgctttacaattagccagggcacggccaaaaacaccgtatatctccagatgaacagcctccaaccagaagacacagccatgtattactgcaagactgtatgcgtggtcggctcccgttggtctgactattggggccagggaactcaggtcaccgtctcatccggtggctctggtgggagcgggggttccggccaggtgcagctccaggagtcaggtggcgggagcgtgcaggcgggggagtccctccggctgagttgtagggcttccggtagcacttactccaactactgcctcggctggtttcgccagatcacgggcaaggagcgcgagggcgtggccgtaattaactgggtcggagggatgctgtatttcgcggacagcgttaagggacgcttcaccgtgtcccaggatcaggccaagaacaccgtctatctggagatgaactccctgaagccggaggacacagccatgtattactgcgcaacggaatccgtgtctagcttcagctgcggtgggtggctcacccgtcccgaccgcgtgccgtattgggggcaggggacccaggtgactgtgtcctcc

SEQ ID NO: 1123 - DNA, 729 bp, synthetic construct
  source 1..729: mol_type = other DNA; note = Description of Artificial Sequence: Synthetic polynucleotide
caggtgcaactccaggagtcaggcggtggctccgtccaggcgggaggttccctgcgcctttcttgcgttgcatctgcgtccacctactgtacctatgacatgcactggtatcgtcaggcaccaggcaaggggagggagttcgtgtctgcgattgattctgatggcacaactaggtatgctgactccgtcaagggacggttcacaatctctcaagggaccgccaagaataccgtgtatctccagatgaactcccttcagcccgaggacacggccatgtattactgcaagaccgtttgcgtcgtgggttccaggtggtctgactactgggggcaaggcacgcaggtgaccgttagctctggcgggggtagccaggtgcagttgcaggaatctggtggaggttctgtgcaagcaggagggtctctgcgcttgagttgcgtagcaagtgggtacgtgagttgtgattacttcctgccttcttggtacaggcaggctccgggcaaggaacgcgagttcgtgtccattatcgacgggaccggctccaccagctatgccgcgagcgtcaaggggcgcttcacagccagccaggatcgcgggaagaacatcgcctacttgcagatgaacagcctgaaaccggaagatacagctatgtattactgtaaggcctcctgcgtccgtggccgtactattagtgaatactggggccaaggcacgcaggtgaccgtatcttcc

SEQ ID NO: 1124 - DNA, 747 bp, synthetic construct
  source 1..747: mol_type = other DNA; note = Description of Artificial Sequence: Synthetic polynucleotide
caggttcagctccaggagagcggaggtggcagcgttcaagccggtggctccctgcgcctgtcttgtgtcgcgtctgcttccacgtactgcacctacgacatgcactggtatcggcaggctcctggaaagggccgcgagttcgtctccgctatcgactctgacggaaccactcgctatgccgatagcgtgaagggccgcttcaccattagccaaggcacagccaagaacacagtgtacttgcagatgaacagcctccagccggaagacactgctatgtactattgcaagactgtgtgtgttgtggggtcccgttggtctgattattggggccagggcacccaggtgaccgtcagtagcgggggcagtggcgggtcaggaggctccggtcaggtgcagttgcaggagagcggagggggcagtgttcaggccgggggcagcctgagactgtcttgtgtcgcctccggctatgtgtcttgtgactactttctgccatcctggtatcggcaggcccctgggaaagaaagagagttcgtgtccattatcgacggcactggaagcacctcttatgctgcctctgtgaagggtaggtttactgcctcccaagacagggggaagaacattgcttatctccagatgaacagtctgaagcccgaggacactgcgatgtattactgtaaggcctcttgcgttcgcggtcgcacaatttccgagtactggggccagggaacacaggtgacggtgagtagc

SEQ ID NO: 1125 - DNA, 729 bp, synthetic construct
  source 1..729: mol_type = other DNA; note = Description of Artificial Sequence: Synthetic polynucleotide
caggtacagctccaggagtctggcggaggttcagtgcaggctggcggttctttgcgcctgtcctgtgtagcctccgccagcacatattgcacttacgacatgcactggtatcgccaggctccgggtaagggccgcgagtttgttagcgccatcgactccgatggaacaacccgttatgctgactctgtgaagggccgctttacaattagtcagggaaccgcaaagaatactgtttatttgcagatgaatagcctgcaacccgaggacaccgctatgtattactgtaagacagtgtgcgttgtgggctcccgctggagcgactattggggtcagggcacacaggttaccgtgtccagcggaggcgggagccaggtgcagctccaggagtcaggtggcggatctgtccaagctggaggttccctgcggttgtcttgtgtggcctctggttatgtgtcatgcgattatttcttgcccagctggtatcgccaggctccgggcaaggagcgcgaatttgtgtctatcattgacggcaccggctccacctcctacgcagccagtgtcaaggggcgcttcacggcaagccaagacaagggaaagaacatcgcctatttgcagatgaactctttgaagccagaggacaccgccatgtattactgtaaggcatcttgtgtgaggggccgcgcgatcagcgagtactggggccagggcacccaggtgaccgtgagcagc

SEQ ID NO: 1126 - DNA, 747 bp, synthetic construct
  source 1..747: mol_type = other DNA; note = Description of Artificial Sequence: Synthetic polynucleotide
caggtgcagcttcaggagtccggcgggggcagcgtgcaagccgggggatctctgcgcctctcctgtgtcgcgagcgcaagcacatactgcacctacgatatgcactggtatcgccaggcccccggcaagggcagagagttcgtgagcgcgattgattccgatggcactacccgctacgctgatagtgtgaaaggacggttcactatctcccagggcactgccaaaaacacagtgtacctccagatgaactcccttcagcccgaggacaccgccatgtattactgcaaaactgtgtgcgtggtagggtctcgctggagcgattattgggggcagggaacccaggtgacagtttcctctgggggcagcggaggttctggcggttccggccaggtgcagcttcaggaaagcggaggtgggagcgtgcaggccggaggcagcctcaggctgagctgcgtggcctccggttacgtatcatgcgattacttcctcccctcctggtatcggcaggctccgggcaaggagcgcgagttcgtgagcattatcgacggtacaggctccaccagctatgccgcatctgtgaagggacgtttcacagcttcccaggacaagggtaaaaacattgcctacttgcagatgaacagcttgaagccggaagataccgcaatgtattactgcaaagccagttgtgtccgtggccgcgctatctccgagtattggggacagggcacacaggtgacggtgtcctcc

SEQ ID NO: 1127 - DNA, 729 bp, synthetic construct
  source 1..729: mol_type = other DNA; note = Description of Artificial Sequence: Synthetic polynucleotide
caggtccagctccaggagagcggcggtggaagcgtccaggctgggggctctctgcgtctgtcttgtgtagcctctgcctccacttactgtacttacgacatgcactggtatcgccaggcccctggcaagggccgcgagttcgtttccgccattgattctgacggtactaccagatacgccgactccgtgaaaggtaggttcacgatcagccagggcactgccaaaaacacagtttatctccagatgaactccctccagcctgaggacactgccatgtattactgtaaaaccgtttgtgtggtcggatctcggtggtctgactattgggggcagggcacccaggtgaccgtatcttccggcggagggtcccaggtccagttgcaggagtctggcggaggctccgtacaggcagggggctccctgcgcctctcttgcgtggcctccggctacgtgtcttgcgactatttcctgccatcttggtatagacaggctcccggcaaggagcgcgagtttgtgtctattatcgacggcaccggctcaacttcctacgctgcctctgtgaagggccgctttaccgccagccaggacaaaggcaagaacatcgcgtacctccagatgaacaccctgaagcccgaggacaccgccatgtattactgtaaggcctcctgtgtgcgtggacgtgccatctccgaatactggggccagggcacccaggtgaccgtaagctca

SEQ ID NO: 1128 - DNA, 747 bp, synthetic construct
  source 1..747: mol_type = other DNA; note = Description of Artificial Sequence: Synthetic polynucleotide
caggtgcagctgcaagagagcggtgggggcagcgtgcaagctgggggcagcctgcgcctctcctgcgtcgcgtctgcttccacttactgtacttacgacatgcactggtatcgccaggcccctggcaagggccgcgagttcgtgtctgccattgacagcgatggaacgacccgctacgcggacagcgttaagggtcgcttcactatctctcagggcactgctaaaaacactgtgtacctccagatgaactctttgcagcccgaggatactgccatgtattactgtaagaccgtttgcgttgtgggttcccgttggtccgattattggggccagggcacccaggtgaccgtatcaagcggcgggtccgggggcagcggaggttcaggtcaggtgcagttgcaggaaagcggaggtggcagcgtacaggccgggggctccctgaggctgagctgcgtggcgagtggctacgtcagttgcgactacttcttgccttcttggtatcggcaagcccccggtaaggagcgcgagttcgtgagtattatcgacggcactggtagcacctcctatgctgccagcgtgaaaggtcgttttaccgcctcccaggacaagggtaaaaacattgcctatttgcaaatgaacacccttaaacctgaggacactgccatgtattactgtaaggcttcatgtgtgagaggtcgtgctatctcagaatactggggccagggcacccaagtcactgtttcttct

SEQ ID NO: 1129 - DNA, 756 bp, synthetic construct
  source 1..756: mol_type = other DNA; note = Description of Artificial Sequence: Synthetic polynucleotide
caggttcagctccaggaatccggcggtggctccgttcaggcagggggcagcctgcgtctgtcctgtgtcgcatccgcctctacctactgcacttacgatatgcactggtatcggcaggctcctggtaagggccgcgagttcgtcagtgctattgactccgacggtacaacccggtatgcggattctgtgaaaggaagatttacgatctcccaagggaccgcaaaaaacaccgtgtaccttcagatgaactctctccagcccgaagatacagcgatgtattactgcaagactgtatgcgtggtaggttctcgttggagcgactactggggccagggtacacaagtcaccgtctccagcggcgggggcagccaggtccagctccaggaatctggcggaggttccgtgcaggccggaggtagccttcgcctctcttgccgcgcatccggcagcacctactccaactactgtctgggctggttcaggcagatcaccggcaaggagcgcgagggcgtagccgtaataaattgggtaggcggtatgctgtactttgctgacagcgttaagggtcggtttacggtgtcccaggatcaggccaagaacaccgtgtatctccagatgaactccctgaagccggaggataccgctatgtactattgcgcagccgagtcagctagttccttcagctgcggtggctggctcacgagaccagatcgcgtcccctactggggacaaggcacacaggttaccgtgtcctcc

SEQ ID NO: 1130 - DNA, 774 bp, synthetic construct
  source 1..774: mol_type = other DNA; note = Description of Artificial Sequence: Synthetic polynucleotide
caggtccagcttcaggagagcgggggaggctccgtgcaagctggaggttccctccgcttgtcctgcgttgcgtccgcaagcacctactgcacttatgacatgcactggtatcgccaggctcctggcaaagggagagagttcgtctccgccattgatagcgatggtacaactaggtacgcagattccgttaaaggtaggtttactatcagccagggcacggccaaaaacaccgtctatctgcaaatgaactctctccagcccgaggataccgcgatgtactattgcaagaccgtctgtgtagtgggcagccgctggtcagactattggggccagggaacgcaggtgacagtgtctagcggcgggtccggcggttccggtggctccggccaggtacagctccaggagtcaggcggaggctccgtgcaagccgggggttctctgcggctctcctgtcgcgcttctgggtccacctattccaattactgcctgggctggttccgtcaaattacgggcaaggagcgcgaaggcgtggccgtgataaattgggtgggcgggatgttgtactttgctgacagcgttaagggacgttttactgtgtcccaggaccaggccaagaacaccgtgtacttgcagatgaactccttgaagccagaggacacagcaatgtattactgtgccgctgaaagcgccagctctttcagttgtgggggctggctgactagaccagaccgtgtcccttactggggtcagggcacccaggttaccgtgtcctcc

SEQ ID NO: 1131 - DNA, 738 bp, synthetic construct
  source 1..738: mol_type = other DNA; note = Description of Artificial Sequence: Synthetic polynucleotide
caagtccagctccaggagtccggcggtggctccgtccaggcgggcggatctctgcgcctgtcctgtgtcgcctccgcttccacatactgcacctatgacatgcactggtatcggcaggctcctggtaagggccgcgagttcgtcagcgccatcgactccgacggaacgacccggtacgctgatagcgtgaaaggtaggtttaccatctcacagggcaccgccaaaaataccgtctacttgcagatgaacagtttgcagcctgaggacaccgccatgtattactgcaagactgtgtgtgtagtggggtcacgctggtctgattattggggccagggtactcaggtgactgtgtctagtggcggtggcagccaggtgcagttgcaggagagtggaggcggtctcgtccagccaggaggcagtctgcgcctgtcatgcgctgcctccggctttactttttccctgtctggtatgtcatgggtgcggcaggcccccggcaagggtctggagtgggtcagtgcaatcagcagtggaggggcctctacttattacaccgacagcgtcaaaggcagattcaccatcagtagggataatgccaagaacatgctgtacctccagctgaactctctgaagacagaggacacggctatgtactattgtgctaaagggggcagcggttacggggatgcttccagaatgacttctccgggatctcagggtactcaagtcaccgttagttct

SEQ ID NO: 1132 - DNA, 756 bp, synthetic construct
  source 1..756: mol_type = other DNA; note = Description of Artificial Sequence: Synthetic polynucleotide
caagtccagctccaggagagcggagggggttccgtgcaggcagggggttcacttcgcctgtcctgtgtggcttctgcttccacctattgcacgtatgatatgcactggtatcgccaggctcccggcaagggccgcgagttcgtctcagcgattgattctgacggcaccactcgctacgctgactctgtgaagggccgctttaccatcagtcaaggtactgcgaagaacaccgtgtaccttcagatgaactcactgcaaccggaggacaccgcgatgtactattgcaagactgtttgtgtggtcggttcccgctggtccgattactgggggcagggcactcaggtgacggtcagttccggcgggagtggcgggtccgggggctctggccaagtgcagttgcaggagagcgggggaggcctcgtgcagccaggtggatctctgcggctgtcttgtgccgcttccggcttcactttttccctgtccggcatgagttgggtccgccaggccccagggaaaggcctggagtgggtgtccgccatctctagcggcggtgcctccacatattacactgacagcgtcaagggtcgctttacgatttcccgcgataacgctaagaacatgctctacctccagctgaacagcctgaagaccgaggatactgccatgtattactgtgccaaagggggtagcggctatggggacgccagcaggatgaccagtcccggaagtcagggaactcaggtcaccgtttcttcc

SEQ ID NO: 1133 - DNA, 729 bp, synthetic construct
  source 1..729: mol_type = other DNA; note = Description of Artificial Sequence: Synthetic polynucleotide
caggtacagcttcaggagagcgggggaggctctgtgcaggccggaggctctctgcgcctctcttgtgtcgcctccgcgtctacctattgcacctacgacatgcactggtatcgccaggcccccggaaaaggtcgcgagttcgtgtctgctatcgactccgacgggaccactcgctacgctgactccgtaaaaggacgttttacaattagtcagggtacagccaagaatacagtatacctgcaaatgaactccttgcagccagaggacaccgccatgtattactgcaagaccgtgtgcgtggtcggcagtcgctggtccgactactggggccagggaacccaggtcacggtctcaagcggagggggatcacaggtccagctgcaagaatcaggaggtggaagcgtgcaggcaggcggaagcctgaggctgtcctgcgtggccagcggctacgtgtcctgcgattactttctccctagctggtatcgccaggcacccggaaaagagagggagttcgtctcaattatcgacggaactggaagcacctcttacgccgcttccgtgaagggccgctttactgcatcacaggataagggcaagaatatcgcctacctccagatgaactcactgaagcctgaggacactgctatgtattactgcaaggcttcctgtgtgcggggtcgcggaatctctgagtactggggtcagggtactcaggtcaccgtctcttct

SEQ ID NO: 1134 - DNA, 747 bp, synthetic construct
  source 1..747: mol_type = other DNA; note = Description of Artificial Sequence: Synthetic polynucleotide
caggtgcagttgcaggagagcggaggtgggagtgtccaggctggtggctccttgcgcctgagctgcgtggcctccgcctccacttattgcacctacgacatgcactggtacaggcaagcccctggtaagggtagggagttcgtcagcgccattgatagcgatggcacaacccgttacgcggatagcgtgaagggccgtttcacaatctcacagggcaccgccaagaacaccgtttatttgcagatgaacagcctccagcccgaagatacagctatgtattactgtaagaccgtgtgtgtggttggtagcagatggtccgactactggggtcaaggcactcaagtcaccgtatccagcggcggatcaggaggcagcgggggttccgggcaggtgcagctccaggaatcaggcggtggcagcgtgcaggcagggggttccttgcgtctgagttgtgtggcaagtggctatgtaagctgtgactacttcctccccagttggtatcgccaggctcccggcaaggagcgggagttcgtgagtatcattgatggcactggtagcacctcctacgcagcgagcgtcaagggtcgttttaccgcgtctcaggacaagggaaaaaacatcgcgtacctccagatgaacagcctgaagcctgaggacacagccatgtattactgcaaggcctcctgcgtgcgcggtcgcggaatttccgagtattggggccagggcacccaagtaacagtaagctct

SEQ ID NO: 1135 - DNA, 756 bp, synthetic construct
  source 1..756: mol_type = other DNA; note = Description of Artificial Sequence: Synthetic polynucleotide
caggtccaacttcaagagtctggcggtgggtccgtccaggccgggggttccctcagactgtcatgcgtggcctccgcttccacctattgtacctacgacatgcactggtatcgccaggctcctggcaagggccgcgagttcgtgtctgccattgattcagacgggacaacccgctacgcagactccgtgaaaggtcgttttaccatctcacagggcactgcaaaaaacactgtctatctgcaaatgaactccttgcagccagaagacaccgccatgtattactgcaagaccgtatgtgtcgtgggaagccgttggtcagactactgggggcagggcacccaagttacggtgtcctctggcgggggcagtcaggtgcagttgcaggagagcgggggcggttctgtgcaagctggcggttccctgcgcctgagctgtcgcgcctctggatctacgtatagcaactactgcctgggctggttccgccagatcaccggaaaggaacgtgagggagtggccgtcatcaactgggtgggcggaatgctgtacttcgccgattctgtcaagggccggtttactgtctcccaggatcaggcgaagaacacggtataccttcagatgaacagcctgaaaccagaagataccgctatgtattactgtgccgcagagagcgtctccagcttttcctgcggaggctggctcacccgcccagatcgtgtgccttactgggggcaggggacccaggtgactgtttcctcc

SEQ ID NO: 1136 - DNA, 774 bp, synthetic construct
  source 1..774: mol_type = other DNA; note = Description of Artificial Sequence: Synthetic polynucleotide
caagtccagctccaggagtccggcgggggttccgtccaggctgggggctctttgcggttgtcttgtgtcgcatcagcctccacttattgtacctatgatatgcactggtatcgccaggctccggggaagggcagggaatttgtgtcagctattgattccgacggaaccacacggtatgcagattctgtgaaaggccgcttcactatctcacagggtactgccaagaacaccgtctacttgcagatgaactccctccagccagaggacactgccatgtattactgcaagaccgtctgtgtggttgggagtaggtggagtgactactggggccagggcacacaggtcacggtatcttccggcggaagcggcggaagtggtggctctggacaagtgcagttgcaggagagcggcgggggttccgtgcaggcaggcggaagcctgaggctgagctgtcgtgcttctggctccacctattccaactattgcttgggttggtttcgccaaattaccggcaaggagcgtgaaggcgttgctgtcatcaactgggttgggggtatgctctactttgctgactccgtgaagggtcgcttcacagtcagccaagaccaggctaagaacacagtgtatctccagatgaactctcttaaaccggaagacactgctatgtattactgcgccgcagaaagcgtcagctccttcagttgcggtggctggctgaccaggccagatcgcgtaccatattggggacagggaacccaggtcaccgtgtcctcc

SEQ ID NO: 1137 - DNA, 738 bp, synthetic construct
  source 1..738: mol_type = other DNA; note = Description of Artificial Sequence: Synthetic polynucleotide
caagtgcagctgcaagagagcggcggtggctccgtgcaggccgggggctccctgcgcctgagctgtgtggcaagcgcctcaacatactgcacctatgacatgcactggtatcgtcaggctcccggaaagggcagagagttcgtgtccgccatcgacagcgatgggacaacccgctacgcagacagcgtgaagggccgcttcactatctctcagggcacagctaagaacaccgtgtaccttcagatgaactccttgcagcctgaggatactgccatgtactattgcaagaccgtgtgtgtagtgggctccagatggtctgactactgggggcagggaacacaggttaccgtctctagcgggggcggaagccaagtgcagttgcaggaaagcgggggcgggctggtccagccagggggatctctgaggctgtcttgcgccgcatcaggttttactttctcaagctaccccatgtcctgggtcagacaagcgccggggaagggcttggaatgggtgagcaccatctccagcggtggagacacgaccctgtacgccgacagcgtcaaagggcgcttcacatctagccgcgacaatgcaaaaaacaccctgtacctccagcttaattccctgaagacagaggacaccgcaatgtactattgcgcgaaacggattgactgcaactccggttattgttacaagcgcagttactggggccaggggacccaggtgaccgtgtctagc

SEQ ID NO: 1138 - DNA, 756 bp, synthetic construct
  source 1..756: mol_type = other DNA; note = Description of Artificial Sequence: Synthetic polynucleotide
caggttcagcttcaggaatctggagggggatctgtgcaggctggtggaagcctgcgtctcagctgcgtggcctctgcctccacgtattgtacctacgacatgcactggtacaggcaggctccagggaagggccgggagtttgtgagcgctattgattcagacggcactacacggtacgctgacagtgtcaaggggaggttcaccatcagccaggggacagctaagaataccgtctacctccagatgaactcccttcagccggaggataccgctatgtattactgcaagacggtgtgcgtggtcggctcccgttggagcgactactgggggcagggcacccaagttaccgtgtccagcggaggttcaggcggttctggtggctctggccaggtgcagctccaggagagcggaggcggtctggtgcagccgggtggctccctgagactttcctgcgcagcttccggctttaccttctctagctatccaatgtcttgggtgagacaggcccctggaaagggtctggagtgggtgtctactatttcctctggtggcgatacaaccctgtacgcggattctgtcaaaggtcgtttcaccagctcacgcgacaacgctaagaacaccttgtatcttcagttgaacagcctgaagacagaggacactgcgatgtattactgtgcaaagcgcattgattgtaatagcggctactgttacaagcgtagctactggggccaaggcacccaggtcacggtcagcagc

SEQ ID NO: 1139 - DNA, 738 bp, synthetic construct
  source 1..738: mol_type = other DNA; note = Description of Artificial Sequence: Synthetic polynucleotide
caggtgcagcttcaggagtctggtggcggttccgtccaggctggcggttctctgaggctgtcatgcgtggcatctgcgagcacctactgtacttacgacatgcactggtatcgtcaggcccccggtaagggtcgggagttcgtgtccgccattgatagcgatgggacaacccggtacgccgactccgtgaagggtcgcttcactatctcacagggaaccgctaagaacacagtctaccttcagatgaactctttgcagccagaggacaccgccatgtattactgtaagacagtgtgtgtagttggaagccgctggagcgactactggggccaaggcactcaggtcaccgtcagctctggcggaggcagccaggtgcagttgcaggagagcggcggaggcttggtacagcccggaggctccctcaggctcagctgtgctgcctccggtttcaccttttccctgtcttccatgtcctgggtgcgtcaggcaccaggcaagggtctggagtgggtgtctgctatcagctccggcggagcttccacgtactatacagattccgttaagggacggttcactatctcccgtgacaacgcgaagaatatgctgtaccttcagctcaactcactgaagactgaggacaccgccatgtattactgcgccaaagggggctccggctatggcgacgcgagccgtatgactagccctggaagccaaggcacacaggtcaccgttagctcc

SEQ ID NO: 1140 - DNA, 756 bp, synthetic construct
  source 1..756: mol_type = other DNA; note = Description of Artificial Sequence: Synthetic polynucleotide
caggttcagcttcaggagagcgggggaggcagcgtccaggccggaggctcactgcgcctgtcttgtgtcgcctctgcatctacctactgcacttatgacatgcactggtatcgccaagcgccgggtaaaggacgcgagttcgtctctgccatcgactccgacggcacaactcgctacgccgactctgtgaagggcaggtttaccatcagccagggaaccgctaagaacaccgtttacctccagatgaactccctccagcctgaggacaccgccatgtattactgtaagaccgtttgtgtcgtgggctccaggtggtccgactactggggacagggcacccaggtgacagtctccagcggtggaagtggtggctccggcggttcaggccaggtccagttgcaggagtctggcggtggactcgtgcaacctgggggctctctgagactgagctgtgcggcttctgggttcaccttcagtctgagcagtatgagctgggtccgccaagccccaggaaagggactggaatgggtgtccgccatctcctctggcggagcgagcacatactatacagatagcgtgaaagggaggtttactatctctagggataacgcgaagaacatgctttatctccagcttaattccttgaagactgaggacactgccatgtactattgcgccaaaggtggcagcggttatggagacgccagtagaatgaccagcccaggttcccaggggactcaagtgaccgtcagttct

SEQ ID NO: 1141 - DNA, 756 bp, synthetic construct
  source 1..756: mol_type = other DNA; note = Description of Artificial Sequence: Synthetic polynucleotide
caggtgcagcttcaggaaagcggaggcggtagcgtacaggccgggggtagcctgcgtttgtcctgcgtggcgagcgcttccacgtactgtacctacgacatgcactggtatcgccaagcgccgggaaagggacgcgagttcgtttccgctattgattccgatgggaccacacgctacgcagattccgtgaagggccgcttcacaatttcccagggcacagccaagaacaccgtgtacctccagatgaactccttgcagcctgaggataccgccatgtattactgcaaaacagtctgcgtcgtgggttctcgttggtctgactattggggccagggaactcaggttaccgtttcctctgggggcgggtcccaggtccagctccaggagtcaggtggcgggtccgtccaagcaggtggctccctgcgcctgtcttgtcgggcgagcggcagtacttatagcaattactgtctgggctggttccggcagacaaccggcaaagagagagagggcgttgccgttattaactgggtgggtggaatgctgtacttcgccgactccgtaaagggacgcttcaccgttagccaggatcaggctaaaaatacagtatacctgcaaatgaacagtttgaagcctgaagacacagccatgtactattgcgccgctgagtctgtcagctctttttcttgcgggggatggctgactcgcccggatcgcgtaccttattggggccagggaacccaagtcacggtctctagt

SEQ ID NO: 1142 - DNA, 774 bp, synthetic construct
  source 1..774: mol_type = other DNA; note = Description of Artificial Sequence: Synthetic polynucleotide
caagtgcagcttcaggaaagcggaggtggaagtgtgcaggctgggggtagcctgaggctgtcctgcgtggcgagcgcgtccacttactgtacctacgacatgcactggtatcgccaagcaccaggcaagggtcgcgagttcgtttccgccattgatagcgatggcaccactcgttacgctgacagtgtgaagggtcgctttaccatttcccagggcacagcgaagaacaccgtttacctccagatgaacagccttcagccagaggatacagccatgtactattgcaaaaccgtgtgcgttgtgggcagccgttggtctgactattggggacaaggcactcaggttactgtcagctccggtgggtccgggggatctgggggcagcggccaggtccagctgcaagagtctggtggcggttccgtccaggcgggcgggagtttgcggctcagctgccgcgcctcaggctcaacttacagtaactattgcctgggctggttcaggcagaccacaggcaaggagagagagggtgtcgccgtcatcaactgggtaggcggtatgctgtacttcgccgactccgttaaagggcgtttcacggtttcccaagaccaggcaaagaacactgtgtatctccagatgaacagcctcaaacccgaagataccgcgatgtattactgtgctgccgagagcgtgtcttccttcagctgtggcggttggcttacacgcccggatcgggttccttactggggccagggcacacaggtgacagtctccagc

SEQ ID NO: 1143 - DNA, 756 bp, synthetic construct
  source 1..756: mol_type = other DNA; note = Description of Artificial Sequence: Synthetic polynucleotide
caggtgcagctccaggagagcggtggaggctctgtgcaggccggtggctcacttcgcctgtcctgcgtggcttcagccagcacttactgtacctatgatatgcactggtatcgccaggcccctggcaaaggacgcgagttcgtgtctgccattgatagtgatggcaccacacgctacgccgactcagttaagggtaggtttaccatttcccaaggcacggccaagaacaccgtgtacctgcaaatgaactccctccagcccgaggacacagcgatgtattactgcaagaccgtgtgtgttgtgggttcccgctggtccgactattggggtcagggcacgcaggtgaccgttagttccggtggaggcagccaggtccagcttcaggagtcaggcgggggctcagtccaggctggcggatctctccgcttgtcctgtagggcctcccgtagcccctacggcaactattgtttgggttggttccgccagtccactggcaaggagcgggagggagttgcggtcatcaactgggtgggcgggatgctctactttgcggactccgtgaaaggccgcttcaccgttagccaggatcacgctaagaacactgtgacactccagatgaacagcctgaagcctgaggatactgccatgtactattgcgccgcagagagcgtgtctagcttctcctgcggcggttggctgaccagacccgacagggttccgtattggggtcaaggcacccaggtgactgtctctagt

SEQ ID NO: 1144 - DNA, 774 bp, synthetic construct
  source 1..774: mol_type = other DNA; note = Description of Artificial Sequence: Synthetic polynucleotide
caggttcagcttcaggagagcgggggcggttctgttcaggcaggtgggtccctgagactgtcttgcgttgccagcgcctccacgtattgcacctatgacatgcactggtatcgccaggcccctggcaagggcagagagttcgtttctgccattgattctgatggcacaacccgctacgccgattctgtcaagggacgcttcacgatttcccaggggaccgccaagaacacggtatatctgcaaatgaactctctccagcctgaagacacagcgatgtactattgtaaaaccgtgtgcgtcgtaggcagtcgttggtccgattactggggccagggcactcaagtgactgtcagctccgggggctctggagggagcggtggctctggtcaggtccaactgcaagagtcaggcgggggctccgtgcaggccggaggctccctgcgcctttcctgtcgcgcaagccgttctccatacgggaactattgtctgggctggttcagacagagtactgggaaggagagggagggcgtggccgtcatcaactgggtcggtggaatgctgtacttcgctgacagtgtgaagggccgtttcactgtgtcccaggatcacgccaaaaacactgttacactccagatgaacagcctgaagccagaagatacagcaatgtattactgtgcggctgaatctgtttccagcttttcttgcggcggttggctgacgcgccctgatcgcgtcccctattggggccagggtactcaggttactgtgtcatct

SEQ ID NO: 1145 - DNA, 738 bp, synthetic construct
  source 1..738: mol_type = other DNA; note = Description of Artificial Sequence: Synthetic polynucleotide
caggttcagctgcaagagtctggcggaggctctgtgcaggcaggaggctctctccggctgagctgcgtggcctccgcctccacttactgtacttacgatatgcactggtatcgccaagcgccggggaagggccgtgagtttgttagcgccatcgactccgacggtacgactcgctacgccgattctgtgaaagggcgcttcactatttcccaaggcaccgccaaaaacaccgtgtaccttcagatgaactctcttcagccagaggacaccgccatgtattactgcaagacagtctgtgttgtgggcagtcgttggagcgattactggggtcagggtactcaggttactgtcagctccggcgggggaagccaggtccagctccaggagagcggcgggggcctggtgcaacctggcggttctctgcgcctttcctgcgctgcgtctggcttcacattctcccactccggcatgagctgggtccgtcaggctccggggaagggccttgagtgggtgtccacgatcaatagtggcggagccagcacctattacaccgactctgtcaagggccggttcactatcagccgggataacgccaagaacatgctgtatttgcagctgaactctctgaagacggaggacaccgcgatgtattactgtgccaagggaggctccggctatggggatgcctccaggatgacttctccgggtagccagggaacacaggtgacagtctcaagc

SEQ ID NO: 1146 - DNA, 756 bp, synthetic construct
  source 1..756: mol_type = other DNA; note = Description of Artificial Sequence: Synthetic polynucleotide
caggtccaactgcaagagtctggaggcggtagcgtccaggccgggggttccctgcggctgtcctgtgtcgcctctgcgagcacatactgtacctatgatatgcactggtatcgccaagcgccggggaagggacgcgagttcgtcagcgccattgattcagacggaacgactcggtacgcggactctgtcaagggacggttcaccatctcacagggtacagccaagaatacagtctacttgcagatgaactccttgcagcccgaggacacagccatgtattactgtaaaaccgtttgcgtagtgggctccaggtggagcgattactggggccagggcactcaggtcaccgtcagctccggcggttccggcgggagcggaggcagcggtcaggtacagctgcaagaaagcggaggtgggctggttcagccgggaggcagcctgcgcctgtcctgcgccgcgtcaggtttcacgttctctcactctgggatgagctgggtgcggcaagcgccgggcaagggcctcgaatgggtctctaccatcaattctggcggggcctccacctattacaccgatagcgttaaaggcagattcactatctcacgtgacaatgccaagaatatgctgtacttgcagctcaacagtctgaagaccgaagatactgctatgtattactgtgccaagggcgggagcggatatggtgacgcatcccgtatgaccagccctggctcccagggcacccaggtgaccgtctctagc

SEQ ID NO: 1147 - DNA, 732 bp, synthetic construct
  source 1..732: mol_type = other DNA; note = Description of Artificial Sequence: Synthetic polynucleotide
caagtccagctccaggagagcgggggaggctctgttcaggctgggggcagtctgacattgtcctgcgctgccagcgagtacgcctattccacctgtaacatgggatggtatcggcaagccccaggtaaggaacgcgaactcgtctcagctttcatcagcgatggcagcacttattacgccgactctgtgaagggccgctttaccatcacaagggataatgcaaagaatacagtgtatctgcaaatgaactccctcaagccggaggacacagctatctattactgttccgcgaactgctacaggcgtctgaggaactactgggggcagggcactcaggttaccgttagctccggcggtggaagccaggtgcagctccaggagtctggaggcgggctggtgcagcctgggggcagccttcgcctgtcttgcgcggccagcggattcaccttctctagctacccaatgtcttgggtgaggcaggctcctggcaaaggccttgagtggatctccacaatcagcgccggaggtgataccactctgtacgcagacagtgtgaagggccgcttcacatcttcccgcgacaatgccaagaacaccctgtacctccagctgaactcactgaagaccgaggacgcagcgatctactattgtgctaaacgtattgactgcaacagtgggtattgctaccgccgtaactactgggggcaagggacgcaggtcaccgtctcttcc

SEQ ID NO: 1148 - DNA, 750 bp, synthetic construct
  source 1..750: mol_type = other DNA; note = Description of Artificial Sequence: Synthetic polynucleotide
caggtgcagctccaggagtctggtggcggttctgtgcaggcagggggctcccttacactgagctgcgccgcgtcagagtatgcgtacagcacctgcaacatgggctggtatcgccaagccccaggtaaggagcgtgagctggtgtccgcgttcatctccgatggctctacttattacgctgactccgtcaagggacgcttcacaatcacacgtgacaacgcgaagaacaccgtgtaccttcagatgaactctctgaaaccagaagacacagcgatctactattgctctgctaactgctaccgcaggctgcgcaactactggggtcaaggcacccaggtcaccgtcagctccggtgggagtggtggcagcggtggctccggccaggtgcagctccaggagtctgggggcgggctggtgcagccaggtggctcccttagattgtcttgcgcagctagtggatttaccttttcttcctacccaatgtcctgggttcgccaagctcccggcaaggggctggaatggattagtaccatctctgcgggaggcgatactacactgtatgccgattccgtcaaaggccggttcacctcttccagagacaacgccaagaacaccctgtatttgcagctgaacagcctgaagaccgaggatgctgccatctactattgcgctaagcgtattgattgcaacagcggctactgttatcggcgcaactactggggccagggcacccaggttactgttagcagt

SEQ ID NO: 1149 - DNA, 732 bp, synthetic construct
  source 1..732: mol_type = other DNA; note = Description of Artificial Sequence: Synthetic polynucleotide
caggttcagctccaggaaagcggtggcgggagcgtgcaggccggaggctctctgactctgtcctgtgctgcgagcgaatacgcctactcaacttgcaacatgggctggtatcgccaggcacccggcaaagagcgcgagttggtgagtgccttcatctccgatggcagcacctattacgcagattccgttaaggggcgcttcacaatcacccgcgacaacgcgaagaacaccgtgtacctccagatgaactctctgaagcccgaggataccgccatttattactgttctgctaactgttacagacgccttcgtaattattggggccagggcacccaggtaaccgttagctctggcgggggcagccaggtgcagttgcaggagtccggcgggggactggtgcagcctggagggtctcttaggctgtcttgtgccgcgtccgggttcaccttttccctctccggcatgtcatgggttagacaggcaccaggcaagggccttgagtgggtatctgccatctcatccggcggggcctctacctactataccgattccgttaaaggccgcttcaccatttctagggacaatgcaaagaatatcctgtacctccagttgaacagtctgaagaccgaggatacagccatgtactattgtgcaaaagggggctccggctacggcgacgccagccgcatgacatctccagggtctcaaggcacccaagtgaccgtatctagc

SEQ ID NO: 1150 - DNA, 750 bp, synthetic construct
  source 1..750: mol_type = other DNA; note = Description of Artificial Sequence: Synthetic polynucleotide
caggtccagctgcaagaaagcggtgggggcagcgtacaggctgggggatctctgaccctgagctgtgctgcctcagagtacgcatattcaacctgcaatatgggctggtatcgccaagcccccggaaaggagcgcgaactcgtgtccgctttcatcagtgacgggtccacgtactatgccgattccgtcaaaggccgttttactatcacacgcgacaacgccaagaataccgtctacctccagatgaacagcctgaagccagaagatacagccatctattactgtagtgcgaactgctacagacgcctgcgcaactactggggacagggcacccaagtgactgtgtcctctggaggcagcggcggatctggagggagtggacaggttcagcttcaggagagcgggggcggactggtgcagccaggaggctccctgaggttgtcatgcgcggccagcggtttcaccttcagtttgtccggcatgtcatgggtacgccaagcgcccggtaagggtctggaatgggtgtccgctatttctagcggaggcgcgagtacctattacaccgacagcgtgaaggggcgctttactatctctcgtgataacgccaagaacattctctatctccaacttaattctctgaagaccgaggacaccgcgatgtattactgcgccaagggcggttctggttatggcgacgcttcccgcatgacatctccgggtagtcagggcacacaggtgactgtgtctagc

SEQ ID NO: 1151 - DNA, 723 bp, synthetic construct
  source 1..723: mol_type = other DNA; note = Description of Artificial Sequence: Synthetic polynucleotide
caggtgcagctccaggagtccggcggaggcagcgtgcaagccggtggctccctcaccctgtcatgcgcggccagcgagtacgcctatagcacctgtaacatgggctggtacaggcaagcgccgggtaaggagcgtgaactcgtctctgcctttatctccgatgggtccacctattacgcagacagcgtgaagggccggtttacgatcacccgcgacaacgccaaaaacacagtctatctccagatgaacagtctgaaacccgaggatacggcaatttactattgtagcgctaactgctaccgtagactcagaaactactggggccagggcacacaggtgaccgtgagttccgggggtgggtctcaggtgcaactccaagagtccggcgggggctccgtccaggctggcggtagcctgcgcttgtcttgtgtggcatctggatacgtatcttgcgactatttcctcccctcctggtatcgtcaagctccgggaaaagagcgggagttcgtgtccattatcgacgggaccggctccacgagctatgctgcctctgtgaagggaagatttactgccagtgaggacaagggtaagaatatcgcttatctgcaaatgaatagtctgaagccggaagacactgcgatgtattactgcaaggcgagttgcgtcagaggacgcgccgtatccgaatactgggggcagggtacgcaggtgacggtctcatct

SEQ ID NO: 1152 - DNA, 741 bp, synthetic construct
  source 1..741: mol_type = other DNA; note = Description of Artificial Sequence: Synthetic polynucleotide
caagtccagcttcaagagagtggcggaggctccgttcaggccggtggctctctgactttgtcctgcgccgcaagcgagtacgcatactctacctgcaatatgggctggtatagacaagcgcctggcaaggagcgcgagctggtatcagccttcatcagcgacggatctacctactatgcggattcagtgaaggggaggttcaccatcacacgcgacaacgcgaagaatactgtgtaccttcagatgaacagcctgaaacccgaggacaccgcaatctattactgctctgccaactgttacaggcggctgcgcaattactggggccaaggaacgcaagtgacagtatccagcggcgggagtggcggtagtggcggatctggccaggtgcagctccaggagagcggcggaggctccgtacaggcgggtggcagtttgcgcctgtcctgtgtcgctagtggttacgtgtcctgcgactattttttgccctcttggtatcggcaggctcctgggaaggaacgtgagttcgtaagcatcattgatgggaccggctccacctcctacgctgccagcgtcaaggggagatttactgcatccgaagataaaggcaaaaacattgcttacctccagatgaactccctcaaaccagaggataccgccatgtattactgcaaggcctcctgtgtgaggggccgcgccgtgtctgagtactggggtcagggcactcaggtgactgtctcctcc

SEQ ID NO: 1153 - DNA, 735 bp, synthetic construct
  source 1..735: mol_type = other DNA; note = Description of Artificial Sequence: Synthetic polynucleotide
caggtgcagcttcaggaatccggcggaggcagcgtccaagcgggaggcagcctgaccctgtcttgcgctgccagtgagtatgcttactccacttgtaacatgggctggtatcgtcaagcgccagggaaggagcgtgagctggtctctgccttcatctcagatggttccacctattacgctgacagtgtcaagggcaggttcaccatcactcgggataatgccaagaacaccgtgtacctccagatgaactccctgaagcctgaagacactgccatctattactgctccgccaactgctaccgtcgcctgagaaattactggggtcagggaacccaggtcaccgtgtcttccggcggaggctcccaggtccagctgcaagagtctggtggcggtttggtgcagcctggcgagtccctgcgcctgtcttgcaccgcgagcggcttcaccttcagcaattacgctatgagctgggtccgtcaggctcctgggaagggcctggagtgggtaagtggaatcaacgtggcctacggtatcacgtcctatgctgatagcgtgaagggcagatttaccatctctcgggacaacaccaagaacacactgtacctccaactcaacagcctgaagaccgaagacacggctatctattactgtgtcaagcacagtggcaccacgatccccagaggctttattagttatactaaacggggtcaggggacccaggtgaccgtcagctcc

SEQ ID NO: 1154 - DNA, 753 bp, synthetic construct
  source 1..753: mol_type = other DNA; note = Description of Artificial Sequence: Synthetic polynucleotide
caagttcagcttcaggaaagcggcggaggcagcgtccaggccggtggaagtttgacgctgagctgtgcggctagtgaatacgcatattccacctgcaatatggggtggtacaggcaggcccccggcaaggaacgcgaactggtgagtgcttttatcagcgacggctccacgtattacgcagattccgtgaaaggaaggtttaccattacccgcgataacgccaagaacactgtgtaccttcagatgaactctctcaaacccgaggacactgccatctactattgctcagccaactgttaccgcaggttgcgtaactactggggccagggcacccaggtcacagtcagctccggcgggagtggtggatctggcggttccgggcaagtgcaacttcaggaatccggcgggggcctggtgcagcctggggagtccctgcgccttagctgtactgcttccggcttcaccttttccaactacgccatgagttgggtgcgccaggctcctggcaagggcttggagtgggtgtctgggattaacgtggcttacgggattacctcttatgccgactcagtcaagggtcgtttcacaatcagtcgcgacaacaccaaaaacactctgtatctgcaactgaatagtctgaagaccgaggataccgctatctattactgcgtcaagcactccggtactaccatccccaggggctttattagttacacgaaacggggtcaggggactcaggtgacagtgtcctcc

SEQ ID NO: 1155 - DNA, 723 bp, synthetic construct
  source 1..723: mol_type = other DNA; note = Description of Artificial Sequence: Synthetic polynucleotide
caggtgcagctgcaagaatccggcggaggctccgtgcaggcaggtggcagtctgacactgagctgcgccgcttccgagtatgcctattccacctgcaacatgggttggtacaggcaggctcctggtaaggaacgcgaattggtgtccgccttcatttccgatggtagcacctactatgccgacagtgtaaaggggcggttcaccatcactcgggacaacgcaaaaaataccgtgtacctgcaaatgaactccttgaagccagaggacaccgctatctattactgctccgcaaactgctatcgcaggctgaggaactattggggccagggcacccaggtgacggtctcctctgggggtggctcccaagtccagctccaggagtcaggaggtgggagtgtgcaagccgggggaagcctgcgtctctcctgtaccgccagcggctacgtgagctgtgactatttcctcccctcatggtatagacaggcccctgggaaggagagagaatttgttagcgtgatcgacggcaccgggtccaccagttacgctgccagcgtcaaagggcgctttaccgcttctcaggacaaggggaagaacattgcctacctgcaaatgaacagcctgaaacccgaggacactgcaatgtattactgtaaggccagttgtgtgcgtggccgtgccattagcgaatattggggccagggcacccaggtgaccgtgtctagt

SEQ ID NO: 1156 - DNA, 741 bp, synthetic construct
  source 1..741: mol_type = other DNA; note = Description of Artificial Sequence: Synthetic polynucleotide
caggtccagctccaggagagcggaggtggcagtgtgcaggctggtggctccctgacccttagttgtgcagccagcgaatatgcttactccacctgtaacatgggatggtatcgtcaggctccgggcaaggagcgggagcttgtgagcgcatttatcagcgacgggtcaacctattacgcagattccgtgaaagggcgcttcaccatcacccgtgacaacgctaagaacaccgtctacctccagatgaactcactgaagcccgaggacactgctatctattactgttctgccaactgctacagacgcctcaggaattactggggacagggcacgcaggtcactgttagctccggtggcagtggtggcagcgggggcagtggacaggtgcagttgcaggaatccggtggcgggagtgttcaggcaggcggatctctgcgcctgagctgcaccgcctctggatatgtgagctgtgattacttcctgcctagctggtatcggcaggcccccggcaaggaacgtgagttcgtgagcgtcatcgacggcaccggctccacctcttacgcagcctctgtgaagggccgcttcacagccagccaagacaaggggaagaatatcgcctatctccagatgaacagcctgaaacccgaggatacagccatgtattactgtaaagccagctgtgtgcgcggcagagctatctccgagtactggggccagggcacccaggttaccgtctcctcc

SEQ ID NO: 1157 - DNA, 720 bp, synthetic construct
  source 1..720: mol_type = other DNA; note = Description of Artificial Sequence: Synthetic polynucleotide
caggtccaactccaggagagcggagggggctctgttcaggccggaggctccctgaccctctcctgcgcagccagtgaatatgcttactccacttgtaacatgggatggtatcgtcaagcccctggtaaagaacgtgagctggtctccgcctttatctccgacggttccacttattacgccgatagtgtcaagggccgctttaccatcacgagggacaatgccaagaataccgtctacctccagatgaactctctgaagcctgaggatactgccatctactattgtagtgcaaactgctaccggagattgagaaattattggggtcagggcacccaggtgacagtgtccagcggtggcgggagtcaagtgcagttgcaggagtctggtggcggactggtgcagccgggcggaagtctgcgtttgtcttgcgccgcgagcggtttcagttttagcagttacgccatgaaatgggtgcgtcaggcccctgggaagggcctggagtgggtgagtaccatctccagcggtggcagcagtactaactacgccgactctgtgaaaggccgcttcacaatctcacgtgataacgccaaaaataccctctaccttcagctcaactccctgaaaatcgaggacactgccatgtactattgtgctaaggccattgtgccgactggtgccactatggaacgtgggcagggcactcaggtgaccgtttcttcc

SEQ ID NO: 1158 - DNA, 738 bp, synthetic construct
  source 1..738: mol_type = other DNA; note = Description of Artificial Sequence: Synthetic polynucleotide
caggtgcagctccaggaaagcggtggaggctccgtgcaggctggcggttccctgacgctgtcttgtgcagcctccgagtacgcctatagcacctgcaacatgggctggtatcgccaggcccccggcaaggaacgtgaactggtatccgcgttcatctctgatggcagtacctactatgcggattctgtgaagggccgcttcaccatcacaagagacaacgctaagaacaccgtgtatctccaaatgaactccctcaagcccgaggatacagcaatctactattgcagcgctaactgctacagacgcctgaggaactattggggacaggggacccaggtgacagtttctagtggaggcagcggaggcagcggagggtctggccaggttcagttgcaggagagtgggggcggtttggtgcagccagggggctccctgaggctcagttgcgctgcctctggattctccttctcctcttatgccatgaagtgggtgcgccaagcgcccggcaagggcctggagtgggtatctaccatcagctctgggggctccagcacgaattacgcagacagcgtgaagggacgctttactatttcaagagataatgccaagaacactctgtatcttcagctcaactccctgaagatcgaggataccgctatgtactattgcgccaaagccatcgtccccactggggcaacaatggaacgcggccaaggaacacaggtcaccgtcagttct

SEQ ID NO: 1159 - DNA, 732 bp, synthetic construct
  source 1..732: mol_type = other DNA; note = Description of Artificial Sequence: Synthetic polynucleotide
caggtgcagttgcaggagagcggcggtggctccgtacaggcagggggctcactgaccctgagctgtgcagctagtgagtatgcctatagcacttgcaacatggggtggtatcgtcaggcccctggcaaggagcgcgagcttgtgagcgcgttcattagcgatggctccacctactatgcagacagcgttaagggccgctttaccatcacccgcgataacgctaaaaacaccgtttacctccagatgaactccctgaagcctgaggatacggctatctattactgctccgctaattgttatcgcaggctgcgtaactactggggtcaaggcacccaggtgaccgtgtcttccggcggtggctcccaggtccagctgcaagagtccggcggtggccttgtgcaacctggaggctccctgagactttcctgcgctgcctccggcttcacgttcagctcttatcccatgagctgggtgagacaggctcctggtaagggcctggaatggatttccaccatctctgcgggcggtgacacgacactctacgctgatagtgttaagggacgtttcacctcctctcgcgataacgcgaagaacaccctgtaccttcagcttaattccctgaaaaccgaagacaccgctatctactattgcgccaagagaattgactgcaactccggttactgttatcgtcgcaactactggggccagggcacccaggtgacagtctcttct

SEQ ID NO: 1160 - DNA, 750 bp, synthetic construct
  source 1..750: mol_type = other DNA; note = Description of Artificial Sequence: Synthetic polynucleotide
caggtccagttgcaggagtctggcgggggctcagtgcaagccgggggctccctgactctgagctgcgctgcctctgagtatgcttactccacgtgcaacatggggtggtatcgccaggcccccggaaaggaacgcgagctggtgtctgccttcatctctgacggcagcacatattacgctgactccgtaaaaggtagatttaccatcacccgcgacaatgcgaaaaacacagtttatctccagatgaactccctgaaaccggaggacaccgcgatctactattgcagcgcgaattgttaccgccgtcttcgtaattactgggggcagggaacccaggtgacagtctccagcgggggctccggtggctccggtggctccggccaggtgcagctccaggagtctggtggcgggttggtgcagcccggaggtagcctgaggctgtcctgtgctgcatctggttttaccttcagcagttatccaatgtcttgggtacgccaagcgcccggtaagggcttggagtggatttctacaattagcgccggaggcgatactaccctgtacgctgactctgtgaagggtcgtttcacatcctctagggataacgcgaaaaatacactgtaccttcagctcaatagtctgaagaccgaggacaccgcaatctattactgtgcaaaacgcatcgactgtaatagcggatactgctacaggcgtaactactggggccagggaacccaggtgaccgtcagtagc

SEQ ID NO: 1161 - DNA, 732 bp, synthetic construct
  source 1..732: mol_type = other DNA; note = Description of Artificial Sequence: Synthetic polynucleotide
caggtacagttgcaggaaagtgggggcgggtctgtgcaggctggcgggtccttgaccctgtcatgtgccgcttctgagtacgcctactccacctgtaacatgggctggtatcgtcaggctcccggcaaggagcgcgagctggtatccgccttcatctctgatggcagcacctattacgccgatagcgtgaagggtcgtttcactatcacacgggacaacgcgaagaacacagtgtatttgcaaatgaacagcttgaagcccgaagataccgctatctattactgctctgctaactgttatcgtcgcctgcggaactactgggggcaggggactcaggtaactgtttccagcggaggcggtagccaggtccagcttcaggagagcggcggaggctccgtgcaggtcggtggctctctccgcctctcatgtgctgccagcggatttactttcagctcctaccccatgtcatgggtgcggcaggctcccggaaagggccttgaatggattagcacgattagcgccggtggcgacacaaccctgtacgccgactctgtcaagggtcgtttcacgtcctcaagagacaacgcgaagaacactctgtacttgcagctcaattctctgaagacagaggacaccgccatctattactgtgcaaagaggattgactgcaacagcggctattgctacagacgtaactattggggtcagggcactcaggtgactgtgtccagt

SEQ ID NO: 1162 - DNA, 750 bp, synthetic construct
  source 1..750: mol_type = other DNA; note = Description of Artificial Sequence: Synthetic polynucleotide
caggtgcagctgcaagagtctgggggcgggtccgtgcaggccggaggtagtctgactctttcctgcgctgcgtctgagtacgcctactccacctgtaacatgggatggtacagacaggcccctggcaaagagagagaactggtgtccgcttttatcagcgacggcagcacttactatgctgacagtgtgaagggcaggttcaccatcacccgtgataacgccaagaacactgtctaccttcagatgaactctttgaaaccagaggacacagctatctactattgcagcgctaactgctacagacgcctcaggaactattgggggcagggcacccaggtgaccgtttctagtggaggtagcggaggcagcggtggaagcggccaggtgcagctccaggagtccggtggcgggtccgtccaggtcggcgggtctctccgcctgtcctgcgctgccagcgggttcaccttctccagctaccccatgagctgggtcaggcaggcccctggcaagggcctcgaatggatcagcactatttccgccggtggcgacacaaccctctacgccgacagcgtcaagggacggttcaccagcagtcgtgacaacgctaaaaataccctgtacctccagcttaatagcctgaagaccgaagatacagcaatctattactgcgccaagaggatcgactgcaactcagggtactgttaccgtcgcaactactggggacagggaactcaagtgactgtgtcttcc

SEQ ID NO: 1163 - DNA, 747 bp, synthetic construct
  source 1..747: mol_type = other DNA; note = Description of Artificial Sequence: Synthetic polynucleotide
caggtccagttgcaggagtccggcggtggaagtgtgcaggctggtggcagcctgaccttgtcttgtgccgctagtgagtacgcttattcaacctgcaacatgggctggtacagacaggctccgggaaaggagcgcgagctggtgtctgccttcatctccgatggttcaacatactatgctgactccgtgaaggggcgcttcaccatcacgcgcgataatgcaaagaataccgtgtaccttcaaatgaatagtctgaaacccgaggataccgctatctattactgctccgccaactgctatcgtcgcctgcgtaattactggggccagggcacccaggtcactgttagttcaggaggcggaagccaggtccagttgcaggagtccgggggtggctccgtccagagcggcggtagcctgagattgagttgcgcggcctcaggcttcacctacagcaccagcaatagctggatggcctggttccgtcaggctccgggcaaagagagggagggcgtggcggccatctacactgtgggcggtagcatcttctacgcggacagcgttcggggtcgcttcactatcagccaagacgctaccaagaatatgttctacctccagatgaacactctgaagcccgaggacaccgccatgtactattgcgctgccgcttctggccgcctgcgcggtaagtggttttggccctatgagtacaactattggggtcaaggaacccaggtgaccgtgtcttcc

SEQ ID NO: 1164 - DNA, 765 bp, synthetic construct
  source 1..765: mol_type = other DNA; note = Description of Artificial Sequence: Synthetic polynucleotide
caggtccagttgcaggagagcggtggcggatctgtccaagccggaggtagtctcacgctcagctgtgccgcgagcgaatacgcctactccacctgtaatatggggtggtatcgtcaggcaccaggcaaagagcgcgaactggtgtccgcgttcatctccgacggctcaacgtattacgccgatagcgtaaagggccggtttacaatcacccgcgacaacgccaagaataccgtctaccttcagatgaactccctgaagccagaggacactgcaatttactattgcagcgctaactgttaccgccgtctgcgcaactactggggacaaggaacccaagttaccgtgagttctggtggctctggtggcagcggaggcagcggacaagttcagcttcaggagtctggaggtggctcagtacagtctggtggctccctccgcctcagctgtgcagcttcaggtttcacctactccacgtccaacagttggatggcctggtttcggcaagctccgggaaaagagcgtgagggagtggctgcgatctatacagtcgggggatctatcttctacgcggactccgtcagaggcaggttcaccatttctcaggatgctactaaaaatatgttctatcttcagatgaacacgctgaagccagaggacacagccatgtactattgcgccgcagcctcaggcaggctgcgcggtaaatggttttggccttacgagtacaactattggggtcagggcacccaggtgaccgtgagttct

SEQ ID NO: 1165 - DNA, 750 bp, synthetic construct
  source 1..750: mol_type = other DNA; note = Description of Artificial Sequence: Synthetic polynucleotide
caggtgcagttgcaggagtccggcgggggctccgtgcaggcgggcggtagcctgactctgtcatgtgccgcgtccgagtacgcttactctacctgcaacatgggctggtatcgccaggctcctggaaaagaacgcgaactggtgagtgcctttatctctgacggttccacttattacgccgattccgtgaaggggcgctttacaatcactcgcgataatgccaagaacacagtgtacctccagatgaacagcctgaaaccagaggacaccgctatttactattgcagcgcgaactgctacagacgcctcaggaactattggggacagggcacccaggtgacagtttccagtggaggtggctcccaggtccagttgcaggaaagtgggggagggtccgtccaagctggcggttctctgcggctctcatgcagggcctccggttccacttatagtaactattgcttgggctggttcaggcagatcaccggcaaggagcgcgagggagtggctgtcatcaactgggtgggcggtatgctttatttcgccgactccgtgaagggccgttttacagtgtcacaagaccaggccaaaaatactctgtacctgcaaatgaacagtttgaagcctgaggataccgcgatgtactattgtgccgctgagtccgtaagtagctttagctgcggcggttggttgaccagacctgaccgcgtgccatattggggtcagggcacacaggtgacagtgagcagc

SEQ ID NO: 1166 - DNA, 768 bp, synthetic construct
  source 1..768: mol_type = other DNA; note = Description of Artificial Sequence: Synthetic polynucleotide
caagtgcagttgcaggaaagcggaggcgggtctgttcaggccggaggcagccttacgctgtcctgcgctgcctcagaatacgcatacagtacctgtaacatgggctggtatcgccaggcccctgggaaggagagagagctggtgagtgccttcatttctgacggctctacctactatgctgatagcgtgaagggtaggtttacaatcacccgcgacaacgccaaaaataccgtttaccttcagatgaacagcctgaagccggaagacaccgccatctattactgctctgccaactgctatcgccgtctgcgcaattactggggccagggcacccaggtcaccgtgtccagcggcggttctggtgggtctggagggtccgggcaggtgcagctgcaagagtctggaggtggctccgtccaggccgggggcagtctgcgcttgtcatgtcgggcctctggttccacttactccaactactgcttgggatggttccggcagattacaggcaaggaacgcgagggagtcgcagtcatcaactgggtgggcggaatgctttactttgccgattccgtcaagggcaggttcactgtgagccaggatcaggctaagaacacactgtaccttcagatgaatagcctgaagcccgaggacactgctatgtattactgtgctgccgaaagcgtgtcctcattctcctgcggaggctggctgacccgccctgatcgggtgccgtactggggtcaaggcactcaagtgactgtctcatct

SEQ ID NO: 1167 - DNA, 750 bp, synthetic construct
  source 1..750: mol_type = other DNA; note = Description of Artificial Sequence: Synthetic polynucleotide
caagtacagttgcaggagagcggtggcggttcagtgcaggccgggggaagtctgaccctgagttgcgcggccagcgagtatgcctacagtacctgtaacatgggctggtatcgccaagcacctggcaaggaacgtgagctggtttcagccttcatctccgacggctccacctattacgctgacagcgtgaagggtaggttcactattactcgggacaacgcgaagaataccgtatacttgcagatgaactcactgaagcctgaggacaccgccatctattactgctccgccaactgctaccgtcgccttcgtaattattgggggcagggaacccaggtcactgtcagctctggaggcggttcacaagtacagttgcaggagtctggtgggggtagcgtccaggccgggggaagccttcgcctttcttgccgcgccagcggctccacctactcaaattactgcctcggatggtttcgccagtctaccggaaaggaacgcgagggtgtcgcagtgataaattgggtcggcggtatgctgtacttcgcggattctgtgaagggcaggttcacagtttcccaggatcacgccaagaacaccgtgaccctccagatgaactccctgaagccggaagataccgcaatgtattactgtgccgctgagtctgtgtcatctttttcttgcggtggatggttgactcgccccggtcgcgtgccttattggggccaaggcacacaagtgacagtgtctagc

SEQ ID NO: 1168 - DNA, 768 bp, synthetic construct
  source 1..768: mol_type = other DNA; note = Description of Artificial Sequence: Synthetic polynucleotide
caggtgcagttgcaggaaagcggtggagggtccgtgcaggccgggggctctctgacactgtcttgtgccgctagtgagtacgcatacagcacatgcaacatgggctggtatcgtcaagctccgggtaaggagcgtgagcttgtctccgcattcatcagtgacggctcaacctattacgcggacagcgtgaagggaagatttaccatcacccgcgataacgccaagaacactgtctacctccagatgaacagcctgaaacctgaggatactgctatttactattgcagtgcaaactgttaccgtcgccttcgcaactattggggccagggcacacaagtgactgtgagttcaggtggctccggtggctcaggtggctccggtcaggtccagctccaggagtccggcggaggctccgtgcaggcagggggctctctgaggctgtcctgtagggcatccggttccacctatagtaactactgcctgggctggttccgccagagcaccggaaaggaacgcgagggcgtggccgtcatcaactgggtcgggggcatgttgtacttcgcggactctgtgaagggccgcttcaccgtgtcccaagatcacgccaaaaacactgtgactctccagatgaatagcctcaagcccgaagatacggcgatgtactattgcgcagccgagtccgtgagttccttctcatgcggtggctggctgacccgccccggtcgcgtgccttactggggccagggtactcaggtgaccgtctcctcc

SEQ ID NO: 1169 - DNA, 750 bp, synthetic construct
  source 1..750: mol_type = other DNA; note = Description of Artificial Sequence: Synthetic polynucleotide
caggtgcagttgcaggagtccggcggtgggagcgtacaggctggcggttctctgacactttcctgcgcagccagcgagtacgcctactccacctgcaacatggggtggtatcgccaagcgcctggaaaggagcgcgagctggttagcgccttcatcagtgatggctccacatattacgcggacagcgtgaagggacgcttcaccatcacccgtgacaacgcgaaaaacacagtctacttgcagatgaactccctcaagcctgaggatacagccatctactattgctccgccaactgctataggagattgcgcaactactgggggcaaggaacgcaggtcaccgtctcctctgggggaggcagccaagtgcaactccaggagagcgggggtggcagcgtgcaggcgggtgagtctctcagactgtcttgccgcgcgtctggctctacatattctaactattgcctgggttggttccggcagattactggcaaggagcgcgagggtgttgctgtgattaactgggtgggcggtatgctgtacttcgccgattccgtcaagggacgtttcaccgttagccaggaccaggccaaaaacaccgtctacctggagatgaatagcttgaagcccgaagataccgcgatgtattactgcgccaccgagagtgtctcatctttttcctgtgggggttggcttactcgcccagacagggtgccatactggggacagggcactcaggtgactgtaagcagc

SEQ ID NO: 1170 - DNA, 768 bp, synthetic construct
  source 1..768: mol_type = other DNA; note = Description of Artificial Sequence: Synthetic polynucleotide
caggttcagttgcaggagagtggcggaggcagcgttcaggccggaggctctctgaccctgtcatgcgcggccagcgagtacgcctacagcacctgcaacatgggatggtatcgccaggcacccggtaaggagagagaactggtgtccgccttcatctctgacggctccacttactatgctgatagcgtgaagggtcgctttaccatcacgcgcgataacgcaaaaaataccgtgtatttgcagatgaactctctcaagcccgaggataccgccatttattactgtagcgctaactgttaccgtcgcctgcgcaactattggggccagggcacccaggttactgtcagctccggtggctccggcggttctgggggctccggccaggtgcagctccaggagtctggtggaggctccgtgcaggcaggtgagtccttgcgtctgtcctgccgggccagcggttcaacatattctaactactgcctggggtggttccgccagattaccggcaaagagcgcgagggtgtcgcagtcatcaactgggtcggaggtatgctgtacttcgccgattctgtgaagggacgtttcaccgtgtcccaggaccaggccaagaacacagtatatctggagatgaactccctgaagcctgaagatacagccatgtattactgcgccacggagtccgtcagctccttctcctgtggcggatggttgaccaggcccgacagggtgccttattggggtcagggcacccaagtcaccgtgagcagc

SEQ ID NO: 1171 - DNA, 723 bp, synthetic construct
  source 1..723: mol_type = other DNA; note = Description of Artificial Sequence: Synthetic polynucleotide
caggtgcagctccaggagtccggcggtggctctgtgcaggcgggcggtagccttactctcagctgtgctgcgtctgaatacgcttattctacctgtaatatgggctggtatcggcaggcccctggcaaggagagagaactcgtgagcgccttcatctccgacggctctacctactatgccgacagtgtgaagggccgcttcactattactcgcgataacgctaagaacacggtgtacctccagatgaactctctgaagccggaggacacggccatttattactgctccgctaactgctacagacggctgcgtaactactggggccagggcacccaggtaaccgtcagctccggcggaggttctcaggttcagctccaagagtctgggggcgggagcgtccaggccggagggtccctcaggttgtcctgcgtggccagcggatatgtgtcttgtgactacttcctgcccagctggtatcgccaggctccagggaaggaacgtgagtttgtttccatcattgatggtacaggcagcacatcctacgccgcatctgtgaagggccggttcactgccagccaggaccgtggcaaaaacatcgcttacttgcagatgaactccctgaagcccgaggataccgcaatgtactattgcaaggcgagctgtgtgcgtggcagaaccattagcgaatactggggacagggcacgcaggtgaccgtctcctcc

SEQ ID NO: 1172 - DNA, 741 bp, synthetic construct
  source 1..741: mol_type = other DNA; note = Description of Artificial Sequence: Synthetic polynucleotide
caggtccaactccaggagtctggcggaggttccgttcaggccggtgggtcccttaccctgagttgcgccgcttcagaatacgcctactcaacctgtaacatgggctggtatcgccaagctcctggtaaggaaagagagttggtgtccgctttcatctctgatggttctacctattacgcggactctgtgaagggcagatttaccatcacaagagacaacgccaagaataccgtgtacctccagatgaactctctgaagcctgaggatactgccatctattactgttcagcaaactgctaccgtcgcctgcgcaattactgggggcagggcacccaggtgacagtatccagcggtggcagtggaggctccggtggctctggccaagtgcagctccaggagtccgggggcggttcagtgcaggccgggggctccctgcggctgtcctgtgtcgcgtctggatacgtgagttgcgactactttctcccctcctggtatcgccaggctccaggaaaggagcgcgagtttgtcagcatcattgatggcaccgggagtaccagttatgcggcttctgttaagggccgtttcaccgcttctcaggatcgcggaaagaacatcgcctatttgcagatgaactctctgaagccggaagacacagccatgtattactgcaaagccagttgtgtcaggggacggaccatctctgagtattggggacagggtacgcaggtcactgtgagttcc

SEQ ID NO: 1173 - DNA, 723 bp, synthetic construct
  source 1..723: mol_type = other DNA; note = Description of Artificial Sequence: Synthetic polynucleotide
caggtgcagcttcaggagtctggaggcggatctgtccaggccgggggcagtctgaccctgtcctgcgccgcttctgagtatgcctatagtacttgcaacatgggttggtatcggcaggctccgggcaaggagcgcgaactggtttcagcgttcatctctgacggtagcacctactatgccgacagcgtgaagggccgctttactatcaccagggataacgcaaagaacaccgtttacctccagatgaatagcctcaagcctgaggataccgctatctattactgctcagctaactgttatcgtcggctgcgtaactactggggccagggaactcaagttaccgtcagcagtgggggaggcagtcaggtgcagttgcaggaaagcggcgggggcagcgtccaggctggtggaagccttcgtctctcttgtgtcgccagtggctatgtctcctgtgattattttctgccgtcctggtatcgtcaagcgcctggcaaggaaagggagttcgtatccattatcgacggaactggtagtaccagctacgctgcctccgtgaagggaaggttcacagcctcccaggataagggtaagaacattgcctacctccagatgaactccctgaagcctgaagatacggccatgtactattgcaaagcctcttgtgtcaggggcagagccatcagcgaatactggggccaaggcactcaggtcaccgtgagcagc

SEQ ID NO: 1174 - DNA, 741 bp, synthetic construct
  source 1..741: mol_type = other DNA; note = Description of Artificial Sequence: Synthetic polynucleotide
caggttcagctccaggagtctgggggcggttctgtccaggccggaggcagccttacactgtcttgcgctgccagcgagtatgcttactctacctgcaacatgggttggtatcggcaagcgccgggcaaggaacgggaactcgtctctgctttcatctccgatggcagcacatattacgctgatagcgtaaagggccggttcaccatcacaagagacaacgcaaagaacacagtttacctccagatgaactccctcaaacctgaggataccgccatctattactgctccgctaactgctaccgccgtctgcgcaactactggggtcaaggcacccaggttaccgtgtctagcgggggctctggtggcagtggtgggtcagggcaggtccagctccaggagagcggcggaggtagcgtacaggccgggggttcactgagactgtcttgtgtggcctctggatacgtctcttgcgattacttccttcccagttggtataggcaagcgcccggtaaggagagagagttcgttagcatcattgatggcacaggttcaacaagttatgcggcttccgtaaagggacgctttactgcgtctcaggacaagggcaaaaacatcgcctatcttcaaatgaacagtctgaagcctgaagataccgctatgtattactgcaaagcctcctgcgtgcgcggtcgcgctatcagcgaatactggggccagggtacgcaagtgactgtcagttct

SEQ ID NO: 1175 - DNA, 723 bp, synthetic construct
  source 1..723: mol_type = other DNA; note = Description of Artificial Sequence: Synthetic polynucleotide
caggttcaactccaggaatcaggaggcggttcagtgcaggctggcggtagcctgaccctcagctgcgctgcgagtgagtatgcttattccacctgcaacatggggtggtatcgccaagcgcctggcaaggagagagagctggtcagtgcatttatttccgatggctccacctactatgctgactcagtgaaggggcgcttcaccatcactcgcgacaacgccaagaatactgtctatctccagatgaacagcctcaaaccagaggatacagccatctactattgcagtgcgaattgttatcgtaggctgcgcaactactggggccaaggcacacaggtgaccgtgtctagtggaggtggctctcaggtccagctccaggaatctggtggaggctccgtccaggctggcggttcccttcgtctgtcctgcgtggccagcggctacgtgagctgtgattatttcctccctagctggtatcggcaggctcccggcaaggaacgcgagttcgtttctatcattgatggaacgggttctactagctacgcggcctccgtgaaggggcgcttcacagcaagccaggacaaagggaagaacatcgcttacctgcaaatgaataccttgaagcctgaggacaccgcaatgtattactgcaaggcttcctgcgtgaggggccgcgccatctccgaatactgggggcagggtactcaggtgaccgttagcagt

SEQ ID NO: 1176 - DNA, 741 bp, synthetic construct
  source 1..741: mol_type = other DNA; note = Description of Artificial Sequence: Synthetic polynucleotide
caggtccagctccaggagtccgggggcggatcagtccaggctggcgggagtctgacactgtcctgtgctgcctctgagtatgcttacagcacctgtaacatgggctggtacagacaagcccctgggaaggagcgcgaactcgtgtccgcgtttattagtgacggttccacctactatgctgactccgtgaagggtcgcttcacgatcacccgcgacaacgccaaaaataccgtgtacttgcagatgaactccctgaagccggaggacacagccatctattactgtagcgcaaattgctaccgtcgcctgcgtaactattggggtcagggcactcaggtcacagtcagtagcggcggtagcggtggctccggcggtagtggacaggtgcagttgcaggaatccggcggtggaagtgttcaagcagggggctctctgcgcctgtcatgtgttgcatcaggctatgtctcttgcgactacttcctgccatcttggtatcgtcaggccccagggaaggaaagggagttcgtctccatcattgatggcaccggctcaacctcttacgctgccagcgtaaaggggcgcttcaccgcctcccaggataagggcaagaacatcgcttacctccagatgaacacactcaagcctgaggataccgcgatgtattactgtaaggcgagttgcgttcgtggccgtgcgatcagcgagtattgggggcagggaacccaggtaacagtcagctcc

SEQ ID NO: 1177 - DNA, 750 bp, synthetic construct
  source 1..750: mol_type = other DNA; note = Description of Artificial Sequence: Synthetic polynucleotide
caagtgcagctccaggagtccgggggcggtagcgtgcaggccggtggctccctcactctgtcctgcgctgccagcgagtatgcgtactccacctgcaacatgggatggtacaggcaagcgcctggcaaggaaagagagcttgtgagcgccttcatctccgatggttctacctactatgctgactccgttaagggccggttcaccattactcgcgataacgccaagaacaccgtgtatctccagatgaactccctcaagccagaggacacagctatctactattgctcagctaactgttaccgtcgcctccgcaactattggggccagggcactcaggtgactgtctcttccgggggtggctcccaagtgcagctccaggagtcaggaggcgggtctgtccaggcgggtggctccctgcgcctcagctgccgtgcgtctggcagcacctacagcaactactgtttgggctggttcagacagattactggaaaagaacgcgagggcgttgcggtcatcaactgggtgggcgggatgctttactttgcagacagtgtgaagggtcgctttaccgtcagccaggaccaggccaagaacacagtgtatttgcagatgaatagcctgaagccagaggacactgccatgtattactgcgcggctgagtcagccagctctttcagttgcggtggctggttgacgcgccctgaccgcgttccttactgggggcaggggactcaggttaccgtgagcagc

SEQ ID NO: 1178 - DNA, 768 bp, synthetic construct
  source 1..768: mol_type = other DNA; note = Description of Artificial Sequence: Synthetic polynucleotide
caggtgcagcttcaggaatcagggggtggaagcgtgcaggcaggaggctctctgactttgtcatgtgccgctagtgagtatgcgtattctacgtgcaacatgggctggtatcgtcaagcccccggaaaagagcgtgaactcgtgtcagctttcatttccgacggtagcacatattacgccgacagcgtgaaggggcgctttactatcactcgcgataatgccaagaatacagtttacctccagatgaactcactgaagcccgaagacaccgccatctactattgtagcgccaactgttataggagactgcggaactactggggtcaaggcacccaggtgaccgtgtcctctggaggctctggaggctccggcggtagcggacaggtgcagttgcaggagtccggtggcgggtcagtgcaggccgggggctcactcaggctttcctgccgcgccagtggttccacttattccaactattgcctgggctggttcaggcagatcacaggtaaggaacgtgagggggtggctgtgattaactgggtcggcgggatgctgtattttgccgacagtgtgaaagggagattcaccgtcagccaggatcaggccaaaaacaccgtgtacctgcaaatgaacagtctgaagccagaggataccgccatgtattactgtgcagcggagagcgcctccagcttttcctgcggaggttggctcactcggcctgaccgcgttccctactggggtcaagggacccaggtgacagtctcctcc

SEQ ID NO: 1179 - DNA, 732 bp, synthetic construct
  source 1..732: mol_type = other DNA; note = Description of Artificial Sequence: Synthetic polynucleotide
caggtccaactccaagaaagcggtggcggttccgtccaggccggaggctccctgaccctgtcctgtgctgcaagtgagtacgcctattccacctgtaatatgggttggtataggcaggcaccaggaaaagagcgcgaactggtgtccgcgttcatctccgacggctccacttactatgctgatagtgttaaaggccgcttcaccatcacccgtgataacgcgaagaacactgtgtacttgcagatgaacagcctgaagcccgaggatacagccatctactattgctctgccaactgctatagaaggctgcggaactactggggtcagggaacccaggtgaccgtgagttccggcgggggttcccaggtccagctccaggaatctggcgggggtctggtgcagcctggaggttcactcagattgtcttgcgccgcgtctggcttcacattctccctctccgggatgagttgggtccgccaagcccccggcaagggtctggagtgggtatccgccatcagttccggcggagcctcaacctactatacggactccgtgaagggacgttttaccatcagccgggacaacgctaagaacatgctgtacctccagctgaactctctgaagactgaagacaccgccatgtattactgtgccaagggtggctccgggtacggggatgccagccgcatgacctctcctggtagccagggcacgcaggtcacagtgtcttct

SEQ ID NO: 1180 - DNA, 750 bp, synthetic construct
  source 1..750: mol_type = other DNA; note = Description of Artificial Sequence: Synthetic polynucleotide
caggtacagcttcaggaatctggaggcggaagcgtgcaggctggtggctctctgacactgtcttgcgccgcgagcgaatacgcatacagtacgtgtaatatgggttggtacaggcaagctccgggcaaggaaagagaactcgtaagcgccttcatcagcgatggctccacttattacgcagacagcgtgaagggccgcttcactatcacgagggataacgccaagaacactgtctatctccagatgaactccctcaaacctgaagacaccgccatttattactgctccgctaattgttaccgccgtctgcgcaattattggggacagggcacccaggtaacagtgtcctctggagggagcggtggatctggaggctccggccaagtccagttgcaggaaagcggaggcgggttggtgcagcctggtggcagcctgcgcctgtcttgcgcggcctctggcttcacattctccctgtctggaatgtcttgggtccggcaggccccaggtaagggcctggagtgggtgagcgcaatttcctctggcggggcatccacctattacaccgactccgtgaagggcaggttcactattagccgggataatgcgaagaacatgctgtaccttcagctgaactccttgaagactgaggacaccgctatgtattactgtgccaagggcggtagcggctacggtgacgcttcccgcatgacctctccgggttcccagggcacccaggtgaccgtgtcttcc

SEQ ID NO: 1181 - DNA, 723 bp, synthetic construct
  source 1..723: mol_type = other DNA; note = Description of Artificial Sequence: Synthetic polynucleotide
caggtccagttgcaggaatccggcgggggttccgtccaagcaggcggttcccttacactcagctgcgctgccagcgagtacgcctattctacgtgtaacatgggctggtatcgccaggctcctgggaaggaacgcgagctggtgagcgcatttatctcagatgggtccacatactatgctgactctgttaagggtcgtttcactatcaccagggacaacgctaagaacactgtctatctgcaaatgaactccctgaaaccagaggacaccgctatctattactgctctgccaactgttatcgtcggttgcgcaattattgggggcaggggacacaggtgaccgtgtcctcaggtggaggctcccaggtgcagttgcaggaatctgggggaggctccgtgcaggctggcggttcactgaggctgagttgtgttgcatctggctatgtaagttgtgattacttcttgccaagctggtatcgtcaggccccagggaaggaacgcgagttcgtctctattatcgacggcacgggttctaccagctacgctgccagcgttaaggggcggtttacggcatcccaggacaagggaaagaacatcgcttatttgcagatgaactccctgaaacccgaggatactgcgatgtattactgcaaggccagctgtgtaagggggcgcggcatcagcgaatattggggccagggaactcaggtgaccgtgtcctct

SEQ ID NO: 1182 - DNA, 741 bp, synthetic construct
  source 1..741: mol_type = other DNA; note = Description of Artificial Sequence: Synthetic polynucleotide
caggtgcagctccaggaaagcggcgggggctccgtgcaggctgggggcagcttgacactgtcctgtgcagcttccgagtacgcctactcaacctgcaacatgggctggtacaggcaggctcccggtaaggagcgcgaactggtgtccgccttcatttctgacggctccacctattacgccgactcagtgaaaggtaggttcaccattacaagggacaacgccaagaacactgtctacttgcagatgaacagtttgaagcccgaagacactgctatctactattgcagcgccaactgttacaggcgtctgcgcaactattggggtcagggcacccaagtgactgtgtcttccggtgggtccggtggctccgggggctccggccaggtgcagctgcaagagtccggcggtggctccgtacaggccgggggcagcctcagactgtcttgcgtagcctccggctacgtttcttgcgactactttcttccttcttggtacagacaagctccagggaaggaacgggagttcgtgagcattatcgacggcaccgggtcaacctcttacgcggcctccgtgaagggccgttttaccgccagccaagacaagggcaaaaacatcgcgtatcttcagatgaactcccttaaacctgaggacaccgcgatgtactattgcaaggcttcttgcgttcgcgggcgcgggatcagcgagtattggggccagggcacccaggtgaccgtgtcttct

SEQ ID NO: 1183 - DNA, 750 bp, synthetic construct
  source 1..750: mol_type = other DNA; note = Description of Artificial Sequence: Synthetic polynucleotide
caggtgcagttgcaggagtctggcgggggctccgttcaagcgggcggatctctcaccctgtcatgtgccgcttctgagtatgcctattccacttgcaacatggggtggtatcgccaggcaccgggcaaggaacgcgaactcgtgtctgccttcatctctgatggctccacctattacgcagattccgtcaagggcagatttaccattaccagagacaacgctaagaacaccgtttacctccagatgaactccctgaaacctgaggatacagccatttattactgttccgccaactgctatagacgcctgcggaactattggggacaaggcacgcaggttactgtgtcctctgggggcggatctcaggtgcagcttcaggagagcggtggcgggtctgtccaggctggagggagcttgagactgtcctgtcgtgcgtccgggtcaacctattccaactattgcctgggttggtttcgccagatcactggtaaggagcgtgagggggtcgctgttatcaactgggtgggtgggatgctgtatttcgctgattcagtaaagggccgcttcaccgtctcccaggaccaggcgaagaacaccgtgtatcttcagatgaacagcctcaagcctgaggacaccgcaatgtattactgcgcagctgagtctgtttccagcttcagttgcggtggatggcttacacgcccagatcgcgtgccatactggggtcagggtacgcaagttaccgtctcctcc

SEQ ID NO: 1184 - DNA, 768 bp, synthetic construct
  source 1..768: mol_type = other DNA; note = Description of Artificial Sequence: Synthetic polynucleotide
caggtgcagctccaggagtccggtggcggttccgtccaggctggtggctctctgacgttgagttgcgcggccagcgagtacgcttactcaacgtgcaacatggggtggtatcgccaagcgccagggaaagagcgcgaactcgtaagtgcctttatttccgatggaagcacctattacgcagacagtgtgaaggggcgctttactattacccgtgacaacgccaaaaacaccgtctacctgcaaatgaactccctgaaaccggaggacaccgccatttattactgttccgccaactgctatcgccgtctgcgcaattattggggccaggggacccaggtgacagtgagttctggcgggagcggcgggagcggagggagcgggcaggtccagcttcaggagagcgggggaggcagcgtgcaggctgggggtagcctgcgcttgtcttgcagagcctccggttccacatacagtaactattgcctgggatggttccgccagattaccggcaaggaacgggaaggagtcgcggtcatcaactgggtcggtggaatgctgtattttgctgactctgtcaaaggccgctttacagtgtcccaggatcaggctaagaatactgtctatctccagatgaacagcctgaagcctgaagacacagccatgtattactgtgccgcagagtccgtcagctccttctcctgcggtgggtggcttaccaggcctgatcgcgttccttactggggtcagggtacacaggtgacggtgtccagt

SEQ ID NO: 1185 - DNA, 732 bp, synthetic construct
  source 1..732: mol_type = other DNA; note = Description of Artificial Sequence: Synthetic polynucleotide
caggtacagctccaggagagcggcggaggttccgtgcaggccggtggcagtctcaccctgtcctgcgctgcctctgagtatgcgtattctacctgtaatatgggctggtacaggcaggctccaggcaaagagagagaactcgtgtctgctttcatctctgacggtagtacctattacgcggacagcgttaaaggcaggttcaccatcaccagagacaacgccaaaaacacagtttacctccagatgaactccctcaagcccgaggacaccgcaatttactattgttccgctaactgctatcgcagactgcgtaactattggggtcagggtactcaggttaccgtgtctagcggcgggggcagtcaggttcagcttcaggaaagtggcggtggacttgtgcagcccggagggtctcttcgcctttcatgtgctgccagcggcttcaccttttccagttacccaatgtcctgggtcagacaggcccctggcaaggggctggagtgggtcagcaccatctcttccggcggtgatacaaccttgtacgcagactctgttaagggcaggttcacatccagccgggacaatgctaagaataccctctatctgcaactcaacagcctgaagaccgaggacaccgcaatgtactattgcgccaaacgcattgattgcaacagcggctactgttacaaacgctcttactggggccagggcacccaggtgacagtctcctcc

SEQ ID NO: 1186 - DNA, 750 bp, synthetic construct
  source 1..750: mol_type = other DNA; note = Description of Artificial Sequence: Synthetic polynucleotide
caggtccagttgcaggaatctggcggtggctccgtacaggcgggcgggtccctcacgctgtcttgtgccgcatccgaatatgcttattccacctgcaacatgggctggtatcgccaggcccctggaaaggaacgcgaacttgtgagcgcctttattagcgatggttctacttattacgctgatagcgtgaaaggaagatttactatcacacgcgataatgctaaaaatactgtgtacttgcagatgaactctttgaagcctgaggatacggccatctattactgctctgcaaattgctaccgccgtctgcgtaattactggggccagggcactcaggtcacagtgtcaagcggcgggtcaggaggctccggcggaagcggccaggtccagctccaggagtctggaggtggcttggtgcagcctggtggctctcttcgtctgtcttgcgctgcctccggtttcacctttagttcttaccctatgtcctgggtgcgtcaggcccccggaaaagggctggaatgggtgtccaccatttcctctggcggtgacactacactgtatgcagacagtgtgaaggggagattcacctcttcccgtgacaacgccaagaacaccctgtatctccagctcaatagcctgaagactgaggataccgcaatgtactattgcgccaaacggatcgactgtaacagtggatattgttacaagcgttcctattggggccaggggacccaggtgactgtgagttct

SEQ ID NO: 1187 - DNA, 732 bp, synthetic construct
  source 1..732: mol_type = other DNA; note = Description of Artificial Sequence: Synthetic polynucleotide
caggtgcagcttcaggagtccggtggcggttccgtacaggcaggagggtccttgaccctgagttgtgcggcttccgaatacgcctatagtacatgcaacatgggttggtatcgccaggcccccggtaaggaacgcgagttggtaagcgccttcatctccgatggaagtacctactatgccgattcagtcaagggtcgctttacgatcacacgtgacaacgctaagaacacagtctatctccagatgaatagtctgaagcccgaagatacagcaatctattactgttcagccaactgttatcggcgtttgcgtaactactggggacagggcacccaagtcaccgtctccagtggtggcggttcccaggtccagcttcaggaatccggcggtggcttggttcagcctgggggctccctgcgcctgagctgcgctgcctctggatttaccttctcattgtccagcatgtcatgggtccgtcaggctcccggcaagggcctggagtgggtcagtgccatctcttccggtggggcctcaacgtactataccgatagcgtgaagggacgctttaccatcagccgggacaacgcaaaaaatatgctgtatctccagttgaacagcctgaagacggaggacactgcaatgtactattgcgcaaagggagggtccgggtacggtgacgcctccaggatgacctctcctggctcccaggggacccaggtgactgtctccagc

SEQ ID NO: 1188 - DNA, 750 bp, synthetic construct
  source 1..750: mol_type = other DNA; note = Description of Artificial Sequence: Synthetic polynucleotide
caggtacagcttcaggagtcagggggcggtagcgtccaggcgggcggttctttgacactctcctgcgccgcgagcgagtacgcatactctacatgcaacatgggctggtacaggcaggccccaggcaaggaaagggagctggtgtccgccttcattagcgacggaagcacctactatgctgattccgtgaagggccggttcaccatcacacgcgataacgctaagaacacggtgtacttgcagatgaactctctgaagcccgaagacaccgccatctattactgctccgctaactgctatcgcagactgcgcaattattgggggcagggcacccaggtgaccgttagctccggcggtagcggtggcagtggcggttccggtcaggtgcagctgcaagagtcaggcgggggtctggtgcagccgggaggttccctgcgcctctcctgcgccgcttctgggtttaccttcagcctctcttccatgtcctgggtgcgccaagcgccgggcaagggtcttgagtgggtttctgcgatctcttccggtggagcctctacatactatacagattctgtgaaggggaggttcactatcagccgcgacaacgccaaaaacatgctgtaccttcagctcaattccctcaagactgaggacacagctatgtattactgtgcaaagggtggcagcggatatggggacgcctctcgcatgactagccctggttcccaggggacccaggtgaccgtgtccagc

SEQ ID NO: 1189 - DNA, 750 bp, synthetic construct
  source 1..750: mol_type = other DNA; note = Description of Artificial Sequence: Synthetic polynucleotide
caggtgcagctgcaagagagcggcgggggttccgtacaggctggtggctctctgaccttgtcttgcgcggcttcagagtatgcctatagtacctgtaatatgggttggtatcgccaggcaccgggaaaggagcgggagctggtgtctgctttcatctccgacggttctacctactatgccgattctgtaaaggggaggtttactatcactcgggataacgcgaagaacaccgtctacctccagatgaacagcctgaaacccgaggatactgcgatttactattgcagcgccaactgttaccggcgcttgcgcaactactggggccagggaactcaagtcactgtcagttctggcggaggcagccaggtccagctccaggagagcgggggcggatctgtccaagctggcggttccctccgcctcagctgtcgcgcatctggtagcacttactctaactactgtctcggctggtttcgtcagacaaccggaaaagagcgcgagggcgtggctgtcatcaactgggtgggcgggatgctgtactttgcggatagcgtcaagggccgctttactgtctcccaggaccaggcaaaaaacaccgtctacctccagatgaactctctgaagccggaggacaccgcgatgtactattgtgctgccgagagcgtctcctcattctcttgcggcggatggctgacccgcccagaccgggttccatactggggccagggcacccaggtgaccgtttcttcc

SEQ ID NO: 1190 - DNA, 768 bp, synthetic construct
  source 1..768: mol_type = other DNA; note = Description of Artificial Sequence: Synthetic polynucleotide
caggtgcagctccaggagtctggagggggtagcgtgcaggccggaggctcccttaccctgtcctgtgcggcctccgagtacgcttactctacctgtaacatgggctggtatcggcaagcgcccggcaaagaacgcgaactcgtgtccgctttcatcagtgacggttccacttattacgctgattccgttaaaggccggtttactatcacaagggataacgcgaagaacacggtgtatttgcagatgaactctttgaagccagaagatacagctatctactattgctccgccaactgttacaggcgtctgcgtaactattggggtcagggcacccaggtaacagtgtcatctggtgggagcggcggttctggcgggtctggtcaggtccagttgcaagagagcggtggaggtagcgtccaggctggtggctctctgcgcctgtcttgccgtgcctccggcagcacctactccaactattgcttgggttggttccggcagacaaccggcaaagaacgcgagggtgtggctgttatcaactgggtgggcggaatgctgtactttgcagatagcgtaaaaggccggtttaccgtgagccaagaccaggctaagaacaccgtgtacctccagatgaatagcttgaagcccgaggacacggcgatgtattactgtgctgccgaatctgtgtcatctttcagctgcggagggtggctgaccagaccagaccgcgtcccttattggggacagggcacccaggtcaccgtctcatct

SEQ ID NO: 1191 - DNA, 750 bp, synthetic construct
  source 1..750: mol_type = other DNA; note = Description of Artificial Sequence: Synthetic polynucleotide
caggtgcagttgcaggagagcggcgggggaagtgttcaggctggcgggtcccttacacttagctgcgcagccagcgagtacgcatattctacctgcaacatgggttggtatcgccaggcccctggaaaagagcgcgaactggtgtccgcattcatctctgatggctccacctattacgctgactccgtgaagggcaggttcactatcactcgggataacgcaaaaaatacagtgtacctccaaatgaactccttgaaacccgaggatactgcgatttattactgtagcgccaactgttaccgcagactgagaaactactgggggcagggcacacaggtgaccgtaagctccggcgggggcagtcaggtgcagctccaggagagtggcggaggttccgtgcaggctggaggctcactgaggttgtcttgccgtgcctcccgcagtccctacggtaattactgcctcgggtggttccgccagtccacgggtaaggagagagagggtgtggccgttatcaactgggtcggcggtatgctgtattttgccgacagcgtcaagggacgcttcaccgtaagccaggaccacgctaagaataccgtcactctgcaaatgaactccctgaagcctgaggatacggctatgtactattgtgcagcggagagcgtgagttccttctcttgtggcgggtggctgaccagaccagaccgggtgccctactggggccagggcactcaagttaccgtctcatcc

SEQ ID NO: 1192 - DNA, 768 bp, synthetic construct
  source 1..768: mol_type = other DNA; note = Description of Artificial Sequence: Synthetic polynucleotide
caggtgcaacttcaggaatccggcggtggcagcgttcaggccggtggctccctgaccctgtcctgtgcagcgagcgaatatgcgtactctacgtgcaatatgggctggtatcgtcaggctccaggcaaggagcgcgaattggtgagtgcgttcatctccgatgggtcaacatactatgcggactctgtgaagggccgctttaccatcaccagagacaacgccaagaacacggtctacctgcaaatgaacagcctgaagcccgaggacaccgcaatctactattgtagtgctaattgttaccgcaggctgaggaattactggggtcaaggcacccaagtcaccgtgtccagcgggggttccggcggtagcggaggctccggccaggtgcagctccaggagagtgggggagggagcgtgcaagcgggagggagtctcaggctttcatgccgtgcttctcgcagcccttatggcaactattgtctgggctggttcaggcagagtacaggcaaggaacgcgagggcgtggcagtcatcaactgggtcggcgggatgttgtacttcgctgactccgtgaagggccgctttacagtctcccaagaccacgccaagaacaccgtcacgctccagatgaacagtctcaagcccgaagatactgccatgtattactgcgctgcggagtcagtgtcctctttcagctgtgggggttggctgactcgcccagaccgggtgccatattggggccagggtacacaagtcaccgtcagcagc

SEQ ID NO: 1193 - DNA, 732 bp, synthetic construct
  source 1..732: mol_type = other DNA; note = Description of Artificial Sequence: Synthetic polynucleotide
caagtccagttgcaggagagcgggggcggaagcgtgcaggctggagggagcctcaccctgtcctgcgccgcttccgagtacgcctactctacttgtaacatggggtggtataggcaggctcccggcaaagaacgcgagctggtctccgcgtttatttctgacggatctacctattacgcggacagtgtgaagggcagatttacaatcactagggataacgcaaaaaacactgtctatctccagatgaactctttgaagcctgaggacacagctatctattactgttccgcgaactgctacagacgcctccgtaactattggggtcagggtactcaggtgactgttagttcaggtgggggctcccaggtccagcttcaagaatctgggggtggattggtccagcctggcggttctctgcgcctgtcttgtgctgccagtggcttcactttttcccacagcggcatgtcctgggtgcgccaggctccaggcaagggcctcgaatgggttagtaccatcaacagcggaggtgccagcacctactatacagattctgtgaagggcagattcactattagtcgcgacaatgcgaagaacatgctttacttgcagctgaactccctgaagaccgaagacactgcaatgtattactgcgccaagggcggttctggctacggtgatgcgtctcgcatgacatccccagggagtcagggaacccaggtgaccgtgagttca

SEQ ID NO: 1194 - DNA, 750 bp, synthetic construct
  source 1..750: mol_type = other DNA; note = Description of Artificial Sequence: Synthetic polynucleotide
caggtccagctccaggaatctggaggcggtagcgtacaagctggcggttctctgactctgagctgcgctgcctccgagtacgcctactcaacttgcaatatgggctggtataggcaagcaccagggaaggaaagagaattggtttccgccttcatctccgacggaagtacttattacgccgattccgtgaagggacgcttcacgattacacgggacaacgcaaagaacaccgtgtatctccagatgaacagcctgaagcctgaggacaccgcaatttattactgttccgccaactgctacagacgcttgcgcaactactggggtcaaggcacccaggtgaccgtctctagtggaggctccggtggctccgggggctctggacaggtgcagcttcaggagagtggtggcgggctggtgcagcctggcggttcccttcgtctctcttgtgcagccagcggattcacatttagtcacagcggcatgagttgggttcggcaagcacctgggaaggggctggagtgggtatccacaatcaacagcggaggtgccagcacgtactataccgactcagttaaagggcgcttcaccattagtcgcgacaacgcgaagaatatgctgtacttgcagctgaacagcctgaagaccgaggacactgccatgtactattgcgccaaagggggcagcggctacggagatgcgagccgtatgacttcacctgggagccagggcacccaggtgaccgtctcctct

SEQ ID NO: 1195 - DNA, 753 bp, synthetic construct
  source 1..753: mol_type = other DNA; note = Description of Artificial Sequence: Synthetic polynucleotide
caggtgcagcttcaggagtctgggggaggcctggtacaacccggtggcagtctcaggctcagctgcacagcctccggcctgaccttcgacgattccgtgatgggctggtttaggcaggccccaggtaaaggccgggaggctgtaagctgcattagctcctctggagccaacgccttctacgctgattctgtgaaggggcgttttaccatttctcgcgacaacgccaagaacaccttgtatttgcagatgaactccctgaaacccgaggacaccgccacctactattgtaagcgtggccacgcttgtgcgggttattaccccattccctacgatgactattggggtcagggtacgcaagtcaccgtatcttccggcggaggctcccaggtgcagctccaggagtcagggggcggactggtgcagcccggaggttccctgcggctgtcttgtgcggcatccggctttactttctcttcctaccccatgagctgggtccgccaagcgccagggaagggtctggagtggatttctacaatctcagctggaggcgacactaccctctacgctgactctgttaaaggccgcttcactagcagtcgggataacgccaagaacacgctgtacctccagcttaatagcttgaaaaccgaggacgcggccatctattactgcgccaagcgtattgactgtaactctggatactgctatcgtcgcaactattggggtcaggggacccaagttacagtgagttct

SEQ ID NO: 1196 - DNA, 771 bp, synthetic construct
  source 1..771: mol_type = other DNA; note = Description of Artificial Sequence: Synthetic polynucleotide
caggttcagcttcaggagagtggcgggggcctggttcagcccggcggttcccttcgcctgagctgtacggcaagcggtctgacatttgacgattccgtgatgggctggtttcgtcaggctcctggcaagggtagggaggcggtgagttgcatcagctccagcggagccaacgccttttacgcggatagcgtcaagggaaggtttaccatcagccgggacaatgctaagaacaccctgtacttgcagatgaacagtctgaaaccagaggacaccgcaacttattactgcaagcgcggccacgcttgcgcgggctattacccgattccctatgacgattactggggccagggcactcaggtgacagtcagctctggcggaagtggcggaagcggcggttctggccaggttcagttgcaggagagcggaggtggcctggtccagcccggtggctctctgcgcctgagctgcgccgcttccggtttcactttctctagctatcccatgagttgggtgcgtcaggctccaggcaagggactggagtggatcagtaccatctcagctgggggcgacaccacattgtacgccgattctgtgaagggcagatttacctcctctcgcgataatgccaagaacaccctgtatctccagttgaactctctgaagaccgaggacgctgccatctactattgcgccaagcgtatcgactgtaattccggctactgttaccgtcggaactactggggacaaggcacccaggttaccgttagctcc

SEQ ID NO: 1197 - DNA, 753 bp, synthetic construct
  source 1..753: mol_type = other DNA; note = Description of Artificial Sequence: Synthetic polynucleotide
caggtccaactgcaagaatccggtgggggtctggttcagcccggtggctcactgcgcctgtcatgtaccgccagcggcctgactttcgatgacagtgtcatgggatggtttcgccaggcccctggaaagggaagggaagcggtcagctgtatttcttccagcggggctaatgccttctacgctgactccgtgaaaggtcggtttaccatcagtagggataatgccaagaacaccttgtacttgcagatgaactccctgaaacctgaggacaccgccacctattactgtaagcgtggccacgcctgcgctggctactatcccatcccatacgatgactactggggccagggtactcaggtaactgttagctctggagggggctcccaggtgcagcttcaggaatctggtggcggactggtccagcctgggggttcccttcgtctgagctgcgcagcctctggtttcacttttagcctgagcggtatgagctgggtgaggcaggcccctggcaagggtctggagtgggtcagcgcgatctccagcggcggtgcctctacctactatacagattccgtgaagggcagattcactatctccagagataacgctaaaaacatcctctacctgcaactgaactccctcaagaccgaggatactgccatgtattactgtgcaaagggaggctctggttatggtgatgccagtcggatgacctcccctggctcccagggaacacaggttacggtctcatcc

SEQ ID NO: 1198 - DNA, 771 bp, synthetic construct
  source 1..771: mol_type = other DNA; note = Description of Artificial Sequence: Synthetic polynucleotide
caggtccagcttcaggagagtggcgggggactggtacagcccggaggctccctgagactgagttgcaccgccagtggtctgacattcgatgacagcgtgatgggctggttcagacaggcccccggcaaaggccgcgaggccgttagctgtatctctagtagcggggccaacgctttttacgctgactctgttaagggcaggttcaccatttcccgcgacaatgcgaagaacaccctgtacttgcagatgaacagtctgaaacccgaagacacggctacttactattgtaagaggggtcacgcctgcgccggttattaccccattccctacgatgactattgggggcaagggacccaggtcacagtctccagcggcgggtccggcggtagcgggggctccggccaggtgcagctgcaagagtccgggggcggtcttgttcagccaggtggctctctgcggctgtcctgcgcggcctctggattcacattctctctcagtggcatgtcttgggtgcgccaggctccgggcaagggcctcgaatgggtgtccgccatctccagcggtggcgcttccacttattacaccgattctgtgaagggacgcttcaccatctctagggacaacgcgaagaacattttgtatctccaactgaacagtcttaaaaccgaggacactgccatgtattactgtgctaagggtgggtctggctacggagatgcgtccaggatgacgagcccaggctcccagggcacccaggtgaccgtgtcctct

SEQ ID NO: 1199 - DNA, 744 bp, synthetic construct
  source 1..744: mol_type = other DNA; note = Description of Artificial Sequence: Synthetic polynucleotide
caggtccagctccaggagtccggtgggggcctcgttcagcccggcggatctctgaggctgagctgtaccgcctctggcctgaccttcgacgattccgtgatgggctggttcagacaggctcccggcaagggccgcgaagctgtctcctgcatctcctcttccggcgcaaatgcgttctacgccgactcagtgaagggccgttttaccatttctcgggataacgctaaaaacacgctgtatctgcaaatgaactccttgaaaccggaggataccgccacctattactgcaaacgcggtcatgcctgtgctgggtattacccaatcccttacgatgactattggggccaaggcacccaggtcaccgtcagtagcggcggtggctcccaggttcagttgcaggaatcaggcgggggctccgtccaagccggaggctctctgcgtctgtcatgtgtagccagtggctacgtgtcatgcgattacttcctgccttcctggtatagacaggctcccggcaaggagcgcgagttcgtgagcattatcgacggcacgggttccacgtcctacgctgcctccgttaagggtcgctttacagctagtgaggacaagggcaagaacattgcgtacctccagatgaactccctgaagcctgaagatacagccatgtactattgcaaggccagctgtgtgaggggccgcgctgtttcagaatactggggccagggcacccaggtcactgtttcttct

SEQ ID NO: 1200 - DNA, 762 bp, synthetic construct
  source 1..762: mol_type = other DNA; note = Description of Artificial Sequence: Synthetic polynucleotide
caggttcagttgcaggaatccgggggcggattggtccagccaggaggctcccttcgcctgagctgcactgcctctggactgacatttgacgattctgttatgggctggttccgccaagcaccaggaaagggcagagaggcagtgtcttgtatctcttccagcggagccaatgcgttttatgctgacagcgtgaagggcaggttcaccatctcacgcgacaacgctaagaacaccctctatcttcagatgaactctctcaaacctgaggataccgccacctattactgtaaacgcggacatgcttgcgccggttactatcctatcccctatgatgactactgggggcagggcacccaggtgaccgtgtcaagcgggggatcaggaggcagcggaggcagcggccaggtccaacttcaggagtcaggaggcggttctgtgcaggccggaggctcactgcggctgtcctgtgtggcgagtggctacgtaagctgcgactacttcctgccttcttggtacaggcaggcccctggcaaagagagggaatttgtgtccatcattgatggtacaggcagcacctcctatgcggcctccgttaagggcagatttactgcctccgaggacaagggcaagaatatcgcctatctccagatgaactccctgaagccggaagataccgcaatgtactattgcaaagccagttgtgtgagagggagagcggtaagtgagtattggggtcagggcactcaggtgacggtttccagc

SEQ ID NO: 1201 - DNA, 756 bp, synthetic construct
  source 1..756: mol_type = other DNA; note = Description of Artificial Sequence: Synthetic polynucleotide
caggtgcaacttcaggagtctggaggcggactggtccagcctgggggctctctgcgtctgtcttgcaccgcctccggcctgacgtttgatgactcagtcatggggtggttccgccaagcccctgggaagggcagggaggccgtcagctgcatctctagctccggggccaacgctttctacgcggatagcgtcaagggccgcttcaccatcagtagagataacgcaaaaaacactttgtatctccagatgaacagcctgaaacccgaggataccgcaacgtattactgtaagcgcggacacgcttgtgcgggctattaccctattccctatgatgactactggggtcagggcactcaagtcaccgtcagttctggcggaggttctcaggtacagctccaggagtctggcgggggcctggtgcagcccggcgaatctctgagactgtcatgcaccgcatccggctttaccttctctaattacgccatgagctgggtcagacaggcccctggtaaggggctggagtgggtcagtggaatcaacgtggcctatgggatcacctcctacgcggactccgtcaagggtagatttacaatctctcgcgacaacaccaagaacaccctgtaccttcagctgaactcactcaaaaccgaagacaccgcgatctattactgtgtgaaacactcaggtacaaccatccccagaggattcatctcatacacaaaacgcggccagggtactcaggtaaccgtgtcctca

SEQ ID NO: 1202 - DNA, 774 bp, synthetic construct
  source 1..774: mol_type = other DNA; note = Description of Artificial Sequence: Synthetic polynucleotide
caggtccagctccaggagagcggcgggggcctggtgcagcctggcggttccctgcggctcagctgtaccgcctccgggctgacgttcgacgattctgtgatgggctggtttcgccaggcccccggcaagggacgcgaagctgtaagctgcattagttcctctggagcgaatgccttctacgccgactctgtgaagggccgcttcacaatctcccgcgacaacgctaagaacacgctgtaccttcagatgaactctctgaaacccgaggatactgccacctactattgcaagcgcggccatgcctgtgctgggtactatccaatcccgtatgacgattactggggccaagggacccaggtcaccgtaagttcaggaggtagcggtggctctgggggctctggtcaagtacagttgcaggaaagtggcgggggtctggttcagccaggcgagtcattgagattgtcttgtacggctagtggattcacatttagtaactacgccatgagctgggtccgtcaagcacctggcaagggcctggagtgggtatccggtattaacgtggcctacggaattacaagttatgcagactctgtgaagggcaggttcacaatctctcgggacaacaccaagaacacgctgtaccttcagctgaactctctgaaaaccgaagatactgctatctattactgcgtgaagcacagcggcacaaccatcccacgcggtttcatctcttataccaagagaggccagggcacccaagtcaccgtgtcatcc

SEQ ID NO: 1203 - DNA, 744 bp, synthetic construct
  source 1..744: mol_type = other DNA; note = Description of Artificial Sequence: Synthetic polynucleotide
caggtgcaactccaggagtccggcggtggcctcgtgcaaccgggtggctccttgagactgtcttgtaccgccagcggacttaccttcgacgattctgtgatgggctggttccggcaagcgccgggcaagggcagagaggccgtgagctgcatctctagttctggtgctaacgctttttacgccgactccgtgaaaggccgtttcacgatttcaagagataacgccaaaaacactctctacctccagatgaactccctcaagcctgaggacactgccacctattactgtaagcggggccacgcttgcgcaggctattaccctattccctatgacgattactggggccagggtacacaggtgacggtgtccagtggcggagggtcacaagttcaacttcaggagagcggcggagggtctgtccaggctggtggctccctgcgtctctcctgtaccgcctccggctacgtgtcatgtgattactttctgccttcctggtacaggcaagcacccggtaaggagcgcgaatttgtcagcgttattgacggcacgggtagtacgtcctatgctgcctccgtgaagggccgcttcacggcatcccaggacaaggggaaaaatatcgcatacctccaaatgaacagtctgaagccggaggatacagctatgtattactgcaaggcttcatgtgtgcgcggaagagctattagtgagtattggggccagggtacacaggtaacggtcagctcc

SEQ ID NO: 1204 - DNA, 762 bp, synthetic construct
  source 1..762: mol_type = other DNA; note = Description of Artificial Sequence: Synthetic polynucleotide
caggtccagttgcaggagagcggcggtggcttggtgcagcccggtgggtcactgagactgtcctgcactgcaagcggccttacgttcgatgacagcgtgatggggtggttccgccaggcacccggcaagggacgtgaggccgtgtcctgcattagctcatccggcgctaatgccttttatgccgacagcgtcaagggcagatttaccatctctcgcgacaatgccaaaaataccctgtatcttcaaatgaatagcctgaagccagaggataccgctacttactattgtaagcgcggccacgcctgcgcgggctattaccctatcccctacgatgactattggggccagggtactcaagtgactgtgagttccggtggctccggcgggtctggaggctcaggtcaagtccagttgcaggagtccgggggcggtagcgtgcaggcgggcggttccctgcgcctgtcttgtaccgcatctgggtacgtctcctgcgattacttcctgccttcctggtacaggcaggcccctggcaaggagcgtgagtttgtgtccgtgatcgacgggacaggttccacctcctacgctgcatccgttaagggtcgctttacagccagccaggacaaaggaaagaacatcgcttacctgcaaatgaactccctgaaacctgaggataccgctatgtattactgcaaggcctcctgcgtccgtggccgtgcgatctccgaatactggggccagggcacccaggtgactgttagcagc

SEQ ID NO: 1205 - DNA, 741 bp, synthetic construct
  source 1..741: mol_type = other DNA; note = Description of Artificial Sequence: Synthetic polynucleotide
caggtgcagttgcaggagtctgggggaggtctcgtgcagccaggagggtcactccgcctgagttgtactgccagcggtttgacattcgacgattctgtcatgggctggtttcgccaagctccagggaagggccgcgaggctgtgtcctgcatctcatcctctggggccaacgctttttacgctgattctgtcaaaggccgcttcacaatcagccgggacaacgccaagaacactttgtatctccaaatgaacagcctgaagcctgaggacactgcaacctattactgtaagcgcggacacgcctgcgctggctattaccccatcccttacgacgattattggggtcaaggaactcaggttactgttagctccggcgggggcagccaggtgcagcttcaggagtcaggtggaggtctggtgcaacctggaggctccctgcgcctgtcctgtgccgcatccggctttagtttctctagctacgcaatgaaatgggtgcgtcaagccccaggcaaaggtctggagtgggtgtccaccatcagtagcggtggctccagcacgaactacgccgactccgtgaaaggccggttcaccatcagccgtgataacgctaagaacacgctgtacctccagctgaactctctgaagatcgaggacacggcaatgtattactgtgcaaaggcaatcgttccaactggtgccactatggagagggggcagggaacccaagtcaccgttagctcc

SEQ ID NO: 1206 - DNA, 759 bp, synthetic construct
  source 1..759: mol_type = other DNA; note = Description of Artificial Sequence: Synthetic polynucleotide
caagtgcagctccaagaaagcggcggaggcctggtgcagcctggcggttctctgagactgagctgtactgcctcaggtctgacttttgacgattctgtcatgggatggtttagacaagctccaggcaagggtcgtgaggcggtgagctgtattagctcctctggcgcgaacgcattttatgccgattccgttaagggtcgcttcacaatctcacgggacaacgcgaagaatacactgtacctgcaaatgaactccctgaagcccgaggacacagctacctattactgcaagcgcggccacgcctgtgcaggttattaccctattccctatgatgactactggggacaagggactcaggttaccgtcagctccggtggcagcggcggatctggtggctccggccaggtgcagcttcaggagtccgggggaggcctggtgcagccgggcggttcattgcgcctttcttgcgccgcgagtggcttctccttttccagctatgccatgaagtgggtccgccaggctcctgggaagggcctggagtgggtgtccaccatctcctctgggggctccagtaccaactacgccgacagcgtgaagggtcgcttcactatcagcagagataacgctaagaacacactgtacctccagctgaatagcctgaagatcgaggatacggctatgtattactgtgccaaggcgattgtgcctacaggagccactatggaacgcggccaaggcacccaggtgacggtgtcaagc

SEQ ID NO: 1207 - DNA, 753 bp, synthetic construct
  source 1..753: mol_type = other DNA; note = Description of Artificial Sequence: Synthetic polynucleotide
caggtgcaacttcaagaatctggaggtggactggtccagcctggcggttctctgcgcctctcttgtactgcttccggcctcacatttgacgattctgttatgggatggttcagacaggccccaggtaagggtcgcgaggccgtgagttgtatcagctccagcggcgctaacgcattctatgccgacagtgtcaagggacgctttacaatctccagggacaacgccaaaaacacgctctaccttcagatgaactcactgaagcccgaggatactgctacctattactgcaaacgcggtcatgcttgtgccggttattaccccatcccatacgatgactactggggccaggggacccaggtaaccgtcagctccggcggtggatcacaggtgcagcttcaggagagtggtggaggtctcgtgcaacctggaggtagtctccgcttgtcttgtgctgcctccggtttcaccttttccagctaccccatgagttgggtgcgccaagcgccggggaagggcctggagtggatttcaactatcagcgctggaggcgataccacactgtacgccgatagtgttaagggaaggttcacttcctctagggataacgccaagaacaccctgtatcttcagctgaacagtctgaagacggaggacactgctatctattactgcgcaaaacgcattgattgcaactccggctattgctaccgccggaactactggggccaggggacccaggtgacagtcagttcc

SEQ ID NO: 1208 - DNA, 771 bp, synthetic construct
  source 1..771: mol_type = other DNA; note = Description of Artificial Sequence: Synthetic polynucleotide
caggtacagctccaggagagcggcggtggcctggtacagccagggggttcattgcgtctgagctgcactgcttctggtctgacgtttgatgactctgttatgggctggttccgccaagcgcccggcaagggacgggaagctgttagctgtatctccagttctggggccaacgccttctacgccgattctgtgaagggtcgcttcactatctcacgcgacaacgccaagaacaccctgtaccttcagatgaacagtctgaagcctgaggataccgccacctactattgcaagcgcggccatgcgtgcgcgggctattaccctatcccttacgatgactattgggggcagggcacccaggtgactgtgtccagtggaggctccggtggcagtggagggtccggccaggtccaactccaggagtctggtgggggcttggtccagcctgggggtagcttgcgcctgtcttgcgctgcctccgggttcaccttctctagttatcctatgtcttgggtgcggcaagcgccgggtaagggcctggagtggatttctactatctctgctggcggtgacaccacgttgtacgcagattccgtgaaggggcgtttcacctcctcaagagacaatgcgaagaacaccttgtacctccagctgaacagcctgaagaccgaggacaccgctatttactattgtgccaagcgtattgattgtaatagcggttattgctaccgcaggaactactggggccagggcacacaggtcaccgtgagcagt

SEQ ID NO: 1209 - DNA, 753 bp, synthetic construct
  source 1..753: mol_type = other DNA; note = Description of Artificial Sequence: Synthetic polynucleotide
caggtgcaactccaggaaagcggtggcgggcttgtgcagcccggcggtagcctgcggctgagttgtactgcaagcggtctcaccttcgacgatagtgtaatgggttggtttcgtcaagcacccggaaagggaagggaggcggtgtcttgcatctccagcagtggcgcgaatgcgttttatgccgattccgtcaaggggcggtttacgatctccagggataacgccaagaacacgctgtacctccagatgaacagtctgaagcccgaggatacggccacatattactgtaagcgcgggcacgcctgtgccggatactatcccatcccttatgacgattattggggtcaaggtacgcaggtcacagttagctctggcggaggttcccaggtccaacttcaggagtccggtggagggtccgttcaggtgggcggatctcttcgcctgagctgcgcggccagcggatttaccttcagctcctacccaatgagttgggtgcgtcaggctccgggtaagggcctggagtggatctctaccattagtgctggcggagacaccacgctgtacgccgacagcgtgaaggggcgcttcacctcctctcgcgataacgcaaagaataccctgtacctccagctcaattccttgaagaccgaagatacggccatttattactgcgccaagcgcattgattgcaatagcggctattgctatcggaggaactactggggacagggaacccaagtcactgtttcatcc

SEQ ID NO: 1210 - DNA, 771 bp, synthetic construct
  source 1..771: mol_type = other DNA; note = Description of Artificial Sequence: Synthetic polynucleotide
caggtccagctccaagagtcaggaggcggactcgtgcaaccgggtggctccctgaggctgtcttgtaccgcaagcggcctgaccttcgatgacagtgtcatgggctggttcaggcaggcccccggcaaaggccgtgaggccgtcagctgtatcagttctagtggagccaacgccttttacgccgattccgtaaagggccgtttcaccatttcaagggacaatgccaagaataccctgtatctgcaaatgaactccctcaagcccgaagataccgccacctactattgcaagcgcggacatgcctgtgccggttattaccccattccctatgacgattattggggtcagggaacccaggtgaccgtgtccagtggagggtccgggggctctggcgggtccggccaggtgcagttgcaggagtcagggggtgggagcgtccaggttgggggtagtctgcgcctgtcttgtgcagcctctgggttcaccttcagctcctaccccatgagctgggtgcgccaggctccgggaaaaggtcttgagtggatctctacaatctccgccggtggcgacactaccctgtacgctgacagcgtgaagggccggtttacaagttctcgcgacaacgccaagaacaccttgtacctccagctcaactccctgaagaccgaggataccgccatttattactgtgcaaaaaggattgattgtaactccggctactgttatcgcagaaattactggggccaggggacccaggttacagtgtctagc

SEQ ID NO: 1211 - DNA, 768 bp, synthetic construct
  source 1..768: mol_type = other DNA; note = Description of Artificial Sequence: Synthetic polynucleotide
caggttcagctgcaagagagcggagggggtctcgtgcagccgggtgggagcctgcgcctttcctgtactgcttctggactgaccttcgatgactccgtgatgggttggttccggcaggcccctggaaagggccgtgaagctgtgtcctgtatcagctcttccggggcgaatgctttctacgccgatagcgttaagggccgctttaccatctcccgcgacaacgcaaagaatactctgtacttgcagatgaacagcctcaagcccgaagacaccgccacttattactgtaagcgcggccacgcttgcgcgggttactatcccatcccttacgatgactactggggacagggaacccaggtaaccgtgtcatctggcgggggcagtcaggtccagttgcaggaaagcggaggtggcagcgttcagagtggcggttccctgcgtcttagctgtgcagcctccggctttacatacagcacttctaattcctggatggcctggttcagacaggccccaggcaaggaacgcgaaggcgtggctgccatttacacggtcggagggtccatcttttacgccgattccgtgcgtggccgctttaccatctcccaggacgctactaagaatatgttctacctgcaaatgaataccctgaaaccggaggacaccgccatgtactattgtgccgcagcgtccggtcgcctgagggggaagtggttctggccctatgaatacaattactggggacagggcacccaggttaccgtgtcttca

SEQ ID NO: 1212 - DNA, 786 bp, synthetic construct
  source 1..786: mol_type = other DNA; note = Description of Artificial Sequence: Synthetic polynucleotide
caggtacagctgcaagagagcggaggcggattggtgcagcccggaggcagtttgaggttgagctgtaccgcttccggcctcactttcgatgactccgtcatgggctggttccgccaagcacctggaaagggacgggaagctgtctcctgcatcagcagtagcggagccaacgcattctacgctgacagcgtcaaaggcaggttcacaattagccgtgataatgcaaagaacactctgtacctgcaaatgaactctttgaagcccgaggacaccgcgacgtattactgcaagagaggacatgcctgtgccggttattaccccatcccctacgatgactattggggacagggtactcaggtgacggtgagttccggcggtagcggtggcagtggagggagcggtcaggtgcagttgcaggagagcgggggcggaagcgtgcagtccggcgggtccctgcgccttagttgcgccgcttccggcttcacttatagcacctctaactcttggatggcttggtttcgccaggcccccggcaaggagagagagggcgtggctgccatctacacagtgggcggaagcatcttttacgcggatagcgtgagaggccgtttcacaatcagccaggatgcaacaaagaatatgttctatctccagatgaacacactgaagcccgaagacaccgctatgtattactgtgctgccgcttcaggacgcttgaggggcaaatggttttggccctatgaatacaactactggggacagggcacccaggtgactgtaagcagc

SEQ ID NO: 1213 - DNA, 771 bp, synthetic construct
  source 1..771: mol_type = other DNA; note = Description of Artificial Sequence: Synthetic polynucleotide
caggtgcagttgcaggaaagcggcggaggcctggtgcagcctggcggttccctgcgtctttcctgtactgcctcaggacttaccttcgatgacagtgtgatgggttggttccgtcaggcccctggtaaagggcgggaagcagtcagttgtatctccagctctggtgcaaacgcattctacgccgactctgtcaagggacgtttcactatcagtcgcgataacgctaagaataccctgtacctccagatgaacagcctgaagcctgaggatacggctacctattactgtaaacggggacacgcctgtgctggctactatcccattccatacgacgattattggggccagggaactcaggtgacagtgtcaagcggcggtggctcacaggttcagctccaggaatctggcgggggctctgtccaggcaggaggcagcttgcgcctgtcctgtagggcaagtggaagcacttactccaactactgcctgggctggttccgccaaattactggtaaagagcgggaaggtgtcgcggtcattaactgggtcggcggtatgctgtattttgctgattctgtgaagggtcggttcactgtgtcccaggaccaggctaagaacaccttgtatctgcaaatgaacagcctgaagccagaggataccgcgatgtattactgcgcagccgagagcgtctctagctttagctgcggcggttggctgaccaggccggatcgcgtgccttactggggtcaaggaacccaggtgaccgtctcttca

SEQ ID NO: 1214 - DNA, 789 bp, synthetic construct
  source 1..789: mol_type = other DNA; note = Description of Artificial Sequence: Synthetic polynucleotide
caagtccaactccaggagtccgggggtggcctcgtccagcctggtggctcccttaggctgagctgcactgcatctggcctgactttcgatgactccgtcatgggctggttccgccaggctccgggaaagggacgcgaggccgtgtcttgtatcagctccagtggtgccaacgctttttacgctgactctgtaaaaggccggttcactatcagccgcgacaacgccaaaaacaccctctacttgcagatgaatagcctgaagcctgaggacaccgccacatactattgtaaacgtggccacgcttgcgccggttattaccctatcccctacgatgactactggggccagggcacccaggtgaccgtgagttccggtggcagcggcggttctggcggatcaggccaggtccaacttcaggaaagcggagggggcagtgttcaggctggtggctccctgcgtctgtcctgccgtgctagtggctctacctattctaactactgcctcggctggttccgccaaatcacgggtaaggagcgtgagggggttgccgtcataaattgggtgggcgggatgctttacttcgccgatagtgtgaaggggcgttttactgtgtcccaggaccaggcaaagaataccctgtacctccaaatgaactctctgaagcccgaagacacagccatgtactattgtgccgcagagagcgtgtcatccttctcttgtggcggatggctgacccgccctgatcgcgtgccctactggggtcagggcacccaggtgaccgtctcatcc

SEQ ID NO: 1215 - DNA, 771 bp, synthetic construct
  source 1..771: mol_type = other DNA; note = Description of Artificial Sequence: Synthetic polynucleotide
caggtgcagctccaggaatcaggcgggggcctcgtgcagccagggggcagcctgagactctcttgcacagccagcggactcacctttgatgacagcgtcatgggctggttcaggcaggctcccggcaaaggaagggaggccgtctcctgcatctcttcctctggtgctaatgccttctacgctgactccgtcaagggccgctttactatctcccgcgacaacgcaaagaacactctgtacctccagatgaactccctgaagcctgaggacaccgcgacatattactgtaagagaggccacgcctgtgcgggctattaccccatcccctacgatgactattggggtcagggcacgcaagttacagtctccagcgggggaggttcccaggtccagctccaggaatctggcgggggcagtgtccaggccggaggctccctgagactgagctgccgggcctccggttccacatactccaactactgcctgggctggttccgccagtccacaggtaaagagagagagggcgtcgcagtgattaactgggttggcggaatgctgtactttgctgactccgttaagggccgcttcaccgtctcccaggatcacgctaagaacactgtcaccttgcagatgaactcattgaagcccgaagataccgccatgtactattgtgctgccgagagcgttagttcattttcttgcggcggttggctgacgcgcccaggccgcgtgccctactggggccagggaacgcaagtgaccgtgtcatcc

SEQ ID NO: 1216 - DNA, 789 bp, synthetic construct
  source 1..789: mol_type = other DNA; note = Description of Artificial Sequence: Synthetic polynucleotide
caggtacagttgcaggagtccggtgggggactggtccagcccggcggatcactgcgcctgagctgcaccgcatccgggctgaccttcgacgatagcgttatgggttggttccgccaggccccaggtaagggacgcgaagctgtcagctgcatttcttcctctggggccaatgccttctatgccgattctgtgaaaggaagattcaccatcagccgcgacaatgctaagaatactctgtacctccagatgaacagcctcaagccggaggacactgccacatattactgcaagagaggtcatgcttgcgcaggttattacccgattccctacgacgattattggggccaggggacccaggttacggtttctagcggagggagcggagggtccggtggcagtggacaagttcagctccaggaaagtggcgggggctctgtccaagccgggggctccctgcggctctcctgccgggcttctggctctacttattctaactattgcttgggttggttccgtcaatccactgggaaggagagagagggcgtggccgttataaattgggttggcgggatgctctacttcgctgattccgtcaaaggaaggttcacagtgtcccaggaccacgctaagaacactgtgactctgcaaatgaactccctgaagccagaggacactgctatgtattactgtgccgctgagagcgtctcatccttctcctgcggcgggtggctgacccgtcctggccgtgtgccttactgggggcagggcacccaggtgaccgtctctagt

SEQ ID NO: 1217 - DNA, 771 bp, synthetic construct
  source 1..771: mol_type = other DNA; note = Description of Artificial Sequence: Synthetic polynucleotide
caggtgcaactccaggagagcggaggtggacttgttcagcccggcggaagccttcgcctttcatgcactgccagcggactgacgttcgatgactcagtcatgggctggttcaggcaggcccccggtaagggccgcgaagccgtgtcttgtatctctagctctggagcaaacgctttctacgcggattccgtgaagggccgttttacaattagcagagacaacgccaagaatactctgtacttgcagatgaactctctgaagcctgaagataccgctacctattactgtaagagaggccatgcgtgtgcagggtattaccctattccttacgacgattactggggtcaaggaacccaggtaaccgtgtcttcaggcgggggttcccaggtgcagctccaggagtccgggggaggcagtgtgcaagcaggcgagagcttgcgtctgagttgccgcgcttccggttcaacttactctaactactgtcttggatggttccgccagatcaccggcaaggagcgggagggtgtggctgtcatcaactgggttgggggtatgctttacttcgcagactctgtgaagggccgctttaccgtatcacaggaccaagcaaagaacaccgtgtacctggagatgaacagtctgaagcccgaagacaccgctatgtactattgtgccaccgaatccgtctcttccttctcctgtggaggctggctgacacgccccgaccgggtgccctattggggccagggaactcaggtcacagtctctagt

SEQ ID NO: 1218 - DNA, 789 bp, synthetic construct
  source 1..789: mol_type = other DNA; note = Description of Artificial Sequence: Synthetic polynucleotide
caggtccagctccaggagtctggcggtgggctcgtgcagcccggaggctctttgaggctgagctgcaccgcgagcggcctgactttcgacgatagtgtgatgggctggttccgtcaagcccctggcaaaggccgcgaggcggttagctgtatctcctcttccggggccaatgccttctatgctgacagcgtgaagggccgctttaccatcagccgtgacaacgccaagaacactctttaccttcagatgaactccttgaagccggaggacaccgcgacatactattgtaagcgcggccacgcttgtgcaggctattaccccatcccctatgacgattattggggacagggcacccaggtgaccgtctcctctgggggcagcggaggctctggtggctccgggcaggtgcagctccaggagtccggcggtggctccgtgcaggctggcgaaagcctgcgcctgtcctgtcgtgcgtccggcagtacatatagcaactactgtctcggatggttccgtcaaattaccgggaaggaacgcgagggagtggccgttatcaactgggtgggaggcatgttgtattttgccgacagtgtgaaaggcaggtttacagtgagccaggaccaggccaagaacacggtgtatctcgaaatgaacagcctgaagcccgaagacactgcaatgtattactgcgccaccgagtctgttagctccttttcatgtggtgggtggctgacacgcccagaccgcgtgccatactggggtcagggaacccaggttaccgtgagtagt

SEQ ID NO: 1219 - DNA, 744 bp, synthetic construct
  source 1..744: mol_type = other DNA; note = Description of Artificial Sequence: Synthetic polynucleotide
caggtgcagttgcaggagtccggtggcggactcgtacagccaggaggtagccttcgcctgagttgcactgcctccggtctgaccttcgatgactccgttatgggttggttccgccaagccccagggaagggcagagaagctgtctcttgtatcagctctagcggggccaacgccttctacgcagactccgtgaagggccgctttaccatcagtcgtgacaacgccaagaatacactctatttgcaaatgaactctctcaagcctgaggataccgctacgtactattgcaaacgtggacacgcttgtgccggttattaccctatcccttacgatgactactggggccagggcacccaggtgaccgtgagtagcggcggaggctctcaggtgcagctccaggagtctggtggcgggagcgtccaggccgggggctctctgcgcctgtcctgcgtggcttccgggtatgtttcctgcgattactttctgccctcctggtatcgtcaggcccctggtaaggagcgcgagttcgtgagcatcattgatggcactggatctacttcttacgcagcgagtgtgaagggccgcttcaccgccagccaggataggggaaaaaatatcgcatacctccagatgaacagcctgaagcctgaggacactgccatgtattactgcaaggcgtcctgtgtgaggggaaggactatcagcgagtattggggccaaggtacgcaggtgacagtaagctcc

SEQ ID NO: 1220 - DNA, 762 bp, synthetic construct
  source 1..762: mol_type = other DNA; note = Description of Artificial Sequence: Synthetic polynucleotide
caagttcaacttcaggagagtggtggaggcctggtgcagccagggggttccctcaggctcagctgtaccgcaagcggtctgacatttgatgactccgtgatgggatggtttcgccaggcacccggtaaggggcgtgaagccgttagttgtattagttccagcggagccaatgctttctatgccgactccgtgaagggtagattcaccatctcccgtgacaacgccaaaaacacgctgtatcttcagatgaactctctgaagccggaggacacggccacctattactgtaagcgtggtcatgcctgcgcggggtattaccccatcccctacgatgactactgggggcagggaacccaggtcactgtttccagcggtggctccggtggctcaggaggcagtggccaggtacagttgcaagagtctggcggaggcagcgttcaggctggcgggtccctcagactgtcatgcgtggcatctgggtatgtttcctgcgactacttccttcccagttggtatcgtcaagcgccgggtaaggaacgcgaatttgtgagtatcattgatgggaccgggtctacctcttacgccgcgagcgtgaagggccgcttcaccgcgtctcaggatcgcggtaagaacattgcctacctccagatgaacagtctgaaaccagaagacaccgctatgtattactgcaaggcgagctgcgtgagaggcagaaccatttctgagtattggggacagggaactcaggtgaccgtgtcttca

SEQ ID NO: 1221 - DNA, 744 bp, synthetic construct
  source 1..744: mol_type = other DNA; note = Description of Artificial Sequence: Synthetic polynucleotide
caggtgcagctccaggagtcaggtggcggattggtgcagcccggtggcagcttgcgcctgtcctgcacagcgagtggcttgactttcgacgattccgtcatggggtggtttagacaggctcctggcaagggccgtgaggcagtctcctgtatctcttccagtggtgctaacgctttttacgccgatagtgttaaggggagattcacgatctctcgcgacaacgccaagaatacgctctacttgcagatgaactctctcaagcctgaagataccgccacctattactgcaagcgtggtcacgcttgcgcaggctattaccccatcccctacgacgattactggggccagggcacccaggtgaccgtcagttccggtgggggaagccaggtccagcttcaggagtccggcggtggctccgtccaggcaggtggctccctgcgcctgtcttgcgtggcttctgggtacgtgagctgcgactactttctcccctcttggtatcgccaggcccccggaaaggagcgcgagttcgtttctatcattgacggcactggctccaccagctatgctgccagcgtgaaaggccgctttaccgccagccaggacaaaggcaagaacatcgcttacctccagatgaactccctgaagcccgaagataccgcgatgtattactgtaaggcttcatgcgtgcgcggcagagccatctccgagtactggggccaaggcactcaagttacagtctcttca

SEQ ID NO: 1222 - DNA, 762 bp, synthetic construct
  source 1..762: mol_type = other DNA; note = Description of Artificial Sequence: Synthetic polynucleotide
caggtgcagttgcaggagagcggtgggggcctggtgcagcccggtggctccctgcgtctttcttgcactgcgtccggcttgacttttgacgatagcgtcatgggctggttccgccaggcccctggcaaaggacgtgaggccgtgagctgcatctcttcaagtggagccaacgcattctatgctgactccgtgaaaggccgcttcaccatcagtcgggacaacgccaagaacaccctctacttgcagatgaactccctgaagcccgaggacaccgccacctattactgtaagcgcggccacgcttgcgctggctattacccgatcccatacgatgactactggggacaaggcacccaggttaccgtgtcttccgggggctctggtggctcagggggctctggccaggtccaactccaagagtctgggggaggctctgtgcaggcgggtggctccctgcgtctgagctgcgtagcttccggttacgtctcctgcgattacttcctgccctcctggtataggcaggctcccggcaaggagcgcgagtttgtctctattatcgacggtacaggctctacctcttacgccgcaagcgtgaagggccggttcacagcctctcaggataagggtaaaaacatcgcctacttgcagatgaacagccttaaaccagaggacaccgccatgtactattgtaaggcaagctgcgtgaggggccgcgccatcagcgagtactggggccagggaacgcaggtgaccgtcagcagc

SEQ ID NO: 1223 - DNA, 744 bp, synthetic construct
  source 1..744: mol_type = other DNA; note = Description of Artificial Sequence: Synthetic polynucleotide
caggtccagctccaggagtccgggggtggcctggtccagcccggcgggtctctgagactgtcctgtacggcaagcgggctgaccttcgatgactccgtcatgggctggtttcgtcaagcccctggtaagggccgcgaggcggtttcttgcatcagctcttcaggcgcgaatgcgttctacgccgactctgtgaagggtcggtttactatcagccgcgataatgcgaagaacacactgtacttgcaaatgaactccctgaagcctgaggacacagccacttattactgcaaacgtggacacgcctgcgctggctattacccaatcccttacgacgattactggggccagggcacccaagtgaccgtgagttccggcggtggctcccaagtccagctccaggaaagtggtggcgggtccgtgcaggcgggaggcagccttaggctctcttgcgtcgcctctgggtacgtctcttgcgactatttcctcccttcctggtatcgccaagcgccgggcaaggagcgcgagttcgtctccatcattgatggcaccggctccacctcctacgctgcctccgtgaaaggccgcttcactgcctcccaggacaaggggaaaaacatcgcctacttgcagatgaacacccttaaacccgaagacacggccatgtattactgtaaagcgtcctgcgtgaggggaagagcaatctccgagtactggggccaggggacccaggtgacagtgtcctca

SEQ ID NO: 1224 - DNA, 762 bp, synthetic construct
  source 1..762: mol_type = other DNA; note = Description of Artificial Sequence: Synthetic polynucleotide
caggtgcagttgcaggagtccggtggcggactggtacagcccggcggttccttgaggctgagttgtaccgcttccggcttgactttcgatgactcagtgatgggatggttcagacaagcgcccggtaagggtcgcgaggcggtcagttgcatcagctccagtggagccaatgcgttctacgctgattctgtgaaaggacgtttcaccatctccagggacaatgctaagaatacactgtaccttcagatgaacagcctgaagcctgaagatacagctacgtattactgcaagcgcggacacgcttgtgcaggatattacccaattccttatgatgactactggggtcaggggacccaggtgactgtatccagcgggggctccggcggaagcggaggcagtgggcaggtgcagctccaggagtccggcggaggctcagttcaggccggaggttcactcagactgtcatgtgtggcctctggctacgtgtcctgtgactacttcctgccaagttggtatcggcaggcccctggcaaggagcgggagttcgttagcattatcgacggcacgggcagcaccagttacgctgcctccgtgaaaggcagattcacagcatctcaggataaggggaaaaatatcgcctacctccagatgaacactctgaagcccgaggacaccgccatgtactattgtaaggcttcatgcgtgagaggccgcgccattagcgagtactggggccagggaacccaggttactgtcagttct

SEQ ID NO: 1225 - DNA, 771 bp, synthetic construct
  source 1..771: mol_type = other DNA; note = Description of Artificial Sequence: Synthetic polynucleotide
caggtgcagttgcaggaatctggcggtggactggtgcagcccggaggctcactgcgcctctcttgtacggccagcggactcactttcgatgacagcgtgatggggtggttccgccaggcccctggcaaaggccgcgaggctgtctcctgtatctccagcagtggtgcgaacgccttctacgctgactccgtgaaaggccgtttcaccatcagccgtgataacgctaagaacacactctacttgcagatgaacagcctgaagccggaggacactgccacctattactgtaagcgcggtcacgcatgtgctggctattaccctattccttacgacgattactggggccagggcacccaggttacggtgtcctctggcgggggtagccaggtgcagcttcaggagtccggtggaggttccgtgcaggcagggggaagccttaggctgagctgccgcgcttccggttctacctacagcaattactgcctggggtggttccggcagattacaggtaaagagcgcgagggtgtcgccgtgattaactgggtgggcgggatgctttacttcgctgattcagtgaagggccgcttcactgtgagtcaggaccaggccaagaacacagtgtacctccagatgaactcccttaaacccgaggacactgcaatgtactattgcgctgccgagtcagcgtcctctttcagttgcggcggatggctcactcgtcctgaccgtgtcccttactggggccagggcacgcaggtgaccgtctcctcc

SEQ ID NO: 1226 - DNA, 789 bp, synthetic construct
  source 1..789: mol_type = other DNA; note = Description of Artificial Sequence: Synthetic polynucleotide
caggtgcagttgcaggagagcggcggaggcctggtccagcccggaggcagcctgagactttcttgcacagcttccgggcttaccttcgatgactccgtcatgggctggtttcggcaggctccaggtaagggtagggaggctgttagctgtatcagttccagcggcgctaatgccttctacgccgactctgtgaagggccggtttaccatcagcagagacaacgcaaaaaatacgctctacttgcagatgaactctctgaagcccgaagataccgccacctactattgcaagaggggccacgcctgcgccggttactatccaatcccatacgatgactactggggccagggtactcaggtgactgtgtcttccggtggaagcggcggaagcggcggtagcgggcaggtccagctgcaagaaagcggaggcgggtctgtgcaagctggcggttccctgaggctgagctgtcgtgcatcaggctcaacctactctaactactgcttggggtggttccgccagattaccggcaaggagcgcgagggcgtggccgtcatcaactgggtaggcgggatgctgtatttcgctgattccgtgaagggccgctttaccgtctcacaggaccaggccaagaacaccgtctaccttcagatgaactccctgaaacctgaagatactgccatgtattactgtgcagcggagagcgccagctccttctcctgtggagggtggctgacccgcccggatcgtgttccgtactggggccaggggactcaagtgaccgtgtcctcc

SEQ ID NO: 1227 - DNA, 753 bp, synthetic construct
  source 1..753: mol_type = other DNA; note = Description of Artificial Sequence: Synthetic polynucleotide
caggtgcagctccaggaatcagggggcggactggttcagcccggaggttctctcaggctcagctgcactgcctccgggcttacttttgacgatagcgttatgggctggttccgccaggctcccggcaaaggccgcgaggccgtgtcttgtatctccagctccggtgccaacgccttctacgctgactccgtgaagggacgctttaccatctcacgcgacaacgcgaagaacacactttacctgcaaatgaacagcttgaaacctgaggatacagcaacctactattgcaagcgcggtcacgcttgcgccggttattaccctatcccttacgatgactactggggtcagggtactcaggtaacggtgtcaagtgggggcgggtcccaggtccagcttcaagagtccggcgggggactggtgcagcccggtggctctctgaggctctcttgtgctgcgagcggattcactttctctctgtcagggatgtcttgggtgcgtcaagcacctgggaagggcctggaatgggtctcagcaatctccagcggcggtgcttccacctattacactgacagcgtgaagggcaggtttaccatctccagagacaacgccaagaacatgctgtatctccagttgaactcactgaaaaccgaggatacagccatgtattactgtgccaaaggagggagcggctacggtgatgcctctcgtatgaccagccccggctcccagggaacccaggtgacggtgtcttcc

SEQ ID NO: 1228 - DNA, 771 bp, synthetic construct
  source 1..771: mol_type = other DNA; note = Description of Artificial Sequence: Synthetic polynucleotide
caggtccagctccaggagtctggcgggggcctggtccagcctgggggtagcctgagactgtcctgcactgcttctggtcttacctttgatgacagcgtgatgggctggtttagacaagcgcccggcaaaggccgcgaagccgtgagttgtatctcctctagcggcgcgaacgcattctacgctgactctgtcaagggccggttcaccatttccagggataacgccaagaacaccctgtaccttcagatgaacagcctgaaacccgaagacaccgccacttattactgcaagcggggccacgcctgtgctggctattaccctattccttacgacgattactgggggcagggcacccaggtaactgtctcttcaggcggaagcggcggttccggcgggtctgggcaggtgcagttgcaagagtccggcggtgggctggtccagccgggtggctcactccgcttgtcctgcgcggcttcaggatttactttcagtctgagtggtatgagctgggtacgccaggcacccggcaagggcctggagtgggtgtccgccatttcctctggcggagcgagcacatactataccgattcagtgaaagggcgttttactatctctcgcgataatgccaagaacatgctgtacctccagctcaactctctgaagactgaggacaccgccatgtactattgcgccaaaggcggaagtggatacggtgacgcctcaaggatgacttcccctggttcccagggcacgcaggtgaccgtgagtagc

SEQ ID NO: 1229 - DNA, 744 bp, synthetic construct
  source 1..744: mol_type = other DNA; note = Description of Artificial Sequence: Synthetic polynucleotide
caggtgcagctccaggaatccggtgggggactcgtccagccaggcgggtcactgcgtctctcctgtaccgcgagtggactgacattcgatgactccgtgatggggtggttccgccaggcccccggcaagggccgcgaggcggtgtcttgcatttctagctctggggccaatgcgttttacgctgactctgtgaagggcagattcactatcagcagagacaacgcgaagaacacgctgtatctgcaaatgaactctctgaaacccgaggatactgccacatactattgtaagcgcggccacgcctgcgcaggctactatcctattccttacgatgactactggggccagggaacacaggtcaccgttagctcagggggaggctcccaggtgcagctccaggagagcggaggtggcagcgtccaggctggcggatctctgcgcctgtcttgtgtcgccagcggatacgtgagctgtgactacttcctgcctagctggtatcgtcaagcgccggggaaggaaagggagttcgtgtccattatcgacggtactgggtctacctcatacgcggcctccgtcaagggccgtttcacggcctcccaggacaaggggaaaaacatcgcatatctgcaaatgaactctctgaagcctgaggacaccgcaatgtattactgcaaggcctcctgtgtacgcggacgtggaatctctgagtattggggccaggggacccaggtgaccgtgtcttcc

SEQ ID NO: 1230 - DNA, 762 bp, synthetic construct
  source 1..762: mol_type = other DNA; note = Description of Artificial Sequence: Synthetic polynucleotide
caggtgcagctccaggaatccgggggcggtctggttcagccaggtggctctctccgtctgagctgcaccgcttccggtctcacattcgacgattccgtaatggggtggttccgccaggcccctggaaaaggtcgcgaggccgtgtcttgcatttcttccagcggggcgaacgcattctacgcagactctgtgaagggtcgttttacaatctcccgcgacaacgcgaagaacaccctttacttgcaaatgaactccctcaagcccgaggacaccgcgacctactattgcaagcgtggccatgcttgcgccgggtattaccccatcccctatgatgactactggggacagggaacccaagtgacagtttctagcggaggcagtggtggcagcggtgggtccggccaggtgcagttgcaagagagtggcggaggctctgtccaagctggcggttccctccgcctgtcctgcgtggcctctggctacgttagctgcgactatttcctgccttcatggtatcgtcaggccccagggaaagaaagggagttcgttagcatcattgatggaactggctccacctcctatgctgcaagcgtgaagggtcggttcaccgcctcccaggataagggcaagaatatcgcttatttgcagatgaactctctgaagccagaggataccgccatgtactattgcaaggcatcctgcgtgcggggacgcgggatcagcgaatattggggccagggaactcaggtgaccgtcagttct

SEQ ID NO: 1231 - DNA, 771 bp, synthetic construct
  source 1..771: mol_type = other DNA; note = Description of Artificial Sequence: Synthetic polynucleotide
caggttcagctccaggaaagcggaggcggtctcgtacagcctggcggttccctgaggctgtcctgcaccgccagcggactcacgtttgacgatagtgtaatgggatggttcaggcaggctcccggcaagggccgcgaggccgtaagttgcatctccagctcaggtgccaatgcgttctatgccgactccgtgaagggtagattcaccatcagccgtgataacgcgaaaaacacgctctacctccagatgaactcactgaagcctgaggacacggccacatattactgcaagaggggccacgcctgtgctgggtattaccccatcccctatgatgactactggggccaggggacacaagtgaccgtctccagcgggggcggaagccaggtgcagttgcaggaatccgggggtggcagcgtgcaggctggtgggtctctcaggctcagttgtagggcctctggttccacctacagcaactactgtctgggctggttccgtcagatcactggtaaagagagggagggcgtggcagtcatcaactgggttggcggaatgttgtatttcgctgactctgtcaagggcagattcaccgtctcccaggatcaggctaagaacacagtatacttgcagatgaactccctgaagcccgaggatactgctatgtattactgtgccgcagaaagcgtgtcctctttctcttgcggtggctggctgacacgccctgacagagtcccttattggggtcaggggacccaggtaacggtatcttcc

SEQ ID NO: 1232 - DNA, 789 bp, synthetic construct
  source 1..789: mol_type = other DNA; note = Description of Artificial Sequence: Synthetic polynucleotide
caggtccagctgcaagaaagcggcggaggcctggtgcagcctggcggttctctccgtctgagctgtaccgcctctggcctgacattcgatgactccgttatgggttggttccgccaagcgcctgggaaaggaagggaggcagtgagctgtatttctagctctggagccaatgctttctatgctgatagcgtgaaggggcggttcactatctcaagggacaacgccaagaatacactgtatcttcagatgaacagcctgaagccagaggatacagccacctattactgtaagcgcggacatgcctgtgctggctattacccgattccctacgacgattactgggggcaaggaactcaggttactgtgagttccgggggctctgggggctcaggcggttccggccaggtacaactccaggagagcggcggaggctccgtacaggccgggggcagcctgagactgagctgtcgcgcgagcggcagtacctacagcaattactgcctggggtggttccgccagattactgggaaggagcgggaaggcgtcgcagtgataaattgggtcggtggaatgctctacttcgccgatagcgtcaagggacgcttcaccgtgagtcaggatcaggccaaaaacaccgtttatcttcagatgaactccttgaagccggaagacacagcaatgtactattgcgccgctgaaagtgtctccagcttcagctgcggagggtggctcacccgcccggatcgcgtgccttactgggggcagggcacccaggtcactgtgtcctct

SEQ ID NO: 1233 - DNA, 753 bp, synthetic construct
  source 1..753: mol_type = other DNA; note = Description of Artificial Sequence: Synthetic polynucleotide
caggtgcagttgcaggagtccgggggaggcctcgtgcagcctgggggctccctgcgcctctcttgtactgcgtcaggtctgacttttgacgattctgttatgggatggttccggcaagcgcccggcaagggccgcgaggcggtgagttgcatctccagctctggcgcaaacgctttctatgctgacagtgtgaagggccgttttacaatttccagggacaatgccaagaatacactgtacctccagatgaacagtctgaaacccgaagataccgcaacctattactgcaagcgcggccacgcttgcgccggatactatccaatcccctatgatgactactggggccagggcacgcaggtcaccgtgagtagcgggggtggctcccaggttcagcttcaggagtcaggtggaggcctggttcagccaggtggcagcctgcgcttgagctgcgcggccagcggtttcacctttagctcttacccgatgtcttgggtcagacaggctcccggcaagggcctggagtgggtgtctaccatctcttccgggggcgataccactctgtacgcggattccgtgaaaggtcgctttacctcctctagggataatgctaaaaatacgctgtacctccagcttaattccctgaagacagaagataccgccatgtattactgcgcgaagcgcatcgactgcaactccgggtactgttacaaacgcagctattggggccagggaacacaggtgaccgtgtcctcc

SEQ ID NO: 1234 - DNA, 771 bp, synthetic construct
  source 1..771: mol_type = other DNA; note = Description of Artificial Sequence: Synthetic polynucleotide
caggtgcaacttcaggaatccggcgggggcttggtgcagccaggcgggtctctccgcctgtcctgcacggcctctggcctgacctttgacgattccgtgatgggctggtttcgccaagcgccaggcaaggggcgggaggccgttagttgcatcagttcctctggagccaacgctttctacgccgactccgtcaagggccgtttcaccatcagcagagacaacgccaagaatacactgtatctccagatgaacagcctcaaaccggaggacacggccacctactattgtaagcgcggtcacgcatgtgcggggtattacccaatcccgtatgatgactactggggtcagggcacccaggtcaccgttagctccggtggatctggcggaagcgggggcagcggacaggtccagctccaggagagcggcgggggactggttcagcctggcgggtctctgcgtctgtcctgcgccgcttcaggcttcaccttttcatcttatccgatgtcctgggtcagacaagccccaggtaaggggctggagtgggtttctacgattagctctggtggcgataccacactgtacgcggacagcgtgaaggggcggttcaccagctcaagagacaacgccaaaaacaccttgtacctccagctgaactccctgaagaccgaggacaccgccatgtattactgcgccaagagaattgactgtaacagcggttattgttataaaagatcctactggggccagggaacccaggtgacagtcagttct

SEQ ID NO: 1235 - DNA, 753 bp, synthetic construct
  source 1..753: mol_type = other DNA; note = Description of Artificial Sequence: Synthetic polynucleotide
caggtgcagttgcaggagagcggtggaggcctggtccagccaggtggctctctgcggctgagctgcaccgcttctggtctgacctttgatgacagcgtgatggggtggttccgccaggctcccggaaaggggcgcgaagctgtgtcctgcatcagctcctctggtgccaacgccttttacgctgattccgtgaagggtcgcttcaccattagccgcgacaacgcaaagaataccctctacttgcagatgaacagcttgaagcccgaggacacagcgacctattactgtaagcgcggccatgcgtgcgcaggctactatccgatcccctatgatgactactggggccagggaacccaggtgactgtctcttccggtggcggttcccaggtccagcttcaggagagcggtggcggactggttcagcccggcgggagcctcaggttgagctgtgccgctagtggcttcaccttctccctctctagcatgagctgggttcgtcaggccccaggcaaagggctcgaatgggtcagcgcaatctccagcgggggtgcctccacctattacacagactctgtgaaaggaagattcactatctcacgtgacaatgctaaaaacatgctgtaccttcagctgaacagcctgaagaccgaggataccgctatgtactattgtgccaagggtggctccggctatggcgacgcatcacgcatgacctctccgggctcccaaggaacccaagttaccgtatcttca

SEQ ID NO: 1236 - DNA, 771 bp, synthetic construct
  source 1..771: mol_type = other DNA; note = Description of Artificial Sequence: Synthetic polynucleotide
caggtgcagctccaggagtccggtggaggcctggtacaacccggcggttccctgcgcctgtcctgcacagcaagcgggcttacttttgatgacagtgtcatgggatggttccgccaagcgcccggtaagggcagggaggctgtcagctgtatcagttccagcggggctaatgcgttttatgccgatagtgtcaagggccggtttaccatcagccgcgacaacgccaaaaacaccctgtatttgcagatgaatagcctcaaaccagaggacacagcgacctattactgtaagcgcggtcatgcgtgcgcgggctattacccgattccttacgacgattattggggacagggcacccaggtgaccgtcagctccggtggcagtggcggttccggtggctccggccaggtgcagcttcaggagagcggtggcgggctggtgcagcccggaggttccctccgcctgtcctgtgctgccagcggcttcacattttccctgtcatccatgagctgggtgcgccaggcacccggtaagggactggaatgggtttctgcgatttcttccggcggtgcctccacctactataccgatagcgtcaaggggcggtttacgatttccagagacaacgccaagaatatgctgtaccttcagctcaattctcttaaaaccgaggacaccgccatgtattactgtgctaaagggggctctggatatggtgatgcctcacgcatgacatcccctggatctcagggcacccaggtaaccgtgtcctca

SEQ ID NO: 1237 - DNA, 771 bp, synthetic construct
  source 1..771: mol_type = other DNA; note = Description of Artificial Sequence: Synthetic polynucleotide
caggtccaactccaggagagcggtggaggcttggtgcagcccggcgggtccctgcggctgtcttgcactgctagtggactgaccttcgacgattccgtgatggggtggttccgccaagctccgggaaagggccgcgaggccgtgagttgcatttcttccagtggtgcaaacgccttttatgcggacagcgttaaaggacggttcaccatctcacgcgataacgcgaagaatacactgtatcttcagatgaactccctgaagcccgaggataccgctacctactattgtaagaggggtcatgcgtgtgcgggatactatccaatcccgtatgacgattattggggtcaaggcactcaggttactgtgtcttccggtggagggtcccaggtgcagttgcaggagtcaggaggcggtagcgtgcaggccggagggagcctgcgcctgtcttgtcgcgcatccgggagcacatattcaaattattgtctcgggtggttccgccaaaccacaggcaaggaacgggagggcgtggctgtaatcaactgggtcggtggaatgctctactttgctgactctgtgaaaggccgcttcactgtctcccaggaccaggccaagaacaccgtttatcttcagatgaactccctgaagcccgaagacaccgccatgtattactgcgctgccgagagcgtctccagcttctcctgcggcggatggctgacccgtcctgatagagtgccctattggggccaaggcacccaggttaccgtgtccagc

SEQ ID NO: 1238 - DNA, 789 bp, synthetic construct
  source 1..789: mol_type = other DNA; note = Description of Artificial Sequence: Synthetic polynucleotide
caggtgcagctccaggagagtggcgggggcttggtgcagccaggcggatctctgaggctgtcttgcacagcgagcggcctgacattcgatgactccgtgatgggctggtttcgccaggcccccggcaagggccgcgaggccgtctcctgtatcagttcatctggagcaaacgccttttacgctgattccgtgaagggacgctttaccattagccgggacaacgccaagaacaccctctacctccagatgaacagcctgaagcctgaagataccgcaacgtattactgtaagagaggccatgcttgtgcgggttactatccaatcccctatgacgattactggggtcagggcacccaagtcaccgtgtctagcggagggtctggaggctccggcggtagcggtcaggtgcagctccaggaatctggtggcggaagcgtgcaggcgggcggtagcctgcgcctgagctgtcgcgccagcggtagcacctacagcaattattgtctcggctggtttcgtcagaccactggcaaggaacgggaaggcgttgccgttatcaactgggtgggcggtatgctgtacttcgccgatagtgtgaagggtcgcttcaccgtgtcccaggaccaggctaagaacactgtgtatctccagatgaactccttgaagcccgaggacaccgcgatgtactattgcgccgctgagtctgtcagctctttttcctgcggcgggtggctgacgcggcccgaccgggtgccatattggggccaaggtactcaggtgaccgttagcagt

SEQ ID NO: 1239 - DNA, 771 bp, synthetic construct
  source 1..771: mol_type = other DNA; note = Description of Artificial Sequence: Synthetic polynucleotide
caggtgcagcttcaggaatccggcggaggcctggtgcaacctggaggtagcttgcgtctgtcatgcacagccagtggacttactttcgacgatagcgtgatgggttggttccggcaggctcctggcaagggccgtgaggccgtgagctgcatctccagctccggtgccaatgccttttacgctgattccgtcaaaggacggttcactatctcccgcgataacgccaaaaacacattgtatctccagatgaatagtctgaagccggaggataccgcaacctattactgcaagcgcggccacgcttgcgcaggatactatcctatcccttatgacgattattggggacagggaacacaagtgacggtgtcctctggcggaggttcccaggtgcagttgcaggagtctgggggcgggtccgtccaggccggaggcagcctgcgcctttcctgtcgcgccagccgctccccctacgggaactattgtctgggctggtttcgccagtccactggtaaggaaagagagggcgtagccgtgataaattgggtcgggggtatgttgtacttcgctgacagcgttaagggaagattcaccgtgagccaggatcacgcgaagaacaccgtcaccctccagatgaactctctcaagcctgaggatacagctatgtattactgtgccgctgagtccgttagctccttttcatgcggcggatggctgacccgccccgaccgtgtcccctattggggccagggcacccaagttactgtgagttct

SEQ ID NO: 1240 - DNA, 789 bp, synthetic construct
  source 1..789: mol_type = other DNA; note = Description of Artificial Sequence: Synthetic polynucleotide
caagtgcagctccaggagtctgggggcggtcttgttcagccaggaggctctttgcggctgtcctgtaccgcttccggcctgacattcgatgactctgtcatggggtggttcagacaagcccctgggaagggacgcgaagccgtgagctgcatctctagctctggggctaacgccttttacgcggactccgtgaaaggaagattcaccatctccagagacaacgccaagaacacactctacctccagatgaactccctgaaacccgaggacaccgccacctattactgcaagcgcggccatgcgtgcgcgggctattaccctattccttatgatgactactgggggcaggggacacaggtgaccgtttctagcggcggttccggtggctccggcggttctgggcaggtccagctccaggagagcggtggaggctcagtgcaggctgggggctcactgagactgtcctgccgcgcctcccgctctccgtatggcaactactgccttggctggtttcgccagagcactggtaaggaacgtgagggagtcgccgtcatcaactgggtgggagggatgctgtatttcgctgacagcgtgaagggccgcttcactgtgtcccaggaccacgcgaagaacacagtgaccctgcaaatgaatagtctcaaaccagaagacactgctatgtattactgtgctgccgaatccgtcagctctttcagctgcggtggatggctgacaaggccagatcgggtgccttactggggtcagggcacccaggtgaccgttagcagc

SEQ ID NO: 1241 - DNA, 753 bp, synthetic construct
  source 1..753: mol_type = other DNA; note = Description of Artificial Sequence: Synthetic polynucleotide
caggtgcagttgcaggaatccgggggcggattggtgcaacctgggggctccctgcgcttgtcctgtactgcaagcggactgaccttcgatgactctgttatgggctggtttcgccaagctccgggtaaagggagggaagcagtgtcctgtatcagctccagcggggccaatgctttctacgcggatagcgtgaagggtcgttttactattagccgcgacaatgcaaagaacaccctgtacttgcagatgaactcactcaagcccgaagatacagccacttactattgtaagcgcggccacgcctgcgccggatattacccaatcccttacgatgactactggggccagggcacacaggttaccgtgagttctggcggtggcagtcaggtgcagctccaggagagcgggggtggcttggtgcagccgggaggctctctgaggctgtcctgtgctgcctcaggtttcaccttttcccactccggcatgtcctgggtgcgccaggcccccggcaagggtctggaatgggtgagtaccatcaacagtgggggcgcaagtacctactataccgactctgttaagggacgcttcactatcagccgcgacaacgctaagaacatgctgtacctccagttgaacagccttaaaaccgaagacacggccatgtattactgcgcgaaagggggctctggctacggcgacgcgagcaggatgaccagtcccggttcccagggcacacaggtgactgttagcagc

SEQ ID NO: 1242 - DNA, 771 bp, synthetic construct
  source 1..771: mol_type = other DNA; note = Description of Artificial Sequence: Synthetic polynucleotide
caggtgcagttgcaggaatctgggggtggcctggtgcaacctgggggcagcctgcgcctgagctgcaccgccagcggtctgaccttcgacgattccgtgatgggatggttccgccaggctcctggaaagggaagggaagctgtgagctgcatcagctcatccggcgcgaacgccttctacgccgattctgtgaagggccgttttaccatcagcagagacaacgccaagaacactctttatttgcagatgaactccctgaaaccagaggatacagcaacctattactgtaagaggggtcacgcctgcgccggttattaccccattccgtatgacgattactggggacagggcacccaggtaaccgtgtcctcaggtggcagtggtggctccggcgggagcggtcaggtgcaactccaggagagcggcgggggcctggtccagcccggtggctccctgcgtctgtcctgcgcggcctctgggttcactttcagccattccggcatgagctgggtccgccaggcccctggcaagggtctggagtgggttagcacgatcaactcaggcggggccagcacttattacaccgactccgtgaagggacgcttcaccatctctcgtgacaatgctaagaacatgctgtatttgcagctgaactccctgaagactgaggacactgccatgtactattgcgccaaaggtgggtccggttacggtgacgcgagcagaatgacctcacctgggagccagggcacgcaggtgaccgtgtcctct

SEQ ID NO: 1243 - DNA, 768 bp, synthetic construct
  source 1..768: mol_type = other DNA; note = Description of Artificial Sequence: Synthetic polynucleotide
caggtgcagctgcaagagtctggcgggggcctggtgcagcctggaggcagcctgcgcctgagctgtgcggcatcaggattcacgtttagctcctaccctatgtcttgggtcagacaggcaccgggaaagggtttggagtggatctccacaatttccgctggtggcgacaccactctctacgctgattctgtgaagggccgcttcacctcatctcgcgacaacgctaagaacaccttgtacctgcaactgaactctctcaagaccgaggacgccgcaatttactattgcgccaagcgtattgattgcaattccggttactgctaccgtaggaactactggggccagggtactcaggtcacagtgtctagtggtggcggttcccaagtgcagctccaggaatctggaggtgggtctgtgcaggctggaggcagcctgaggctgagctgtaccgcatccggggcaatcgcctctggctacatcgactcccgctggtgcatggcctggtttcgccaggctcccggcaaagagcgcgagggcgtggccgcaatctggcctggcgggggcctgaccgtttatgccgacagcgtcaagggacgcttcactattagccgggaccacgctaaaaacacactgtaccttcagatgaataacctcaaaccggaggacactgcgatgtactattgcgcggcaggatcaccccgcatgtgtccctccctggagttcggtttcgattactgggggcagggcacccaggttaccgtaagttcc

SEQ ID NO: 1244 - DNA, 786 bp, synthetic construct
  source 1..786: mol_type = other DNA; note = Description of Artificial Sequence: Synthetic polynucleotide
caagtccagctccaagagagcggcggtggcctggtgcaacctgggggctccctgcgcctgtcttgcgctgcatccgggttcaccttctctagctacccgatgtcttgggtgcgtcaggctccgggtaagggcctggaatggatcagtaccatctcagccggaggcgataccactctgtatgccgattctgtgaaaggccgctttacctccagccgtgataacgcaaagaacactttgtacctccagctgaactcattgaagactgaggatgcggccatttattactgtgcaaaacgcattgattgtaattccggctactgctaccgccgtaactattggggtcaaggtacacaggtaaccgtgtccagtggtggctctggcggtagtggtgggtctggccaggtgcagcttcaggaaagtggtggaggtagcgtgcaagctggaggctccctgaggctcagctgtaccgcctctggagcaatcgcctccggctacatcgacagccgctggtgcatggcttggttccgccaggctccagggaaggagagggaaggtgtggctgcaatttggcctggagggggcttgacggtgtatgctgatagcgtcaagggacgcttcaccatttccagggatcacgcgaaaaacaccctgtacctgcaaatgaataacctgaaacccgaggacaccgcaatgtattactgcgctgcgggttccccgcgcatgtgtccttctctggagttcgggttcgattactgggggcagggtacacaagtgactgtgtcctct

SEQ ID NO: 1245 - DNA, 750 bp, synthetic construct
  source 1..750: mol_type = other DNA; note = Description of Artificial Sequence: Synthetic polynucleotide
caggtgcagctccaggaatcaggcggtggactggtccaacccggagggtccctgcggctttcctgcgccgcaagcggatttactttctcctcttacccaatgagctgggtgcgccaagcgccagggaagggtctggagtggatctctacaattagtgcgggcggtgacaccacactctacgctgacagcgtcaagggtcggtttacctcctctcgcgacaacgccaagaacactctgtatcttcagctgaactccctgaaaaccgaagacgcggcaatttactattgcgctaagcggatcgactgcaactccggctactgttaccgtcggaactactggggccagggcacacaagttaccgtcagctccggtggcggttcacaagtacagctccaggagtccggcgggggcagtgtgcaggctggtggctccctgcgcctgtcctgcacggctcccggcttcacgtccaactcatgcggtatggattggtatcggcaggctcctggaaaggaacgcgaatttgtgagttcaatttctactgacggcaccacgggctacgctgacagcgtcaagggcagatttactatttccaaagataaggccaaggataccgtgtatctccaaatgaatagcttgaagcctgaggatacggggatgtactcttgcaagaccaaggacggcaccatcgcaactatggaactctgtgatttcggctattgggggcaagggacacaggtgaccgtcagctct

SEQ ID NO: 1246 - DNA, 768 bp, synthetic construct
  source 1..768: mol_type = other DNA; note = Description of Artificial Sequence: Synthetic polynucleotide
caagtacagcttcaggagtctggcgggggcctcgtccagcccggaggcagcctgcggttgtcctgtgccgcatccgggttcaccttctcctcttacccaatgtcttgggtgcgccaggccccaggtaagggattggagtggatctccaccatctctgcgggcggagacacgactctttacgccgacagcgttaagggccggtttacctcttcccgcgataacgccaaaaacactctgtatcttcagctgaacagtctgaagaccgaggatgccgctatttattactgtgctaagcgcatcgactgcaacagcggatattgctaccggaggaactactgggggcagggcacccaggttactgtcagctcaggcggttccgggggctctgggggctccgggcaggtgcagctccaggagtccggcggaggcagtgtccaagcaggaggttcactgcgtctgtcctgtaccgcccccggttttacatcaaactcatgtggcatggactggtatcgccaggcccccggtaaggaacgcgaatttgtctcaagcatttccactgacggcaccactggttacgctgactccgtgaagggccgtttcacaatctccaaggacaaggccaaggacaccgtgtaccttcagatgaacagcttgaagccagaagacacgggtatgtactcttgcaagaccaaggacgggaccatcgctacaatggagttgtgtgacttcggttactgggggcagggcacgcaagtcaccgtttcctcc

SEQ ID NO: 1247 - DNA, 765 bp, synthetic construct
  source 1..765: mol_type = other DNA; note = Description of Artificial Sequence: Synthetic polynucleotide
caggttcagctccaggaaagtggaggcggtctcgtgcagccgggcggatctcttagactgagctgtgcggccagcggcttcactttctctagctaccccatgtcctgggtgcggcaggctccgggtaagggcctggagtggatctccaccatttccgcaggaggcgatactaccctgtatgccgactctgtcaaaggccggttcacctcatcccgcgacaacgccaagaacactctgtacctccagctcaactccctgaagaccgaagacgccgctatctactattgtgccaagcgcatcgactgtaattccggctactgttatagacgtaactactggggtcagggaacacaggttactgtgtcctctggcggaggttctcaggttcagcttcaggagtcaggtggaggttctgtgcaggcaggcgggagcttgagactctcctgtgcggccagcggatacccttactcaaatggctatatgggatggttcaggcaggctcccggaaaggagagggagggcgtggcgactatctacacaggggacggtaggacttattacgcagacagcgtcaaagggaggtttactatctcacgtgacaatgcgaagaacacagtggacctccaaatgtccagcctgaagccagaggatactgccatgtattactgtgcagctagggcggcacccctctactctagtggctctcccttgacacgggcgaggtacaatgtttggggtcaggggacccaggtgactgtgtcctca

SEQ ID NO: 1248 - DNA, 783 bp, synthetic construct
  source 1..783: mol_type = other DNA; note = Description of Artificial Sequence: Synthetic polynucleotide
caggtccagttgcaggaaagtggaggcggactcgtgcaacccggaggcagcctccgtttgtcctgtgcggcttccggcttcacgttcagctcctacccaatgtcttgggtgcggcaagcgcccggcaaggggcttgagtggatctctacaatcagcgcaggaggtgatactaccctgtatgccgactctgtcaagggcagattcacctccagccgcgacaacgccaagaacaccctttatctccaactgaacagcctcaagaccgaagatgccgcgatttactattgtgctaagcgcattgactgcaactccggctattgctacaggcgcaactactggggccagggcactcaggtgactgtgtccagcggcggttctggaggctccgggggcagcggccaggtgcagctccaggagtctggtggaggctccgttcaggccggaggttcccttcgcctgtcttgtgctgcaagcggctacccatactctaacggctacatgggctggttccggcaagcgccgggtaaagaacgcgaaggggtggccacgatctacaccggggatggcagaacctattacgccgatagcgtgaagggtcgtttcactatttcccgtgacaatgcgaagaacaccgtggacctccagatgagttccttgaagcctgaggatacagctatgtactattgcgccgctcgcgcagccccactctattccagcggtagtcccctgacccgtgctcgctacaacgtatggggacagggtacacaggtgactgtgtcctcc

SEQ ID NO: 1249 - DNA, 738 bp, synthetic construct
  source 1..738: mol_type = other DNA; note = Description of Artificial Sequence: Synthetic polynucleotide
caggtccagctccaggaatccggtgggggcctcgtgcagcccggaggttctctgcgcctgtcttgtgccgcgagcggatttactttcagctcctaccccatgtcctgggtgcgtcaagccccaggtaaggggctggagtggatttctactattagcgctggaggcgacacaaccctgtatgccgacagcgtgaagggtcgctttacttctagccgcgacaatgcaaagaacacactgtaccttcagctcaactccctgaaaactgaagacgcggccatctattactgcgccaagcggattgattgtaacagcggatattgctacagacgcaactactggggccaggggacccaggtgacagtgtcaagcgggggcgggtctcaggtgcagcttcaggagagcgggggaggcagcgtccaggctggtggctccctgaggctttcttgtgtggcctccgccagtacctactgcacctatgatatgcactggtatcggcaagcgccgggcaaagggagagagtttgtgtccgctatcgactcagatggcacaaccagatacgccgatagcgttaagggcaggttcactatcagtcaggggaccgctaagaacaccgtgtatctccagatgaatagcctccagccagaggataccgccatgtactattgtaagacagtgtgtgttgtcggatcacgctggagcgactactggggacagggcacccaggtgaccgtgtcctct

SEQ ID NO: 1250 - DNA, 756 bp, synthetic construct
  source 1..756: mol_type = other DNA; note = Description of Artificial Sequence: Synthetic polynucleotide
caggtccagttgcaagaatccggcggtggcctcgtgcagcctggcgggtcactgcgtttgtcttgtgccgctagtggcttcacatttagctcctaccccatgagctgggtccggcaggcccctggcaaaggcctggagtggatcagtaccatctccgcagggggcgacacaaccctgtatgcggactctgtgaagggtagattcacatcatccagggacaacgccaagaacacactttatctccagcttaactctctgaagacagaggatgcagccatctactattgcgctaagcgtatcgactgcaactccggttattgttaccgtcgcaattactggggacagggaacacaggtgactgtttcctctggaggctccggtggctccgggggcagcggccaggtgcagctccaggagtctggaggcggaagcgtgcaggctggcggttctctgcgcctgagctgtgtcgcaagtgcctctacctactgcacttacgacatgcactggtatcggcaagcgcccggaaaaggcagggagtttgttagcgccattgattccgacggtactacccgctatgccgatagcgtgaaaggcaggtttactatcagccagggcactgcgaagaacaccgtgtacctccagatgaactccctccagcccgaggacaccgccatgtattactgcaaaaccgtctgcgtcgtgggatcacgttggtctgactattgggggcaggggactcaggtcactgtgtccagc

SEQ ID NO: 1251 - DNA, 732 bp, synthetic construct
  source 1..732: mol_type = other DNA; note = Description of Artificial Sequence: Synthetic polynucleotide
caggtgcagcttcaggagagcggcgggggtctcgtgcagcctggaggctctctgcgcctgtcctgtgccgcgagcggattcactttctcttcatacccgatgtcctgggtgcgccaggcccccggcaagggactggagtggatcagcacgatctccgccggaggcgacacaaccctgtatgccgactctgttaaggggaggttcaccagtagccgtgacaatgccaagaacactctgtatctgcaactgaactctctcaagactgaggatgccgctatctattactgcgcgaagcgcattgactgcaacagtggctactgctaccgcaggaactattggggccagggcacccaggttaccgttagttctggaggcggatcacaagtgcagctgcaagagtctggaggtggcagtgtgcaagcaggtggctctctgactctgtcctgcgctgccagcgagtatgcttactctacgtgcaacatgggctggtatcgccaggcccctgggaaagagcgggaactggtttccgcgttcatctccgacggctccacttattacgccgactccgtgaaggggagattcaccatcactcgggacaacgcaaaaaatactgtctatctccagatgaactccctcaagcctgaggatacagctatctactattgctctgctaactgctatcgtcgcctgcgcaactattggggacagggcacacaggtgacagttagcagc

SEQ ID NO: 1252 - DNA, 750 bp, synthetic construct
  source 1..750: mol_type = other DNA; note = Description of Artificial Sequence: Synthetic polynucleotide
caggtgcagttgcaggaatctggcgggggtcttgtccagcccggtggctcactccgcctgagctgcgctgccagcggtttcactttcagttcctatcctatgagttgggtgcggcaggccccaggcaaaggactggagtggatctctacaatctcagctggtggcgataccactctttatgccgattctgtgaagggtcgtttcacttcttccagagacaacgcgaagaacacgttgtatttgcagctgaacagtctgaaaaccgaagacgcggccatctattactgtgccaagaggattgattgtaacagcgggtattgttatcgccgtaactattgggggcagggcactcaagttaccgttagctccggtggctccgggggtagcgggggaagcggccaggtccagctgcaagagtctggagggggttccgttcaggcgggagggtctctgaccctgtcttgcgcggcctcagaatacgcctactccacctgtaatatgggttggtacagacaggcccctggcaaagagagggaactcgttagcgctttcatctccgatgggtccacttattacgcggacagcgtcaagggccgcttcaccatcacacgcgataacgccaagaatacggtttatctccagatgaactccctcaagcccgaggatactgcgatctattactgttccgcgaactgctacagacggctgcgtaactattggggccaggggactcaggttaccgtgtccagc

SEQ ID NO: 1253 - DNA, 753 bp, synthetic construct
  source 1..753: mol_type = other DNA; note = Description of Artificial Sequence: Synthetic polynucleotide
caggttcagctccaggagagcggtggaggtttggtccaaccgggaggcagcctgagactcagttgtgccgcttctggcttcactttctcctcttaccctatgtcctgggtcagacaagcaccggggaagggtctggaatggatctccaccatttcagctggaggcgataccacattgtacgccgactccgtgaagggacgcttcacctcttcccgcgataatgccaagaacaccctgtatttgcagttgaatagcctgaagaccgaggatgccgctatttactattgtgctaagcggatcgactgtaacagcggttactgttacaggcgcaactactggggtcaaggcacccaggtaaccgtcagctccggcggtgggtcccaggtgcagctccaggagtcaggaggcggactcgtgcaacccggtggctccctccgcctcagctgtaccgcttccggtctcacctttgatgactcagttatgggctggtttaggcaagcgccgggcaagggcagagaagctgtgtcttgtatctcctcatccggtgctaacgccttctacgctgacagcgtgaagggtcgctttacaatcagtagagataacgccaaaaacactctttacttgcagatgaactctctcaagcctgaggataccgccacttattactgtaagaggggtcatgcttgcgctggctattaccccatcccctatgatgactattggggccagggcacccaggtgactgtgtctagt

SEQ ID NO: 1254 - DNA, 771 bp, synthetic construct
  source 1..771: mol_type = other DNA; note = Description of Artificial Sequence: Synthetic polynucleotide
caggtgcagcttcaggagagcggcggaggcctcgtgcagccaggaggctccctgagactctcctgcgccgcaagcggatttacattttctagctacccgatgtcctgggtgagacaagcgcccggcaaaggccttgaatggatctctactatctctgctggaggcgacacaaccctgtatgccgatagcgttaagggacgtttcacctcttccagagacaatgctaagaacaccctgtacttgcagctgaactccctcaagacggaggatgcagcgatctactattgcgcgaagaggattgactgtaacagtggctattgttacaggcgcaattactggggccagggaactcaggtgaccgtctcctctggcggttccgggggatcaggaggcagtggccaggtgcagttgcaggaaagtggcggagggctggtgcaaccaggcggatctttgagattgtcctgcaccgcctccggcctgacatttgacgattcagtgatgggctggttccgtcaggcacccggcaagggccgcgaggccgtgagttgtatcagctcctcaggcgcaaacgccttctacgccgacagtgttaagggcaggttcactatctccagagacaatgcaaagaacactctgtaccttcagatgaacagcctgaagccagaggacacagccacatactattgcaagcgcggccacgcttgcgccgggtactatcccatcccctacgacgattactggggacagggcactcaggtcacagtgagtagc

SEQ ID NO: 1255 - DNA, 768 bp, synthetic construct
  source 1..768: mol_type = other DNA; note = Description of Artificial Sequence: Synthetic polynucleotide
caagtacaacttcaggaatctgggggcggtctcgttcagcctgggggctctctgaggctgtcttgcgccgcgagcggatttactttttccctcagcggcatgagctgggtcagacaggcccctggcaaagggctggaatgggtgtccgccatctccagcgggggcgcttctacatactatactgacagcgtgaagggcaggttcactatttcccgcgacaatgccaagaacattctttaccttcagctgaactccctcaaaacagaggacaccgcgatgtattactgtgctaagggcgggagcggttatggcgatgcgagtcgcatgacctcccccggcagtcagggaactcaggtcactgtcagctctgggggcgggtcccaggttcaactccaggagtcaggagggggctctgttcaggctggcggtagcctgaggctgtcctgcaccgcctctggagccatcgccagcggctatattgattcacgctggtgtatggcgtggttccgccaggctcctggcaaagaaagggaaggtgtagccgctatttggcctggaggcggtctgaccgtctatgccgatagcgtgaagggcaggtttactatctctcgggatcacgcgaagaacaccctgtatcttcagatgaacaatctcaagcctgaggacacagctatgtattactgcgcagcgggttccccgcgcatgtgccccagcctggagttcggattcgattactgggggcaaggcacccaagtcactgtttctagc

SEQ ID NO: 1256 - DNA, 786 bp, synthetic construct
  source 1..786: mol_type = other DNA; note = Description of Artificial Sequence: Synthetic polynucleotide
caagttcagctccaggagtccggtggcggactcgttcagcctggaggcagtctgaggctgtcttgtgccgcgtcagggttcaccttcagcctgtctgggatgagctgggtccgccaggccccaggcaagggcctggaatgggtgtcagccatcagctccggcggtgcctctacttattacactgactcagtgaagggtcgttttaccatctcccgcgacaacgccaagaacattctgtatctccagctcaacagcctgaaaacggaggacaccgctatgtattactgtgctaagggtggctcagggtacggggacgcttctcgcatgacatctcctggctcccagggcacccaggtgactgtcagctcaggaggcagcggaggcagtggcggatctgggcaggtccagctccaagagtctggagggggttcagtgcaggctggaggttctcttaggctgagctgtaccgccagcggagccatcgcttctgggtatattgacagccgctggtgcatggcttggttccggcaagctccaggtaaggagagggagggagtggcagccatttggcccggaggcggactcacagtgtatgccgatagcgttaagggcagatttaccatcagccgcgatcacgcaaaaaacacactctaccttcagatgaataacctgaagccggaggacaccgccatgtattactgtgccgctggctctccacgcatgtgccctagcctggagttcggttttgactactggggtcaaggcacacaggtgaccgtgtctagt

SEQ ID NO: 1257 - DNA, 750 bp, synthetic construct
  source 1..750: mol_type = other DNA; note = Description of Artificial Sequence: Synthetic polynucleotide
caggtccagttgcaggaatctggaggcggactggtgcaacctggcggttccctgcggctgtcctgtgcagccagtggctttaccttcagcctgagcggcatgtcctgggtgagacaggcccccggaaagggtctggaatgggtgagtgccatcagctccggcggagccagtacctattacaccgatagtgttaaggggcgctttaccatctcccgtgacaacgctaagaatatcctttatctccaactgaacagcctgaagaccgaagacaccgccatgtattactgtgccaagggtggctctggatatggcgatgccagccgcatgaccagtcctgggtcccaaggcacacaggtaacagtgtctagcggcggaggcagccaggtgcagctgcaagaaagcggcggtggcagtgtccaagctgggggcagcttgcgcctctcttgcactgcgcccggtttcacctctaatagctgtggcatggattggtatcgccaggcaccgggcaaggagagggagttcgtgagttccatcagcaccgacggcactacgggatatgccgacagcgttaagggccgcttcaccatctcaaaggacaaggccaaggatactgtgtacctgcaaatgaacagtctgaagccggaggataccgggatgtactcttgcaagaccaaggacggaaccatcgcaactatggagctgtgtgacttcggctactggggccagggaacccaggtgacagtctcttcc

SEQ ID NO: 1258 - DNA, 768 bp, synthetic construct
  source 1..768: mol_type = other DNA; note = Description of Artificial Sequence: Synthetic polynucleotide
caggtgcagcttcaggagtccggcggtggcctggtccagccgggcggaagcctgcgcctttcctgcgccgcgtctggcttcaccttctctctcagcggtatgagttgggtccgccaggccccagggaagggcctggagtgggtgtctgctatctctagcggaggcgctagtacctattacacagattccgtcaagggccgctttacaatctcacgcgataacgccaagaacatcctgtaccttcagctgaacagcctgaaaaccgaggataccgctatgtactattgcgctaagggaggctctggctacggagacgcttcacgtatgaccagtcctggcagccagggaacacaggtcacagtcagctccggcggtagcggtggctccggcgggagcggccaggttcaactccaggaatctgggggcggttccgtccaggctgggggttctctgagactgagctgcacagcccctgggttcacctccaacagttgcggaatggattggtatcgtcaggcccccggcaaggagagagagtttgttagctctatctccacggacgggaccactggttatgctgacagcgttaagggccgttttactatctccaaggacaaggccaaagacaccgtgtacttgcagatgaactctctgaagcccgaggataccggaatgtactcatgcaaaaccaaagatggtactattgctactatggagctgtgtgacttcggctattggggccaggggacccaggtgactgtgtcctct

SEQ ID NO: 1259 - DNA, 765 bp, synthetic construct
  source 1..765: mol_type = other DNA; note = Description of Artificial Sequence: Synthetic polynucleotide
caggttcaactgcaagagtctggaggcggtctcgtacagccaggtgggagcctccgcctgtcctgtgcagccagcggtttcaccttctccctctccggtatgtcctgggtgcgccaggcccctggaaaaggcttggagtgggtgtctgccatcagctcaggaggcgcgtccacatattacaccgacagtgtcaagggccggttcaccatctccagggacaatgcgaagaatatcctctacttgcagctgaactccctcaaaactgaggacactgcaatgtattactgcgctaaagggggcagcggatatggggatgcttcccggatgacatccccaggcagccagggcacccaagtgaccgtgtcttccggtgggggctcccaggtgcagctccaggaaagcggagggggaagcgtgcaggcagggggtagccttcgtctgtcttgtgcagccagcggctacccgtattctaatggatacatgggctggttcaggcaagcccctggcaaggaacgcgagggcgtggccacgatctataccggagacggcaggacttactatgccgatagcgtgaaagggcgcttcaccatctcacgtgacaacgcgaaaaataccgtggatcttcagatgtcctctctcaaacccgaggacaccgcgatgtactattgcgccgcacgggctgcccctctgtactcatctggctcaccgttgactcgggcaagatataacgtgtggggtcagggcacacaggtcaccgtgtcttcc

SEQ ID NO: 1260 - DNA, 783 bp, synthetic construct
  source 1..783: mol_type = other DNA; note = Description of Artificial Sequence: Synthetic polynucleotide
caggtccaactccaggaaagcggcggtggcctggtgcagcctggtgggtccctcagactgtcttgcgccgcttctggcttcaccttttctttgtccgggatgtcttgggtccgccaagcgccgggcaagggcctggagtgggtgtccgccatttcatctggtggagcttcaacttattacaccgactctgtgaagggtcgttttaccatctcccgtgacaacgcgaagaacatcctgtatttgcagctgaactccttgaaaaccgaggatacggccatgtactattgtgcaaagggcggttccggttacggcgacgcttcacgcatgacctcccccggttcccagggcactcaggtgaccgtctcaagtggcggtagcggtggctctggtggcagcggacaggtccagcttcaggaatcaggcggagggagtgtgcaagcaggcggatctctgagactgagctgtgctgccagcggttacccctactctaacggctatatgggttggttcaggcaagcgcctggtaaggagcgcgagggtgtggccacgatctataccggggatggcaggacctactatgccgactctgtgaagggtcggttcaccatcagccgggacaacgcgaagaacactgtggatttgcagatgtcttccctgaaacccgaggacaccgccatgtattactgcgctgcaagagccgctcccctgtatagctctggatctcctctgacccgtgcaagatacaatgtatggggtcagggaacccaggtcaccgtcagcagt

SEQ ID NO: 1261 - DNA, 738 bp, synthetic construct
  source 1..738: mol_type = other DNA; note = Description of Artificial Sequence: Synthetic polynucleotide
caggtgcagcttcaggagtcaggtgggggcctggtccagccaggcggttccttgcgcctgtcatgcgccgctagtgggttcacttttagcctgtccggcatgtcctgggttcggcaagcacccggcaagggtttggagtgggtgtccgccatttcttccgggggcgcatctacctattacactgattctgtcaaggggcgctttaccatttctcgtgacaacgctaaaaacattctgtatctgcaacttaactcactgaagaccgaggatacagcaatgtactattgcgccaagggtggctccgggtacggcgatgcgtcacggatgacatctcctgggtcccagggaactcaggtgaccgtgtcctcaggcgggggcagtcaagtgcagctccaggagagcggaggtggctctgtgcaagctgggggaagtctccgcttgtcttgtgtggcctccgcaagcacatattgcacctacgacatgcactggtataggcaggctcccggcaagggccgggagtttgtttccgcaatcgacagcgacggcaccactcgctatgccgatagcgtgaaaggtcgttttaccatctcccaggggaccgcaaagaacacagtctacttgcagatgaactcccttcagcctgaggacaccgctatgtattactgtaagaccgtgtgcgtcgtgggcagtcgttggtccgattactggggccagggaacacaggtgacagtcagttct

SEQ ID NO: 1262 - DNA, 756 bp, synthetic construct
  source 1..756: mol_type = other DNA; note = Description of Artificial Sequence: Synthetic polynucleotide
caggtgcagctccaggagtctggcgggggcctggtccaaccgggtggctcactccgcctgtcttgcgccgcgtccggcttcacattcagtctctccgggatgtcctgggtgcgccaagctccgggcaaaggcttggagtgggtatctgctatctctagcggtggagcttccacatactataccgactccgtgaagggccgcttcaccatttcacgtgataacgcgaagaacattctgtatcttcagctgaacagcctgaaaaccgaggacaccgctatgtactattgtgccaagggaggcagcgggtatggggacgcttcccggatgacctcccccggttctcagggtactcaggtgaccgtctctagcggtggctctggtggctccggcggatctggacaggtacagctccaggagtcaggtggagggagtgtgcaggcaggtggctccctgcggttgtcctgtgtggccagcgcctctacatattgcacctacgacatgcactggtacaggcaggccccaggtaaagggcgtgaatttgtgagtgccattgactctgatggaacgactagatacgcggattccgtcaaggggcggtttacaatctctcagggcaccgccaagaacaccgtgtatctccaaatgaactcattgcagcctgaggacactgccatgtattactgcaagaccgtgtgcgtcgtgggctcccgttggtccgattattggggccagggcacacaggtaaccgtatcttcc

SEQ ID NO: 1263 - DNA, 732 bp, synthetic construct
  source 1..732: mol_type = other DNA; note = Description of Artificial Sequence: Synthetic polynucleotide
caggtacagctccaggaatccggtgggggcttggtccagccagggggtagtctgcgcctttcctgcgctgcctccggcttcaccttcagcctgtcaggcatgtcctgggtccggcaagcgcctggcaaggggctggagtgggtctccgccattagcagtggtggagcgagcacttattacactgacagcgtgaagggacgctttacaatttcacgtgacaacgccaagaacatcctctacttgcagctcaattctctgaagaccgaggataccgcaatgtactattgcgccaagggtggctccggttacggggacgccagccgcatgacatctccgggttctcagggtacacaggtgactgtctcatccgggggcgggagccaggtccagctccaggagtctggtgggggctccgtgcaagctggcggttcactgacactgagctgtgcagcgtctgagtatgcgtactctacgtgtaacatgggatggtataggcaggctccggggaaggagcgcgaactcgtgtcagcttttattagcgacggctccacgtattacgcagatagcgtcaagggacggttcaccatcacacgggacaatgcgaagaataccgtgtatctccagatgaactccctcaagcccgaggacaccgcaatctattactgtagcgcaaattgctaccggagactgcggaactactggggccagggcacccaggtaaccgtgtcttcc

SEQ ID NO: 1264 - DNA, 750 bp, synthetic construct
  source 1..750: mol_type = other DNA; note = Description of Artificial Sequence: Synthetic polynucleotide
caggtgcagttgcaggaatcagggggcggtctcgtgcagcccggtggatcactgagactgtcatgtgctgcctccggcttcacattcagcctgtctggtatgagctgggtccgccaggcaccaggcaagggactggagtgggtgagtgctatctcatccgggggtgccagcacctattacaccgacagcgtaaaaggacgtttcactatctcccgcgataacgctaagaacatcctgtacctccagctcaattctctgaaaacagaagataccgccatgtattactgcgctaagggaggcagcgggtacggcgatgcgtcccgcatgacatcccccggaagtcagggaacccaagtgacagtgtcttccgggggctctggcggttccgggggttctggccaagtgcagctccaggaatccggcgggggatctgtgcaggcgggcgggtctctgacattgagctgcgcggcctctgagtatgcttactctacctgcaacatgggctggtataggcaggcccccggcaaggaacgcgaactggtgtccgccttcatttccgacgggtccacctattacgccgactccgtgaaaggcaggttcactatcacccgcgacaacgccaagaatactgtgtacctccagatgaatagcttgaagcccgaggataccgcgatttattactgctccgcaaattgctatcgtcggctcagaaattattggggccagggcacacaggttaccgttagctca

SEQ ID NO: 1265 - DNA, 753 bp, synthetic construct
  source 1..753: mol_type = other DNA; note = Description of Artificial Sequence: Synthetic polynucleotide
caagtccaactccaggagtccggcggtggcctggtgcagcccggtgggtccctgcgcctgtcatgtgctgccagtggtttcacattcagcctctcaggcatgtcttgggtacgccaggcccctgggaagggcctggagtgggtctccgccatctccagcggtggcgcaagtacatattacactgattccgtgaagggtcgtttcacaatctctagggataacgctaagaatatcctgtacctccagcttaactccctgaagaccgaagataccgctatgtattactgtgcgaagggcggttctggctatggggatgcctcacgcatgacctctcctgggtcccagggcacccaggtgactgtcagctcaggcgggggcagccaggtgcagctccaggagtccggtggcgggctggtgcagcctggcggaagcctcagactgtcatgtaccgcgagtggactgacatttgatgacagcgtcatgggctggttccggcaggccccaggaaaggggagggaagctgtgagctgtatttcttcctctggcgctaacgccttctacgctgacagtgtgaagggccgtttcaccatttccagagacaacgcaaagaacactctgtacctccagatgaactcactgaagcctgaggacaccgcgacatactattgtaagcgtggtcacgcttgtgctggctactatcctatcccatacgatgactattggggtcagggcacacaggtgaccgtgagtagc

SEQ ID NO: 1266 - DNA, 771 bp, synthetic construct
  source 1..771: mol_type = other DNA; note = Description of Artificial Sequence: Synthetic polynucleotide
caggtccagttgcaggaatctggaggtggcctggttcagcccggaggcagcctgagactgagctgcgctgcgagcggattcacctttagcctgtctggcatgagctgggtaaggcaggctccaggcaagggactggagtgggtgtctgctatctccagcggaggcgcttccacctattacacagactctgttaaaggccgtttcactatcagtagagacaacgcgaagaacatcctctatcttcagctgaatagcctgaagacagaggataccgccatgtattactgtgccaagggaggtagcggttacggcgacgccagccgcatgacaagtccgggctcccagggcacacaggtgaccgtatccagcggtggctccggtgggagcggcggttccggccaggtgcagctgcaagaaagcggcggtggcctggtgcagccagggggttctctgcgtctgagctgcaccgcgagtgggctgaccttcgacgattccgttatgggctggttccgccaagctccgggaaagggcagagaggccgtatcctgcatcagctccagcggggccaacgccttctatgccgatagtgtgaagggacgctttaccatttctcgcgataacgcgaaaaacacactgtatcttcagatgaactcactgaagcctgaggacaccgccacgtactattgtaaacgcggccacgcctgcgctggttattaccctattccatacgacgattactggggccagggcacccaggtcactgtgtcctca

SEQ ID NO: 1267 - DNA, 759 bp, synthetic construct
  source 1..759: mol_type = other DNA; note = Description of Artificial Sequence: Synthetic polynucleotide
caagtgcagctccaggagagcggaggtggctcagtgcaggcaggcggttcactgcgtctgtcctgcgtcgcctctggctacgttagctgtgattattttctcccctcctggtatcggcaggctcctgggaaagagcgcgaatttgtaagcatcattgacggcaccggctctaccagctatgcggcctccgtcaaaggacgctttaccgcatccgaagataagggcaagaacatcgcttacttgcagatgaactctctgaaaccagaggataccgctatgtactattgtaaggcgtcatgcgtgcgtggccgcgccgtgagcgaatactggggccaaggaacccaagttaccgtctcctcagggggcgggtcccaagtgcagttgcaagaatccggtggcggatctgtccaagccggaggttccctgagactctcatgtaccgcaagcggtgccattgcaagcggctatattgattcccgctggtgcatggcttggttccgccaggccccagggaaggagcgtgagggtgtggccgctatctggcccggagggggcttgaccgtgtatgccgattccgtcaaaggacgtttcactatcagccgcgaccacgccaaaaacactctttatctgcaaatgaataacctcaagccagaggacacagctatgtactattgcgccgcaggctccccacgcatgtgtccttccttggagttcggcttcgactactggggacagggtactcaggttactgtctcctcc

SEQ ID NO: 1268 - DNA, 777 bp, synthetic construct
  source 1..777: mol_type = other DNA; note = Description of Artificial Sequence: Synthetic polynucleotide
caggtgcagctccaggagtctggaggcggttccgttcaggccggtggctccctgcgtttgtcttgcgtggccagtggctacgtcagttgtgactacttcctgccctcatggtatcgtcaagcgccaggtaaggagcgcgagttcgtctccattatcgacggaacaggttctactagctacgccgcttctgtcaaggggcgcttcaccgcttccgaggataagggtaagaacatcgcgtatctgcaaatgaactcattgaagcccgaggacaccgccatgtattactgtaaagcctcctgtgtgcgtggccgcgctgtgtccgagtactggggccagggcacacaggtgaccgtttccagcggcggttccggcgggtccgggggctcagggcaggtgcagcttcaggagagcggagggggatctgtgcaggccggtggctccctgcggctgtcctgcacagcatctggggccatcgcgtccgggtacatcgactcccgctggtgtatggcctggttccgccaagcgcctggcaaggagcgtgagggcgtggccgcgatctggccgggtggcggactcacagtctacgctgacagcgtcaaggggcgtttcactattagcagagaccacgctaagaacaccctttaccttcagatgaataacctgaagcctgaagacaccgcgatgtactattgcgcagctggttctccccgcatgtgcccctcacttgaatttggtttcgactactgggggcagggtacgcaggtcacggtgtcctcc

SEQ ID NO: 1269 - DNA, 741 bp, synthetic construct
  source 1..741: mol_type = other DNA; note = Description of Artificial Sequence: Synthetic polynucleotide
caagtccagctccaggagagcggtggcgggtccgtgcaggcgggaggcagcctccgcctcagttgtgtcgcctctggctacgtgtcctgcgattattttcttccgtcctggtatcgccaggctcccggcaaagaaagggagttcgttagcatcattgatggcacgggttccacaagttacgctgccagcgtgaaaggtaggtttaccgcttctgaagacaaaggaaagaacatcgcctacttgcagatgaactctctgaagcccgaggacacagccatgtactattgcaaagcctcttgcgtgaggggacgggcggtgtctgaatactgggggcaaggaacccaagtgaccgtgtcctctggaggcggtagccaggtccagctgcaagagtccggcggaggctctgttcaggccggtggctcactgcgcctgtcttgtaccgcacctggcttcactagcaactcttgtggaatggactggtatcgtcaggcccccggtaaggaaagagagttcgtttcttccatttctacagacggcacaacggggtatgcggacagtgtgaaaggaagattcactatcagtaaggataaggccaaagacaccgtgtatctccagatgaactccttgaaaccagaggacactggaatgtatagctgcaagaccaaggacgggaccattgctacgatggaactctgcgatttcggctactgggggcaggggacacaggtgactgtgtcctcc

SEQ ID NO: 1270 - DNA, 759 bp, synthetic construct
  source 1..759: mol_type = other DNA; note = Description of Artificial Sequence: Synthetic polynucleotide
caggtgcagttgcaggagtccggcggtgggtccgtgcaggctggcggtagcctgcgcctgagttgcgtggcctctggatacgtctcttgcgattacttcttgccctcttggtatcgccaggctcccggcaaggagcgcgagttcgtgagcatcattgacggcacgggtagcaccagctacgctgccagcgtgaagggacgttttacagcctctgaggacaaggggaagaacattgcgtatcttcagatgaactccctgaagcccgaggataccgccatgtactattgcaaggcctcctgcgtgcgtggccgggccgttagtgagtattggggccaggggacgcaggtcaccgtcagtagcggtggctccggcggttctggtggcagtggtcaggtccagctccaggagagcggtggaggcagcgtccaagctggcgggtccctgaggctgtcttgtactgcgccgggatttacttccaacagctgcggtatggactggtatcggcaggcccctgggaaagagagggagttcgtgtcttccatctctacggatggtactaccggctacgccgacagcgtgaagggccgttttactattagcaaagacaaggctaaagacacagtctaccttcagatgaactctctcaaaccagaggacactggtatgtatagctgtaaaaccaaagatgggaccatcgctacaatggaactctgcgatttcgggtactggggacagggcacccaagtcactgtctctagt

SEQ ID NO: 1271 - DNA, 756 bp, synthetic construct
  source 1..756: mol_type = other DNA; note = Description of Artificial Sequence: Synthetic polynucleotide
caggtgcagcttcaggagtccgggggaggcagcgtgcaggcaggaggcagcctgcgcctgtcttgcgtcgcttccggctacgtgtcctgcgactatttcctgccttcttggtacagacaggcacctggaaaggagcgcgagttcgtctctattatcgacggcaccggcagcacttcttacgctgcctccgttaagggccgcttcaccgcaagcgaggacaagggaaagaatattgcctacctccagatgaacagcctgaaaccagaggacaccgcgatgtattactgtaaggcatcatgcgtgcgcggtcgcgcagtgtcagagtattggggtcagggaacccaggtgacagtttcttccggcggtggctctcaggtgcagttgcaggagagtggtggagggtcagtccaggctggaggctccctcagactttcctgtgccgctagtggatacccctattccaatggatatatgggttggtttagacaagctccaggaaaggagcgtgagggcgtcgcgaccatctacactggcgacggtcgcacctactatgcggatagcgtgaagggccgtttcaccatcagccgtgacaacgccaagaataccgtcgatttgcagatgtcttccttgaaaccggaggacaccgctatgtattactgtgcggccagagctgcgccattgtatagctccggttcccctctgacccgcgctcgctacaatgtgtggggacagggcactcaggtcaccgtctcatcc

SEQ ID NO: 1272 - DNA, 774 bp, synthetic construct
  source 1..774: mol_type = other DNA; note = Description of Artificial Sequence: Synthetic polynucleotide
caggtgcaactccaggagagcggcgggggttccgtccaggctggtggctctctgaggttgagctgtgtagccagcggctacgtgtcttgtgactacttcctccccagctggtatcgtcaggctcctggcaaggagcgcgagtttgtcagtatcattgatggcaccgggagcacctcatacgctgcctctgtgaagggtcgcttcactgccagcgaggataagggcaagaacatcgcctaccttcagatgaactctttgaagccggaagacactgccatgtattactgcaaggcttcttgcgtcaggggacgcgcagtgtcagagtattgggggcagggaacccaggttaccgtcagctccggcggaagcggaggcagcgggggcagcgggcaggtgcaactccaggaatctgggggaggctccgttcaggctggcggttctctcagactcagctgcgcggcctccggctatccatattccaacggatacatgggctggttccgtcaggctcccggaaaggaacgcgaaggggtggctaccatctacaccggagatggccggacttattacgcggactctgtgaagggtcgcttcaccatttcaagggacaacgcaaagaacaccgtggacctgcaaatgtcttccctgaaaccagaagacaccgccatgtactattgtgctgcccgcgccgcacccctgtatagctccggttcccctcttacgagggcacgttacaacgtctggggccagggcactcaggtgacagttagctcc

SEQ ID NO: 1273 - DNA, 729 bp, synthetic construct
  source 1..729: mol_type = other DNA; note = Description of Artificial Sequence: Synthetic polynucleotide
caagtgcagctgcaagagagtggcggaggctctgtgcaggctggcggttccctgagactcagttgcgttgcctcaggctacgtgtcttgtgactacttcttgccctcttggtatcggcaggctcccggaaaggagcgcgagtttgtttcaatcattgatgggacaggttctacctcctacgccgcgtcagttaagggacggtttactgcgtccgaggacaagggaaagaacattgcataccttcagatgaactctctgaagcccgaagatacagccatgtattactgcaaggcctcctgcgtcagaggtagagcagtctccgagtactggggccagggaacccaggtgacagtgagtagcggagggggctctcaggtgcagctgcaagagagcggcggtggctccgttcaggccggtgggagcctcaggctcagctgtgtggcgagcgcttccacttattgcacctacgacatgcactggtatcggcaggctccgggaaagggcagagagttcgtatctgccatcgactcagacgggaccacacgttacgccgactctgtgaagggccgcttcactatcagccaaggcaccgccaaaaacactgtttatttgcagatgaacagcttgcagccagaggacaccgccatgtattactgtaagacagtttgtgtggtaggcagcagatggtccgactactggggccagggtactcaagtgaccgtctccagc

SEQ ID NO: 1274 - DNA, 747 bp, synthetic construct
  source 1..747: mol_type = other DNA; note = Description of Artificial Sequence: Synthetic polynucleotide
caggtccagctccaggaaagcggcggtggcagcgtgcaggctggcggatctttgcgtctttcatgcgtggccagcggttatgtaagctgcgactattttctgccaagctggtatcggcaggcacctggcaaggagcgtgaatttgtcagcatcattgatggcaccggatctacctcctacgcagcgagcgtcaagggaagattcaccgcctcagaagataagggcaaaaacatcgcctacctccagatgaactccctgaagcctgaagatacagcgatgtactattgcaaagccagctgtgtccgtggcagagccgtgtccgagtattggggccagggaacacaagtgactgtttcctctggtggatcaggaggcagcggtggctctggccaggtgcagcttcaggagagcggaggtggatctgtgcaggctggcggttcacttcgtctgtcctgcgtcgcctctgcgtctacctattgtacctacgatatgcactggtatcgccaagcccctggcaagggccgcgagttcgtgtccgctattgattccgacggaactacccggtacgccgattctgtcaagggaagatttacaatctcccaggggaccgccaagaataccgtctatctgcaaatgaacagtttgcagccagaggacactgctatgtattactgcaagaccgtgtgcgtggtcggaagccgctggtctgactattggggtcagggcacccaggtgaccgtgtcctcc

SEQ ID NO: 1275 - DNA, 723 bp, synthetic construct
  source 1..723: mol_type = other DNA; note = Description of Artificial Sequence: Synthetic polynucleotide
caggtccagctccaggagtcaggtggcggttccgtccaggccggaggcagcctgcggctttcctgtgtggcttctggctatgttagctgcgactactttctcccttcctggtatcgtcaagcgcctggaaaggagagggagttcgtctccatcattgacgggacgggttccaccagctatgcagcctccgtgaaggggagattcactgccagtgaagacaagggtaagaacatcgcttatttgcagatgaactccctgaaaccagaggataccgctatgtattactgcaaggcgtcttgcgtgaggggccgcgctgtgtccgaatactggggccaggggacccaggtcaccgttagctctggaggcggttcccaggtgcagcttcaggaaagcggaggtggcagcgtgcaggctggaggctcactgacactgtcttgcgcagcctccgaatacgcatattcaacctgcaacatgggctggtatcgtcaggcccctggcaaggagagagagctggtgtctgctttcatctctgatggctccacgtattacgctgattctgttaagggtcgttttaccatcacacgggacaacgctaagaacacggtgtatcttcagatgaacagtttgaagcccgaggatacagcgatctactattgcagcgcgaattgttatagacgcctgcgcaactattggggtcagggcacacaggttaccgtaagctca

SEQ ID NO: 1276 - DNA, 741 bp, synthetic construct
  source 1..741: mol_type = other DNA; note = Description of Artificial Sequence: Synthetic polynucleotide
caagttcagctgcaagaatctggaggcgggtctgtgcaggctggcggttccctgcgtctctcatgcgtcgcctctggctacgtttcctgcgactactttcttccttcatggtacaggcaggcccctggcaaggagcgcgagtttgtgtccattatcgacgggactggtagcacatcctatgctgcctccgtgaaaggacgctttacagccagtgaggacaagggtaagaacatcgcttatctgcaaatgaactcactcaagcccgaagacacagctatgtattactgcaaggcatcctgtgtgcgtggccgcgccgtgtctgagtactgggggcaggggacacaggtgaccgtgtcctctgggggctcaggtggctccggtggctccggccaagttcagctccaggagtctggaggcggtagcgtgcaggctggaggctccctgacccttagctgcgccgctagtgagtatgcgtattcaacttgcaacatgggttggtacaggcaggccccagggaaggagagagagctggtcagcgctttcattagtgacgggtctacgtattacgccgactccgtgaaggggagatttactattacccgtgataacgcgaagaatactgtgtatttgcagatgaactctctcaagccggaggacaccgccatctattactgtagcgccaactgttacagacgcctgagaaactattgggggcaaggaacccaggtgaccgtgagcagc

SEQ ID NO: 1277 - DNA, 744 bp, synthetic construct
  source 1..744: mol_type = other DNA; note = Description of Artificial Sequence: Synthetic polynucleotide
caggtgcaactgcaagagtcaggcgggggcagtgtgcaggcgggtggcagtctgcgcctgtcctgcgtagcttctggctacgtgtcttgcgactacttcctcccgtcctggtataggcaagcgccggggaaggaacgggagtttgtcagtatcattgatggtactggtagcacatcttatgctgcctctgtcaagggaagatttactgccagcgaggataagggcaagaacattgcctacctgcaaatgaactctctgaagccagaggataccgccatgtattactgcaaggccagctgcgttaggggacgtgctgtctctgaatattggggccagggcacccaggtcaccgtgagtagcggtgggggctctcaggttcaactgcaagagtctggaggtgggctcgtccagccgggcgggtctctgaggttgtcttgcaccgcgtcagggctgaccttcgacgattctgtgatgggctggtttcgccaggcccctggcaaagggcgtgaggctgtgtcctgcatcagctcaagcggagcaaatgccttctatgccgacagtgtcaaaggccgcttcacaatcagcagagacaacgctaagaacaccctgtacctccagatgaactcactcaagcctgaagatacggcaacctattactgcaaaaggggccacgcctgcgccgggtattaccctatcccctatgatgactactggggccagggtactcaagtaaccgtgtcctcc

SEQ ID NO: 1278 - DNA, 762 bp, synthetic construct
  source 1..762: mol_type = other DNA; note = Description of Artificial Sequence: Synthetic polynucleotide
caggtccagcttcaggagtccggcggtggctccgtgcaggctggcgggtccctgcgcctgtcctgcgtggccagcggctacgtgtcctgcgactatttcctgccctcttggtatcgccaagcgccgggcaaagaaagagagttcgtatcaatcattgatgggaccggctcaaccagctacgcagcttccgtaaaggggagattcacagcctccgaagataaaggcaagaacatcgcttacctccagatgaactctctgaagcctgaggatactgcaatgtactattgtaaggcctcatgcgtgcgtggccgcgcagtgtctgaatattggggccagggcacccaggttaccgtctcaagcggaggctcaggaggctcaggaggctcaggacaggtgcagcttcaggagtccggcggaggcctggtgcagcccggcggtagcctccgtcttagttgtactgccagcgggctcacctttgatgactcagtgatggggtggtttcgccaggctccgggcaaaggccgggaggccgtgtcctgcatctctagctccggtgccaatgcgttctacgcagatagcgtgaagggcagattcactatcagtagagataatgccaagaatacactgtacttgcagatgaactccctcaagcctgaagacacggccacctactattgtaaacggggccacgcctgcgctggctattacccgatcccgtatgatgactactggggacagggcacccaagtcaccgtctcctct

SEQ ID NO: 1279 - DNA, 771 bp, synthetic construct
  source 1..771: mol_type = other DNA; note = Description of Artificial Sequence: Synthetic polynucleotide
caggttcagttgcaggaatctggtgggggcctcgttcagcctggggagagcctccgtctgtcctgcaccgcttcaggattcactttctcaaactacgcaatgtcttgggtccggcaggctccgggcaaaggcttggaatgggtgtcaggcatcaatgttgcatacggcattacctcctacgcagatagcgtgaagggccgtttcaccatcagtcgtgacaacaccaaaaacactctctacttgcagctcaattcactcaagacagaggacaccgctatttattactgtgtcaaacactccggcactaccatcccacgcggcttcattagctataccaaacgcggccagggcacccaggtcaccgtctcctctggtggcggttcccaggtgcagttgcaggaatccggcgggggaagcgtgcaggccggtggcagcctgcgcctgagctgcacagcttccggggctatcgcttctggctacattgattcccggtggtgtatggcctggttccgccaggcccctggcaaagagcgtgagggcgtggctgcgatctggcctggagggggcctgaccgtctacgccgatagcgttaaaggcaggtttaccatcagccgcgaccatgccaagaacaccctgtacctccagatgaataacctgaagcctgaggacacggccatgtattactgcgccgcaggctcacctagaatgtgccctagtttggagttcggctttgactattggggtcagggtacgcaggtgactgtgtcctcc

SEQ ID NO: 1280 - DNA, 789 bp, synthetic construct
  source 1..789: mol_type = other DNA; note = Description of Artificial Sequence: Synthetic polynucleotide
caagtgcagttgcaggagtccggtggcggactcgtccagcctggagaatccctgaggttgagctgcaccgcgtccgggttcacgttcagcaattacgccatgtcttgggtgaggcaagccccaggtaaaggccttgagtgggtcagcggaatcaacgtggcttacgggatcaccagttacgcagatagcgtcaaggggcggttcactattagcagagataacactaagaacactctgtaccttcagctgaactcactcaagaccgaagacaccgccatttattactgcgtaaagcacagcggtactacgatccctcgcggctttatcagctatactaagcgcggtcaaggaacccaagtgaccgtgtcaagcggagggagcggtggatctgggggatcaggccaggtgcagcttcaggagagtggcggtggctctgtgcaggccgggggctcactgagactgtcttgcactgccagcggggctatcgcgtctggctacatcgacagtcgctggtgcatggcctggttcagacaggcccctggtaaggagcgtgaaggcgtggctgccatttggcctggaggcggactgaccgtctatgcggatagcgtcaaggggaggtttaccattagccgcgaccacgccaagaatactctgtaccttcagatgaataacctgaaacccgaggataccgcgatgtattactgtgcagctggcagtcctcggatgtgtccgagcttggagttcgggttcgattattggggtcagggaactcaggtgactgtgtcctcc

SEQ ID NO: 1281 - DNA, 753 bp, synthetic construct
  source 1..753: mol_type = other DNA; note = Description of Artificial Sequence: Synthetic polynucleotide
caggtacagctccaggaatccggcggaggccttgtccagcccggagagtccttgcgcctctcttgcaccgcaagcggcttcaccttctccaactatgctatgtcttgggtgcgtcaggcccccggcaaaggcctggaatgggtcagcgggatcaatgtggcatacgggatcacttcctacgccgatagtgtcaagggtcgttttaccattagccgtgataacacgaaaaacactctgtacctccagctcaacagcctgaagacggaagatacggctatctattactgtgtcaaacacagtggcacgactattccgcgcggcttcatctcatatactaagcgcggacaggggacccaagtgactgtcagcagtggcggaggctcccaggtgcagctccaggaatccggtggcggttccgtccaagcgggcgggtctctgcgtctttcctgtaccgctccggggtttaccagcaactcttgtggaatggactggtacaggcaggcaccagggaaggagcgcgagttcgtttccagcatcagcaccgacggaaccactggctatgccgacagcgtgaagggtcgcttcacgatctctaaggataaggccaaagatactgtgtacctgcaaatgaactctcttaaaccggaagatacaggtatgtactcatgcaaaacaaaagacggcaccatcgccacgatggagctttgcgatttcggatactggggccagggcacacaagtgacggttagtagc

SEQ ID NO: 1282 - DNA, 771 bp, synthetic construct
  source 1..771: mol_type = other DNA; note = Description of Artificial Sequence: Synthetic polynucleotide
caggtccagctccaggagagcggcgggggcctggtccagccaggtgagtctctgcgtctgtcttgcaccgcttctggtttcacattttccaattatgccatgtcctgggtccgccaggctccagggaagggccttgagtgggtctctggcatcaacgtggcctatggcatcacctcttatgccgacagcgtgaagggtcgtttcaccatctcccgcgacaacacgaagaacacactgtacctccagttgaacagcttgaagaccgaggacaccgcgatctactattgcgtgaagcatagcgggaccacgatccctcgcggattcatcagctatacgaagcgcggccagggtacacaggtcaccgttagctccggcggtagtggcgggtccggtggcagcggacaggtgcagctccaggagtccggtgggggttccgtacaagccggaggctcactgcgcctgtcctgcacagctccgggtttcacttctaacagttgcggcatggactggtatcgccaagccccaggcaaagaaagagagttcgtttctagcatctccaccgatggcaccacaggttacgccgactctgtcaagggccgctttactatcagcaaggataaggccaaggacaccgtgtatcttcagatgaactccctgaagcccgaggatactgggatgtactcatgcaagaccaaggatggaactatcgccacgatggagctgtgtgacttcggttattgggggcagggcacccaggtgaccgtcagcagc

SEQ ID NO: 1283 - DNA, 768 bp, synthetic construct
  source 1..768: mol_type = other DNA; note = Description of Artificial Sequence: Synthetic polynucleotide
caggtgcagctccaggagagtggcgggggcctggttcagccaggtgaaagcctgcgcttgagctgcaccgcatccggcttcaccttctctaattatgccatgagttgggtgagacaagcccccggcaaaggactggagtgggtgtctggaattaacgtagcgtatggcatcacgtcctacgctgatagcgtcaaggggcgcttcaccatctcccgcgacaacacgaaaaacaccctgtacctccagctgaactccctcaagactgaagataccgcgatttattactgtgtgaaacactctggaacaaccatccctcgcggcttcattagttacaccaagcgcggccagggcacccaggtgaccgtcagttccgggggcggaagccaggtgcagttgcaggagtccggcggaggttccgtgcaggctggcgggtccctgagactgtcctgcgcagccagcggctacccttatagcaatggctacatgggatggtttcgccaggctcctggcaaggagcgcgaaggtgtggccactatttacacgggtgatggacgcacctattacgccgacagcgtcaagggccgctttaccattagccgggataacgccaagaatactgtcgatctccagatgtcttcactgaaacctgaagacaccgccatgtactattgcgccgcacgcgccgcgccgttgtactcttccggcagccccctgacccgtgctcgctacaacgtctgggggcaaggcacacaggtgacagtctcctct

SEQ ID NO: 1284 - DNA, 786 bp, synthetic construct
  source 1..786: mol_type = other DNA; note = Description of Artificial Sequence: Synthetic polynucleotide
caggtccagttgcaggagagcggagggggcctggtgcagcctggggaatccctccgtctctcctgcaccgccagcggcttcaccttcagcaactacgccatgagctgggtgcgccaggctccagggaagggcctggagtgggtgtcaggcattaacgtcgcctacggcatcaccagttatgccgatagtgtcaagggccgcttcactatctccagggacaacacaaagaacactctctatcttcagcttaattccctgaaaactgaagacaccgctatctattactgtgtgaaacacagcggaacaaccatcccgcgcggtttcatctcctacactaagagaggccagggcacccaggttaccgtttctagcggcggatctgggggcagcgggggctccggtcaggtccaactccaagagtctggcggaggctctgtccaggctggcgggtctttgcgtctgtcctgtgccgcttctggctacccgtacagcaacggttacatgggttggttcagacaggcccccggcaaagagagggagggagtggccaccatctacaccggcgacggcaggacatattacgctgattccgtgaagggtcgtttcactatctcccgcgataacgccaagaacaccgtcgatcttcagatgtcatccctgaagcctgaagacactgcgatgtattactgtgcagctcgcgccgcgcccctctacagctcaggtagcccactgacacgtgcccggtacaacgtctgggggcagggcacccaggtgacggtgtcttcc

SEQ ID NO: 1285 - DNA, 741 bp, synthetic construct
  source 1..741: mol_type = other DNA; note = Description of Artificial Sequence: Synthetic polynucleotide
caggtgcagctccaggaaagcggtggcgggctggttcagcctggcgagtccctccgtctgtcctgcacagctagtggttttacgtttagcaactacgcgatgagctgggtccgtcaagcccctggtaaggggctggagtgggtgtccggcatcaacgtggcctacggcatcacctcctacgctgactctgtgaagggccggttcactatcagccgggataacactaagaacaccttgtatctccaactgaactccctgaagacagaggacaccgctatttactattgtgtgaagcactctggcacgaccatccccaggggcttcatcagctacaccaagcgtgggcagggtacacaggtgacagtctccagcggcggaggctcccaagtgcagctgcaagaatctggcgggggaagcgtccaggccggtggaagtctgcgccttagttgcgtggcttctgcaagcacctattgcacctatgacatgcactggtataggcaggcccccggcaaggggcgcgagttcgttagcgccatcgacagtgatgggaccacgcgctacgcggacagtgtgaagggcaggttcaccatcagccagggtactgccaaaaatacagtgtacttgcagatgaactccctccagcctgaggacaccgccatgtactattgcaagaccgtgtgcgtcgtaggctcccgttggagcgactactggggccagggcacacaggtgaccgtctcctcc

SEQ ID NO: 1286 - DNA, 759 bp, synthetic construct
  source 1..759: mol_type = other DNA; note = Description of Artificial Sequence: Synthetic polynucleotide
caggtccaactgcaagagtctggaggtggattggtccagcccggcgaaagcctgaggttgagctgcaccgcgagcggattcacctttagcaactatgccatgtcttgggttcgccaagcccctgggaagggcctggagtgggtcagtgggatcaatgtggcttatggaatcaccagctatgcggactctgtgaagggaaggttcactatctctcgtgacaatactaaaaacaccctgtacctccagctcaattccctcaagactgaggacaccgctatttactattgtgtgaaacactccggcaccacgatcccccgtgggttcatcagctacaccaaacggggccaaggcacccaggtcaccgtatctagtggcggtagtggtgggagtggcggttccgggcaggtgcagctccaggagtccggcggtggctccgtgcaggcaggcggtagcctgcgcctgtcctgtgtggcgtctgcaagcacctattgtacttatgatatgcactggtatcgtcaggctccaggcaagggcagagagttcgtctccgcaatcgactccgatggcaccacgcgctacgccgattctgtgaagggccgtttcactatcagccagggtacagccaaaaataccgtgtatcttcagatgaacagtctccagccagaggataccgctatgtactattgcaagactgtgtgcgtggttggctccaggtggtccgattactggggccagggaacccaggtgacagtgtccagc

SEQ ID NO: 1287 - DNA, 735 bp, synthetic construct
  source 1..735: mol_type = other DNA; note = Description of Artificial Sequence: Synthetic polynucleotide
caggtgcagctccaggagagcggagggggtttggtccagcctggcgagtctctcagactttcttgtaccgcatctggctttactttcagcaattacgccatgtcctgggtgcggcaagcccccggcaagggcctggaatgggtgagcggcatcaacgtggcctacggcatcacctcatacgcagattccgtcaaggggcgttttaccatcagtcgcgataatacaaagaacacattgtacctccaactgaactccctcaagaccgaggataccgcgatttactattgcgtgaaacacagcggcactaccatcccacgcgggtttatcagctacacgaagagaggccagggtacacaggtcaccgtgtcaagcggcggtggatctcaggtacagctccaggagtctgggggtggaagcgtgcaggcgggcggatctctgacattgtcctgcgccgcaagtgagtatgcttattccacgtgcaacatgggatggtacaggcaggcccctggtaaagagagagaactcgtgagcgcttttatttcagacggcagcacttattacgccgactccgtcaaaggacgcttcaccatcactcgtgacaacgctaagaatacggtctaccttcagatgaactccctcaaacctgaagatactgcaatctactattgtagtgccaactgctatagacgcctccgcaactattgggggcagggaacacaggtgaccgttagcagc

SEQ ID NO: 1288 - DNA, 753 bp, synthetic construct
  source 1..753: mol_type = other DNA; note = Description of Artificial Sequence: Synthetic polynucleotide
caagttcagctgcaagagtctggcggtggcctggtgcagcccggcgaatctttgcgcttgagttgtaccgcctctggttttacattctcaaactatgcaatgagctgggtgagacaggccccaggcaagggcttggaatgggtctctgggatcaacgtcgcttacggcattacctcatacgccgatagcgtcaagggtcgcttcactatctctcgggataatacgaagaatactctctacttgcagctcaactcactgaagaccgaggacactgcgatctattactgcgtcaaacactccggcaccactatccctcgcggcttcatctcttacactaaacgcggccagggtactcaggtgactgtgagttcaggtggctctggaggtagcgggggttccggtcaggtgcagctccaggagagcgggggcggaagcgtacaggctggaggcagcctgaccttgagctgtgcagcttccgagtatgcctactccacctgtaacatgggatggtatagacaggctcccggcaaggaacgtgagctggtcagcgcctttatcagtgatgggtccacttactatgccgattccgtgaaaggccggttcaccatcactcgcgacaacgccaagaatacagtgtacttgcagatgaactccctcaagcccgaggacactgctatctattactgttctgcaaactgctaccgtcgcctgcgcaactactggggccaaggcactcaggttaccgtgagcagc

SEQ ID NO: 1289 - DNA, 756 bp, synthetic construct
  source 1..756: mol_type = other DNA; note = Description of Artificial Sequence: Synthetic polynucleotide
caggtgcagttgcaggagtctggaggtggcctggtccaacctggagaatccctgcggctctcttgtaccgcgagtggtttcaccttcagcaactatgcaatgagctgggtgcgccaggctcccggcaagggattggagtgggtcagcggcatcaacgtggcctatggcatcaccagctacgctgatagtgtgaagggccggtttaccatcagtagggacaacaccaagaacacactgtatcttcagctcaactccctgaagacagaagacaccgctatctactattgtgtgaagcattccggcactaccatcccacgcgggttcatctcatacaccaaaaggggccagggcacccaggtgacagtttctagcggtggcggttcccaagtgcagttgcaggagtccggtggcggtctggttcagcctggtgggtctcttcgtctgagttgtaccgcaagcggtcttaccttcgatgacagcgtcatggggtggttcaggcaggcccccggcaagggtcgcgaggcagtgagctgcatcagctccagtggggctaacgccttttatgcagactccgtaaaaggaagattcactatcagcagggacaacgcaaagaacaccctgtatctccaaatgaacagtctgaaaccggaagacaccgccacttattactgtaaacgcggccacgcctgcgcagggtattacccgattccttatgatgactactggggccaaggcacccaggtgacagtgtctagc

SEQ ID NO: 1290 - DNA, 774 bp, synthetic construct
  source 1..774: mol_type = other DNA; note = Description of Artificial Sequence: Synthetic polynucleotide
caggtgcagctccaggaaagcggaggcgggctggtgcagccgggagagagtctcaggctttcttgtaccgcctctggatttacattcagcaattacgccatgtcctgggttcgccaagcaccagggaagggcctggagtgggtgtccggcatcaacgtggcatacggcatcacatcctacgcggattccgtcaagggtcggtttaccatcagccgcgataatacaaagaacaccttgtatctccagcttaacagcctcaagacagaggacaccgccatctactattgtgtgaagcactccggcaccactatccctcgcggtttcatttcctacaccaaaaggggtcagggcactcaggtaacagtgtcctctgggggctccggtggatcaggtggctccggccaggtacaactccaagagtcaggaggcggtctggtacagcctggtggctccttgcgcctgtcttgcacagcaagcggcctgactttcgatgactctgtgatgggctggtttcgtcaggccccagggaagggcagggaggccgtctcctgcattagtagctccggcgctaacgccttctatgccgatagtgtgaaggggcgctttaccatctctcgtgacaatgccaagaacaccctgtacttgcagatgaacagcctgaagccggaggatactgccacctattactgcaagcgcggccatgcgtgtgctggctactatcccatcccttacgatgactattggggtcagggcacccaggtgaccgtgtccagc

SEQ ID NO: 1291 - DNA, 759 bp, synthetic construct
  source 1..759: mol_type = other DNA; note = Description of Artificial Sequence: Synthetic polynucleotide
caggtccagcttcaggaaagcgggggtggatctgtccaggcgggcggatcacttcgcctcagttgtacggccagtggctatgtatcctgcgactacttcctcccatcatggtatcgccaggctccgggaaaggaaagggagttcgtgtctgtgatcgacggcactggctccacctcctacgctgccagcgtcaagggtcgcttcaccgcctcacaggacaagggcaaaaacatcgcctatcttcagatgaactccctgaaacccgaggacacagccatgtattactgtaaggcctcctgtgtgcgtggccgcgcaatttccgaatattggggccagggcactcaggtgactgtgagttccggcgggggttcccaggtccagttgcaggagtccggtggcggatctgtgcaggccggagggtccctgcgcctgagctgcacagcgagcggtgccatcgcctccggctatattgactccaggtggtgcatggcctggttcaggcaagcgcccggaaaagagcgtgaaggtgtagctgccatctggcctggcggaggcctgaccgtgtatgccgattccgtcaagggccgcttcaccatcagccgcgaccacgcaaaaaacactctgtacctccagatgaataacctgaagccggaggacaccgccatgtattactgtgctgccggttctccccgtatgtgccccagcctggagttcggcttcgactactggggccagggaactcaggtcactgtgtcatct

SEQ ID NO: 1292 - DNA, 777 bp, synthetic construct
  source 1..777: mol_type = other DNA; note = Description of Artificial Sequence: Synthetic polynucleotide
caggtccagctccaagagtctggaggtggctctgtgcaggctggcggttccctccgcctgagctgcacagcgagcgggtacgtgagctgcgattattttctgccgtcttggtatcgtcaagcgcccggaaaggagcgcgagttcgtgtccgtgatcgacggtacgggtagcaccagttacgcggcttctgtaaaaggacggttcaccgcttcccaggataagggcaaaaacatcgcgtatttgcagatgaacagcctgaagcccgaggataccgccatgtattactgtaaggccagttgtgtcagaggccgcgccatctccgagtactggggacagggcactcaggtgaccgtgtccagcggtggaagcggtggctccgggggctccggtcaggtccagttgcaagagtcaggcggtggctccgtccaggcgggcgggagcctgcgcttgtcctgcacagcttctggggccatcgcctccggctatatcgacagccgctggtgcatggcgtggttccgccaagcgccgggcaaggaacgtgaaggcgtcgcagctatttggcctgggggcgggttgaccgtgtacgccgactccgtgaagggccgtttcaccatcagtagagaccacgccaagaacactctctaccttcagatgaataacctgaaaccggaggacactgctatgtattactgcgctgcgggctcccccaggatgtgtccgagcctggagttcggcttcgactattgggggcaggggacccaggtcaccgtgtcctcc

SEQ ID NO: 1293 - DNA, 741 bp, synthetic construct
  source 1..741: mol_type = other DNA; note = Description of Artificial Sequence: Synthetic polynucleotide
caggttcagctccaggaatccggcggaggctctgtccaggctgggggttctttgcgtttgagctgtaccgcgagcgggtacgtgtcttgcgactacttcttgccttcctggtatcgccaggctcctggtaaggaacgcgagttcgtctccgtcattgatggcaccggctctacgagctatgctgcctcagttaagggccgcttcacagccagccaggataagggcaaaaatatcgcttacctccagatgaactctctgaaacctgaagacactgccatgtattactgtaaagcgagctgcgtaagaggacgtgccatcagcgagtactggggccaagggacacaggtgacagttagtagcggtggcgggtcccaggtgcagttgcaagagagcggtggcggaagcgtgcaggcaggcggatctctgcggctgtcctgcaccgcccctggattcaccagtaactcttgtggtatggactggtatcgtcaggctccgggtaaggagagagagtttgtttcaagtatctccactgatggcacaaccgggtatgccgactccgtcaagggtcgtttcaccatctccaaggacaaggccaaggacactgtgtaccttcagatgaactcactgaagcctgaggacaccgggatgtattcttgcaagactaaagatggcaccattgccactatggagctgtgcgacttcggctattggggtcaggggacacaggtcactgtatctagc

SEQ ID NO: 1294 - DNA, 759 bp, synthetic construct
  source 1..759: mol_type = other DNA; note = Description of Artificial Sequence: Synthetic polynucleotide
caggtgcagcttcaggagtccggcggtgggagcgttcaggctggaggctctctcaggctgtcatgcactgcaagcgggtacgttagttgtgactactttcttccaagctggtatcgccaggctcccggaaaagagcgcgagtttgtttccgttattgatggaactgggagtacgtcctatgccgcttcagtcaaggggcgcttcaccgcatcccaggacaagggtaagaatatcgcttaccttcagatgaactccctgaagcccgaagacaccgcgatgtattactgtaaggcttcttgcgtgaggggccgcgctatcagtgaatactggggtcaggggacccaggtgacggtttctagcggaggcagcggcgggagcggcgggtctggacaggtccagcttcaggaaagtggtgggggctccgttcaggctggcggatcactgcgcctgagctgtactgctcccggcttcacgagcaactcctgcggtatggactggtatcgtcaggccccaggtaaggagcgtgagttcgtgtcttccatcagtacagacgggacaaccggctacgcagacagcgtaaagggccgcttcaccatctccaaggataaggcaaaggacaccgtctacctccagatgaacagcttgaagccagaggacacgggtatgtatagctgtaagaccaaagacggtacaatcgctacaatggagctgtgtgacttcgggtattggggccagggaactcaggttaccgtctcatcc

SEQ ID NO: 1295 - DNA, 756 bp, synthetic construct
  source 1..756: mol_type = other DNA; note = Description of Artificial Sequence: Synthetic polynucleotide
caggtgcagctccaggagagcgggggcggttctgtgcaagctgggggaagtctgcggctcagctgtaccgctagtggttacgtgtcttgcgactatttcctgccttcatggtatcgccaggccccaggcaaagagcgcgagttcgtgtccgtcattgacggaaccgggagtacctcctatgcagccagtgttaagggccgttttacagccagccaggacaagggcaaaaatatcgcttacctccagatgaacagcctgaagcccgaggacactgccatgtattactgtaaagcgagctgtgtcaggggtagagcaattagtgaatattggggccaagggacacaggtgacagtatcttcagggggcggatctcaggtgcagctccaggaaagtggaggtgggtccgtgcaggcgggcggttctctcagactgtcttgcgccgcgtctggctatccttacagcaacgggtacatgggatggtttagacaagccccagggaaggagcgcgagggggtggccaccatttacaccggcgatggccggacttactatgcggattccgtgaagggccgctttaccatttcaagagataacgcgaaaaataccgtggacctccagatgtcctctttgaagccagaggataccgcgatgtactattgcgctgcccgcgccgctcctctctacagtagcggctccccacttacccgcgctcgctataacgtgtggggccaggggacacaggtgactgtgtcctcc

SEQ ID NO: 1296 - DNA, 774 bp, synthetic construct
  source 1..774: mol_type = other DNA; note = Description of Artificial Sequence: Synthetic polynucleotide
caggtgcagcttcaggaatctgggggtgggtccgtccaggctggcggatctttgagactgtcttgcactgccagtggttacgtgagctgtgattacttcctgccgtcttggtatcgtcaagcgccaggcaaggaacgtgagttcgtgtccgtgatcgacgggacaggttccacatcttacgccgcatctgttaaggggaggttcacagcttctcaggacaagggtaaaaatatcgcctatctccagatgaactcactgaagcctgaagataccgctatgtattactgcaaggcttcttgtgtgcggggccgcgctatcagcgagtactggggacagggcactcaggtgacggtctccagcggcgggagcgggggctccgggggcagcggccaggtgcagttgcaggagagcgggggaggctctgtgcaagctggaggctctttgcgcctgtcctgcgctgccagcggatatccttactctaatggttatatgggatggttcaggcaggccccaggaaaggagagagaaggggttgccaccatttatactggggatggccgcacctattacgccgattccgtgaaggggcggttcacaatctctcgtgacaacgccaagaacactgtcgatcttcagatgtccagtctgaaaccggaggacactgccatgtattactgtgccgcacgcgcagctcccctctattcaagcggctcccctctcactcgcgcacgctataacgtgtgggggcagggaactcaggtgactgtgtctagc

SEQ ID NO: 1297 - DNA, 729 bp, synthetic construct
  source 1..729: mol_type = other DNA; note = Description of Artificial Sequence: Synthetic polynucleotide
caggtgcagctgcaagagagcggcggtggcagcgtgcaagccggaggttctctgcggctgagttgtaccgcttctggatacgtgtcctgcgactactttttgccttcatggtatcggcaggccccaggcaaagaacgcgagtttgtgtcagtgatcgacggcactggttccacatcctacgcagccagcgtgaagggccgttttactgcgtctcaggataaaggcaagaacatcgcttatttgcaaatgaacagcctgaagcctgaagacacagccatgtattactgcaaggcaagctgcgttcgcggtcgggcgatctccgagtactgggggcagggtacacaggtcaccgtctccagtggaggtggctcccaggtgcagcttcaggaaagcggtgggggaagcgtccaagctgggggctctctccgcctctcatgtgtggcctctgcctccacctactgcacttacgatatgcactggtatcgtcaggcaccagggaagggacgcgagttcgtgtccgccatcgacagcgacgggacaacccggtacgccgactctgtgaaaggccgcttcaccatcagccaggggacagctaaaaacaccgtgtacctgcaaatgaactccctccagccagaggataccgccatgtactattgtaagaccgtatgcgtagtgggcagcagatggtccgactattggggccaggggacgcaggtcaccgtgtccagc

SEQ ID NO: 1298 - DNA, 747 bp, synthetic construct
  source 1..747: mol_type = other DNA; note = Description of Artificial Sequence: Synthetic polynucleotide
caggtccagctccaggaatccggtggcggttccgtgcaggcaggcgggagcctgcgtctgagttgcactgccagcggctacgtttcatgtgattacttcctgcccagttggtacaggcaggctcctggtaaagagcgcgagttcgtgagcgtgattgatgggactggttcaaccagttacgcggccagcgtgaaggggcgcttcaccgcttcccaggacaagggtaagaacatcgcatatcttcagatgaactctctcaagcctgaagacaccgctatgtactattgcaaagccagctgcgtgcgtggccgcgccatcagcgaatactgggggcagggcacccaggtcactgtgtctagcggtggctcaggagggagcggaggctccggccaggtgcagctccaggagtctggcggtggcagcgttcaggctggcgggagcctgcgcctgagctgcgtggcctctgcatccacctattgcacctacgacatgcactggtatcgccaggctcctggtaagggccgtgagttcgtgagcgctattgatagcgacgggactacccgttacgcggattctgtgaagggcagattcaccatcagccagggcaccgccaaaaatactgtttatctccagatgaatagcctgcaaccagaagacaccgccatgtattactgcaagaccgtgtgcgtagtgggaagtaggtggagtgattactggggccagggtacacaagtcacagtttcaagc

SEQ ID NO: 1299 - DNA, 723 bp, synthetic construct
  source 1..723: mol_type = other DNA; note = Description of Artificial Sequence: Synthetic polynucleotide
caggtccagctccaggagagcggcggaggtagcgtccaggcgggcggaagcctcagactgagctgcacagcctctgggtacgtctcctgcgactatttcctgccatcatggtataggcaagcaccaggcaaggagagggagttcgtgagtgtgattgacggaacagggagtacctcctacgccgcatctgttaaggggcggttcactgcaagtcaggataaaggtaagaacattgcctacctgcaaatgaactccctgaagccagaggacaccgcaatgtattactgcaaggcgagctgcgttcgtggtcgcgcaatctccgagtactggggccaagggacccaggtgaccgtgtcttccggtggcggttcccaggtgcagctccaggagtccgggggtggctctgtgcaggccgggggctctctgaccctctcctgtgcggccagcgagtacgcctactctacttgtaacatggggtggtatcgccaggctcccggcaaggagcgtgagcttgttagtgcatttatctccgacggttccacctattacgccgacagcgtgaagggccgctttaccattacccgtgacaatgcgaagaacactgtatatttgcagatgaactccttgaagcccgaagacaccgccatctactattgcagcgctaactgttaccgtcgcctgcgcaactattgggggcaggggacacaggtgacagtctcctcc

SEQ ID NO: 1300 - DNA, 741 bp, synthetic construct
  source 1..741: mol_type = other DNA; note = Description of Artificial Sequence: Synthetic polynucleotide
caggtgcagcttcaggagagcggcggagggtccgtccaagctggcggttccctgagactgagttgcaccgcttcagggtatgtttcctgtgactatttccttccgagctggtatcggcaagcgccaggaaaggagcgtgagtttgtcagcgtgatcgacggcaccggaagcacctcctacgccgcgagtgtgaaaggccgttttactgcatcccaagacaaaggcaagaacatcgcctaccttcaaatgaactctctgaagccggaggacaccgccatgtactattgcaaggcatcttgcgtcaggggcagggccatctcagagtactggggacagggaacccaggtgacagtgtcttccggcggaagtggtggctctggtggctctggtcaggttcagttgcaggagtccggtggaggctcagtgcaggccggtggctccctgacgctgtcttgcgcggccagcgagtatgcttattccacctgcaatatggggtggtatcgccaggcccccggaaaggaacgtgagctggtgagcgccttcatcagcgacgggtctacttattacgctgattccgtcaagggtaggtttaccatcacacgggataatgccaagaacaccgtctacctccagatgaactctctgaagcccgaagacactgccatctactattgctccgcaaattgctaccgcagactgagaaattattggggccagggaactcaggtgactgtgtcatca

SEQ ID NO: 1301 - DNA, 744 bp, synthetic construct
  source 1..744: mol_type = other DNA; note = Description of Artificial Sequence: Synthetic polynucleotide
caggtgcagcttcaggaatccgggggcgggtctgtgcaggctggtggctctctgcgcctctcttgcaccgcaagcggatacgtgtcctgtgactacttcctgccgtcttggtacagacaagcgcccggtaaagagcgcgagttcgtttccgtcattgatggcaccgggagcacttcctacgcagccagcgtaaagggcagattcacggcttctcaagacaagggcaagaatatcgcgtacctccagatgaactctctgaagcccgaggacaccgcgatgtactattgcaaggcgagctgcgtgagaggcagggccatctccgaatactggggccagggcacccaggtgaccgtgtctagcggtggcggtagccaggtacagttgcaggaatcaggcggtggattggttcagccgggtggaagcctgaggcttagctgcaccgcctccgggttgactttcgacgattctgtaatgggctggtttcgccaggcccctggtaaggggagggaggctgtgagctgcatttcttccagtggagccaatgctttctacgccgactccgtcaaggggagattcaccatcagccgcgacaatgcaaaaaacactctgtacctccagatgaactccttgaagcccgaggacactgctacttattactgtaaaagaggacacgcttgtgctggctactatcctatcccttacgatgactattggggtcagggcactcaagtgaccgtctcctcc

SEQ ID NO: 1302 - DNA, 762 bp, synthetic construct
  source 1..762: mol_type = other DNA; note = Description of Artificial Sequence: Synthetic polynucleotide
caggtgcagttgcaggagtctggaggcggaagcgtccaagccgggggttccctgagactctcttgcaccgcctccggctacgtatcctgcgactacttcctgcccagctggtatcgccaggctcccggtaaggagcgcgagtttgtcagcgtgatcgacggcaccggctccacctcttatgccgctagtgttaagggccgctttactgcctcccaggacaagggcaaaaacattgcctacctccagatgaacagcctgaagcccgaggacaccgcaatgtattactgcaaggcgtcctgcgtgaggggtcgtgccatttctgagtactggggccaggggacccaagtcaccgtaagttctgggggctctggcggtagcggagggagtggacaggtgcagctccaggagagcggcggaggcctggtgcagcctggtgggtcactgagactgtcctgcacagcttcaggcctgacctttgacgattctgtcatggggtggttcaggcaagctccggggaaagggcgcgaggccgtaagctgcatcagtagctctggtgccaatgctttctacgcggactccgtgaaggggcgctttacaatctctcgcgataatgctaagaacaccttgtatctccaaatgaactctttgaagcccgaggacaccgccacctactattgtaagagagggcacgcatgtgctgggtattaccctatcccttatgatgactactgggggcaaggaacacaggttactgtgtcttcc

SEQ ID NO: 1303 - DNA, 756 bp, synthetic construct
  source 1..756: mol_type = other DNA; note = Description of Artificial Sequence: Synthetic polynucleotide
caggtgcagctccaggagtctggaggtggcctggtgcagcccggcggaagccttcgcctgagttgtgcggcatccggcttttccttctcatcttacgcgatgaagtgggtccgccaggccccagggaaaggcctggagtgggtgagtaccatttcatccggcggtagctccaccaattatgctgacagcgtgaagggtaggttcaccatcagccgcgataatgccaagaacaccctctacctccagttgaactccctgaagatcgaagacacagctatgtattactgcgccaaggccatcgttcccactggggccacaatggagaggggacaggggacgcaggtgactgttagctccggtgggggcagccaagtacagttgcaggagtctggtggcggttccgtgcaggccgggggctcactgcgtctgtcctgtaccgcttctggtgctatcgcctctggatacattgattctcgctggtgcatggcgtggttcaggcaagcccctggtaaagaaagagagggtgtggctgccatctggccaggaggcgggctcactgtatacgcagattctgtgaagggaagattcactatctcacgggatcacgccaaaaatacgctgtatttgcagatgaacaatttgaagccggaggacaccgcgatgtactattgtgctgcgggctctcctcgtatgtgcccctccctggagttcggattcgattattggggccagggcacgcaagttaccgtaagcagt

SEQ ID NO: 1304 - DNA, 774 bp, synthetic construct
  source 1..774: mol_type = other DNA; note = Description of Artificial Sequence: Synthetic polynucleotide
caggtccagttgcaggagagtggtggcggtctcgtgcaaccgggaggcagcctcaggctgtcctgcgctgccagcgggttttccttcagctcttatgcgatgaaatgggtccgccaggctccaggcaaaggtctggagtgggtgagcaccatcagctcaggaggctccagcacgaactacgctgactccgttaagggacggttcactatctcaagagacaatgcaaaaaatactctgtatctccagctgaactccctgaagatcgaagacactgctatgtattactgtgccaaggccatcgttcctacaggcgcgacaatggagcgtggccagggcacccaggtcacagtgtcttcaggaggcagcggtggaagcgggggctctggccaagtgcaactccaggagtcaggcgggggctccgtgcaggcaggaggcagccttcgcctgtcctgtaccgcatcaggcgctattgcaagcggctacatcgactcccggtggtgcatggcctggttccgccaagcgccgggcaaagagcgcgagggcgtggctgcaatctggcctggtggaggcttgacagtgtatgccgatagtgtgaagggccgcttcacaatcagccgggatcacgcaaagaataccctgtacctccagatgaataacctgaagcctgaagacaccgccatgtactattgcgcagctggcagtcctcgcatgtgtcccagcctggagtttggattcgattactggggtcaaggtacacaggtgactgtctcatcc

SEQ ID NO: 1305 - DNA, 738 bp, synthetic construct
  source 1..738: mol_type = other DNA; note = Description of Artificial Sequence: Synthetic polynucleotide
caagtgcagctccaggagtcaggcgggggccttgtgcagcctggtggctctctgaggctgtcttgtgcggcttcaggcttctccttctcctcatacgcaatgaagtgggtacgtcaggcccccggcaaaggccttgagtgggtctccactatctcttccggtggctcttccaccaactacgctgattcagtcaaaggccggttcacgatctctcgcgataacgccaagaacacgctgtacctccagctgaactccctgaagatcgaagacactgccatgtactattgcgccaaggccattgttcccaccggagccactatggaacgcggccagggcacccaggtcaccgtgtcctctggaggcggttcacaggtccaacttcaggagagcggaggcgggtccgtgcaggcgggaggctccctgcgtctgtcctgtaccgctcccggtttcaccagtaactcctgcggcatggattggtacagacaggcccctggtaaggaaagggaatttgtcagctctatcagcaccgacggaacaaccggctatgccgatagcgtgaagggacgctttactatctcaaaggacaaggctaaggacacagtgtacctccagatgaactccctcaagcccgaggacaccggcatgtattcctgcaagacaaaagacggcaccattgcaactatggagctgtgtgattttggttattggggccagggaacacaggtcaccgtctccagc

SEQ ID NO: 1306 - DNA, 756 bp, synthetic construct
  source 1..756: mol_type = other DNA; note = Description of Artificial Sequence: Synthetic polynucleotide
caggttcagcttcaggagtctggcggaggcctggttcagcccggaggcagtctgcgcctttcttgcgccgcgagcggcttctcattctccagctacgccatgaagtgggtgcgccaggctcccggaaagggactggagtgggtgtccacaatctcttcaggaggctccagcacaaattacgccgacagcgtgaagggccgcttcacgatctcacgggataacgcgaagaacactctgtatcttcagctcaactccctgaagatcgaggacacagctatgtattactgtgctaaggctatcgttcctaccggcgctactatggaaagagggcagggcacccaagtgactgtgtctagcggaggtagcggagggtccggtggaagtggtcaggtacagctccaggaatctggtggaggcagtgttcaggctggaggttctttgagactgtcctgcacagctcctggatttaccagcaacagctgtgggatggactggtatcgccaggcaccgggcaaggaaagagagtttgtctctagcatctctaccgacggtacaaccggctatgccgactctgtgaagggtaggttcactatctccaaggacaaagcaaaggatactgtgtacctccagatgaactccttgaagcccgaggacaccggcatgtactcatgtaagaccaaggatgggaccatcgctactatggagctgtgtgacttcggatactggggccagggtactcaggtcaccgtgtcttct

SEQ ID NO: 1307 - DNA, 753 bp, synthetic construct
  source 1..753: mol_type = other DNA; note = Description of Artificial Sequence: Synthetic polynucleotide
caagtccagttgcaggagtccggcgggggcctggtccagccaggaggcagcttgcgtctgtcatgtgctgcctctggtttctcattttccagctacgccatgaagtgggtgagacaggctccaggaaagggcctggagtgggtgtctacaatctcctctggagggtcttccactaactatgccgactccgtcaaaggacgcttcacaatttcacgcgacaacgcgaaaaataccttgtacctccagttgaactcactcaagatcgaagacacggccatgtattactgcgccaaagccatcgtgcccacaggtgctactatggagcgcggccagggcacccaggttaccgtcagctctggcggaggctcccaagtgcagctgcaagagagcggcgggggcagcgtccaggccggtggctccctgaggctctcctgtgctgcctccggttacccatactccaatgggtatatgggctggttccgccaagccccaggcaaggagagggaaggagtggcaaccatctacaccggcgatggccgcacatattacgcagacagcgtcaagggcaggtttaccattagtcgcgacaacgccaagaacactgtggacctccagatgtcttccctgaagcccgaggacacagctatgtattactgtgcggccagggctgcaccgctgtactccagcggttcaccgctgacacgcgcccggtacaacgtctggggccagggcacacaggttacggtctcttct

SEQ ID NO: 1308 - DNA, 771 bp, synthetic construct
  source 1..771: mol_type = other DNA; note = Description of Artificial Sequence: Synthetic polynucleotide
caggtccagctccaggaatccggtgggggcctggtgcagcccggtggctccctgcgcctgtcctgcgctgcatccggcttcagcttcagctcctatgctatgaagtgggtccggcaagcgcctggcaagggactggagtgggtgagtacaatcagctccgggggctcctctaccaactatgccgatagcgtgaagggtaggttcaccattagccgcgacaacgccaagaacactctgtaccttcagctgaactccctgaaaatcgaagacacagcgatgtattactgcgcgaaggccatcgtgcctactggtgctactatggaaagagggcaaggcacacaggtgaccgttagctccggtggctccggcggaagcggtgggtcaggtcaggttcagctccaagaaagcggcggtggcagcgtgcaggctggaggctcccttagactctcctgcgccgcatctggatacccttatagcaacggctacatgggatggtttcgccaagcccctggtaaggagcgcgagggcgtcgctactatttatactggggatggccgcacttactatgccgattctgtgaaggggcgctttactatctcacgcgacaacgcaaagaacaccgtggacctccagatgtcatctctcaagccggaagataccgctatgtattactgtgctgcccgcgcagctcccctgtactcttccggctccccactcacccgtgcccgctataacgtgtggggacagggcactcaggtgaccgtctcatct

SEQ ID NO: 1309 - DNA, 726 bp, synthetic construct
  source 1..726: mol_type = other DNA; note = Description of Artificial Sequence: Synthetic polynucleotide
caggtgcagttgcaggagagcgggggtgggctggtccagcccggcggatctctgcgcctcagctgcgccgcaagcggcttctccttctccagctacgctatgaaatgggtccgccaggcccccggtaaggggttggagtgggtgtctaccatttccagtggcggttccagcaccaactacgctgacagcgtgaagggcagattcacgatctctcgcgacaatgctaaaaataccctgtacctgcaactcaacagcctgaagatcgaggataccgccatgtattactgtgccaaggccatcgttcctactggggccactatggagaggggacaaggaactcaggtcaccgtctcttccggtgggggcagccaagtccagctccaagaatctggcggaggctctgtgcaggctggcggatcactcagactgtcctgtgtggcgtccgcttccacctattgcacctacgacatgcactggtatcgccaggcccctggcaaaggcagggaatttgtgtctgctatcgacagcgacggtacaacccgctatgccgattcagtgaagggtcggttcaccatctcacaaggcaccgccaagaacaccgtgtacttgcagatgaactctctgcaacccgaggacactgcaatgtattactgcaagactgtgtgcgtggtcggaagcagatggtctgattattggggccaaggcacacaggttactgtgagcagt

SEQ ID NO: 1310 - DNA, 744 bp, synthetic construct
  source 1..744: mol_type = other DNA; note = Description of Artificial Sequence: Synthetic polynucleotide
caggtgcagctccaggagtccgggggaggcctggtgcagcctggtgggtctctgcggctgtcctgtgccgcttcaggatttagcttctcttcctatgctatgaagtgggtgcgccaggctcctggtaagggactggaatgggtgtctacaattagttccggcgggtcctctaccaactatgccgactccgtgaagggtagattcacgatcagcagagacaacgccaagaataccctctacttgcagctcaactccctgaaaattgaagacaccgcgatgtattactgtgccaaggccatcgtgcccacgggcgctacaatggagcgcggccagggcacacaggtgaccgtttcttccggtggcagcggaggctccgggggctccggccaggtgcagctccaggagtcaggaggcgggtccgtgcaggccggtggcagtctgcgtttgtcctgtgtggccagcgcatccacctattgtacctacgatatgcactggtatcgtcaggccccaggcaagggcagggagttcgttagcgctattgactccgacggcaccactcgctacgctgacagtgtcaaaggccgcttcactatctctcaggggactgccaagaacaccgtgtatctccagatgaactccctgcaaccagaggacacagccatgtactattgcaagacagtgtgcgttgtgggctctcgctggtccgactattggggccagggcacccaggtgacagtgtcttcc

SEQ ID NO: 1311 - DNA, 720 bp, synthetic construct
  source 1..720: mol_type = other DNA; note = Description of Artificial Sequence: Synthetic polynucleotide
caagtgcagctccaggagtctggtggaggcctggtccagcccggtgggagcttgagattgtcttgcgcagcctctggattctctttctccagctacgccatgaaatgggtgcggcaggcaccagggaagggcctggaatgggtgtctaccatttcttccggcggttcttccactaattacgcagactccgtgaagggccggttcaccatttcccgtgacaacgctaagaataccctgtacttgcagctgaactccctgaagatcgaggacacggctatgtattactgtgctaaagccattgtccctacaggggccacaatggaacgcggccagggtactcaagtgacggtcagctctggcgggggcagccaagtgcagctccaggagagcggaggtgggtccgtgcaggctggtggctccctgaccctgagctgtgccgcatctgaatatgcgtatagcacttgtaatatgggatggtatcgccaggctcctggtaaggagcgcgagctggtgagcgctttcatttccgacggtagcacatattacgcggactccgtcaaaggtcgcttcaccattacacgcgataacgccaagaataccgtgtatttgcagatgaactcactcaagccagaagacactgccatctactattgttcagccaactgttatcgcagactccgcaactattggggccaggggacgcaggtaaccgtgtcctcc

SEQ ID NO: 1312 - DNA, 738 bp, synthetic construct
  source 1..738: mol_type = other DNA; note = Description of Artificial Sequence: Synthetic polynucleotide
caggtgcagctccaggaatctggcggtggcctggtgcagccgggcgggtccctgagactgagttgcgctgccagcgggttttccttcagttcctatgccatgaagtgggtccgccaagctccggggaagggcctggaatgggtctccactattagttccggtggctctagcacaaactatgcggattccgtgaagggacgcttcaccatctctcgggacaacgccaagaataccctgtacctccagctgaatagtctcaagatcgaagacaccgcgatgtactattgcgccaaagccatcgttcctactggtgctacaatggagcgtggccagggcacccaggtgaccgtctcctctggcggatctgggggttccgggggctccggccaggtccagttgcaggaaagcggcgggggctccgttcaggccgggggcagtctgaccctgtcctgtgcagcctctgagtacgcctattccacctgtaacatgggctggtacagacaagcgcccggaaaagagcgcgaattggtctccgccttcatctccgatggtagcacttattacgcggactctgtaaaaggccgtttcactattacccgcgacaacgccaagaacaccgtctatctccagatgaacagcctgaagccagaagatacggccatttactattgctccgctaactgctacagacgcttgaggaattattggggccagggcacacaagtgactgtttcctcc

SEQ ID NO: 1313 - DNA, 741 bp, synthetic construct
  source 1..741: mol_type = other DNA; note = Description of Artificial Sequence: Synthetic polynucleotide
caggtgcagctgcaagagagcggtggcggtctggtacagccaggtggcagcctgcgcctgtcctgcgctgcatcaggcttctccttcagttcctatgccatgaagtgggtgcgccaggctccaggcaaaggattggagtgggtgtctaccatttcttccgggggctcatccacaaactacgccgacagcgtgaagggccgcttcaccatctcccgcgacaacgccaagaacactctgtatcttcagctgaactccctgaagattgaggataccgctatgtattactgcgctaaggccatcgttcccacaggcgctacgatggaacgcggtcaggggacacaagtaaccgtaagcagtggtggcggtagccaggtgcagctccaggagtccggcggtggcctggtgcagccgggtgggtccctgaggctgagttgcacagccagcggtctgaccttcgatgactccgtgatggggtggttccgccaggcacctggcaagggccgcgaggctgtgtcctgcattagctctagcggtgccaatgccttctacgctgactcagtcaagggccgcttcaccatctcccgcgataacgccaagaacaccctgtacttgcagatgaactccctgaaacccgaggatacagcaacatactattgcaagcgggggcacgcctgtgcaggatactatcctatcccctatgacgattattggggtcagggcacccaggtcaccgtcagcagc

SEQ ID NO: 1314 - DNA, 759 bp, synthetic construct
  source 1..759: mol_type = other DNA; note = Description of Artificial Sequence: Synthetic polynucleotide
caggtgcagctccaggagtccggcggaggtctggttcagcccggaggctcccttcgcctctcctgtgctgcgtcaggattctcctttagctcctacgctatgaagtgggtgcgccaagcccccggcaagggcctggagtgggtatccaccatttccagtggcggttcttcaaccaactatgctgattccgtgaaaggccgcttcaccatctcccgtgacaacgcaaaaaataccttgtatttgcagctgaacagcctgaagatcgaggacaccgcgatgtactattgcgccaaggccatcgtgcctactggcgcaacaatggagcgtggacagggcactcaggtcactgtgagtagcggagggagtggcggttccggcggttcaggacaggtgcagctccaggagagcgggggtgggctggtacagccaggtggctctctcaggctgagttgcacggcctcaggcctgaccttcgatgacagcgtcatgggctggttccgccaggccccaggtaaaggccgtgaggctgtgtcctgtattagctcatctggggccaatgcgttctatgctgacagtgtcaaaggccgcttcacaatttcccgtgacaacgccaagaacaccctgtatttgcagatgaacagtctgaagccggaagacaccgccacctactattgtaagcgcggtcacgcttgtgcaggttattaccctattccttatgatgactactggggccagggaacgcaggtgacagtgtcctct

SEQ ID NO: 1315 - DNA, 768 bp, synthetic construct
  source 1..768: mol_type = other DNA; note = Description of Artificial Sequence: Synthetic polynucleotide
caggtccagttgcaggagtctggaggtggcctggtgcagccgggaggttctctgcggctgtcctgcgccgcatctggattcaccttcagttcttatccaatgtcttgggtcaggcaagcgccgggcaagggcctggaatggattagcactatttccgcaggtggcgataccactctgtatgccgattcagtgaaaggccgcttcaccagctctcgggataacgctaagaacaccctgtatctccagctgaatagccttaaaaccgaagacaccgcaatctattactgtgctaaaaggattgattgtaattctggctattgttacagacgcaactactggggacagggcacccaagtgaccgtttccagtgggggcgggagccaggtacaactccaggagtccggtggaggtagcgtgcaggccgggggctctctccgtctgtcctgcaccgcatccggggctatcgcctctgggtacattgacagccgctggtgcatggcctggttccgtcaggcccccggcaaggaacgcgagggcgtggctgccatctggccgggcggagggctgactgtgtatgcggactccgtcaagggcaggtttaccatcagccgcgaccatgctaagaacaccctgtacctccagatgaataacttgaaacctgaagacaccgccatgtactattgcgcggctggttccccacgcatgtgcccctcacttgagtttgggttcgattactggggccagggcacccaggtgactgtgtccagc

SEQ ID NO: 1316 - DNA, 786 bp, synthetic construct
  source 1..786: mol_type = other DNA; note = Description of Artificial Sequence: Synthetic polynucleotide
caggtccagcttcaggagtccggcggtggccttgtccagccaggaggcagcctgcggctgtcctgcgccgcgagcggcttcacgttctcatcctacccaatgtcctgggtccgtcaggccccagggaaggggctggagtggatcagtaccatctccgccggtggcgataccactttgtacgccgactctgtgaaagggcgctttacctcttcccgcgataacgcgaaaaacacattgtacctccagctcaactccctgaagactgaggacactgccatctactattgcgccaagagaattgattgcaacagcgggtattgctaccggcgcaactactggggccagggaacccaggtgacggtatcctctgggggctctggaggttcaggaggcagcggacaagtgcagctccaggaatcaggaggcggttctgtgcaggcgggtggctctctgcgtctgagctgcactgcgtctggagccatcgcttctggttacatcgacagcagatggtgcatggcatggttccgtcaggctccgggaaaggagagggagggagtggccgctatctggcccggagggggcttgacagtctacgctgattccgtgaagggaaggttcacgatctcacgtgaccacgctaagaataccctgtaccttcagatgaataacctgaagcccgaggacaccgcaatgtactattgtgctgccggaagccccaggatgtgtcccagcctggaatttggctttgactactggggtcagggcactcaggtcacagtctcctct

SEQ ID NO: 1317 - DNA, 750 bp, synthetic construct
  source 1..750: mol_type = other DNA; note = Description of Artificial Sequence: Synthetic polynucleotide
caggtgcagttgcaggagtccggcgggggcctggtgcagccaggagggtctctgaggctgagttgcgccgctagtggcttcaccttctccagctatcccatgtcttgggtgcgccaggctcccggtaaaggacttgagtggattagcacgatctccgctggaggtgacacgactctctacgccgatagcgtgaagggacgcttcaccagttctcgtgacaacgccaagaataccctgtacctccaactgaacagcctgaagacggaggacaccgccatctattactgtgcaaagcgtattgattgtaactcaggatactgctatcggcgcaactattggggacagggcacgcaggtgacagttagctccggtggcggaagtcaggtccaacttcaggaaagcggaggtggcagcgttcaggctggcggttccttgcgcctgtcttgtaccgcaccgggctttacaagcaacagctgcggtatggactggtatagacaagctccaggcaaagaaagggagttcgtgtccagcattagcactgacggcaccacaggctatgctgattccgtgaagggacgcttcactatctccaaagataaggcgaaggacactgtatacctccagatgaactccctgaagcctgaggataccggcatgtatagttgcaagaccaaggatggcaccatcgcaacgatggaactctgtgacttcggctattgggggcagggcacccaggtgaccgtgtcctct

SEQ ID NO: 1318 - DNA, 768 bp, synthetic construct
  source 1..768: mol_type = other DNA; note = Description of Artificial Sequence: Synthetic polynucleotide
caggtgcagctgcaagaatccgggggcgggctcgtgcagcctgggggttccctccgtctgagctgcgcggcttccggcttcactttctcttcctatcccatgtcctgggtgaggcaggcccctggcaagggcttggaatggattagcaccatcagcgccgggggcgacacaaccctgtacgctgacagcgtgaagggaagattcacgtccagccgggataacgccaagaacaccctgtacctccagttgaactccctgaagactgaagataccgccatctattactgtgccaagcgcattgattgcaacagcggctactgctatcgccggaactactgggggcagggtacacaggtaacggtgtcctcagggggctccggcgggagtgggggcagcgggcaagttcagttgcaggagagcggcgggggctccgtccaagcaggcggaagccttcgcctcagctgcaccgcaccgggtttcacatctaatagctgcggaatggattggtatcggcaggcccccggtaaggagcgcgagttcgtgagttccatcagtaccgacggcacaaccggctatgctgactccgtgaagggtcgcttcaccatttctaaggataaggccaaagacaccgtgtaccttcagatgaactcactgaagccagaagacacaggaatgtactcttgtaaaacgaaggatggaaccatcgctacgatggagctgtgcgactttggctactggggccagggcacccaggtgacagtaagctct

SEQ ID NO: 1319 - DNA, 765 bp, synthetic construct
  source 1..765: mol_type = other DNA; note = Description of Artificial Sequence: Synthetic polynucleotide
caggtccaactccaggaaagcggcggtggcctggtgcagccaggtgggtctctccgtctgagctgtgctgcatccggcttcacttttagctcttacccgatgagctgggtgcgccaggctccgggaaagggccttgagtggatcagcaccatctcagccgggggcgatacaaccctgtatgcagacagtgttaaaggccgttttacctcctctcgcgacaatgctaaaaacaccctttatcttcagctcaatagtctgaagactgaggacaccgccatttattactgcgctaaacgcattgattgcaactccgggtactgctacagacgtaactattggggccagggaacacaggtgaccgtgtccagtggcggaggtagtcaggtccagttgcaagagagcgggggaggcagcgtccaggcgggtggctccctgcgcctgagctgcgcagcctctggttacccatacagcaacggctacatgggctggttcaggcaagcaccgggtaaggagcgggaaggcgtggcaaccatctatacaggtgatggtcgcacctattacgcagattccgtcaagggccggttcactatcagccgcgacaacgcaaagaatacagtcgatctccagatgagcagtttgaaacctgaagacacggcgatgtattactgcgccgctcgtgctgcgccactctactcctctggctcccctctcacacgtgctcgttataatgtatggggccagggcactcaagtgacagtctccagt

SEQ ID NO: 1320 - DNA, 783 bp, synthetic construct
  source 1..783: mol_type = other DNA; note = Description of Artificial Sequence: Synthetic polynucleotide
caggtgcagttgcaggagtccggcggtggactggtccaaccaggcggtagtctcaggctgtcctgtgccgcttctggtttcactttcagctcctacccaatgtcctgggtacggcaagctcctgggaagggtctggagtggatctccacgatctccgcaggcggggacactaccctctacgccgactctgtgaagggccgtttcacttctagcagagataatgcaaaaaacactctctatcttcagctgaacagtctgaaaaccgaagatactgcgatctattactgcgccaagcgcatcgactgcaattctggttactgttaccgtcgcaattactggggccaaggaacccaggtcacggtgtcctcaggtggcagcggaggttccggcgggtccggtcaggtccagttgcaggaaagcggcggaggttctgtccaagccggaggcagcctgaggctgtcttgcgctgccagtggatacccctatagcaacggctacatgggctggttccgccaagcgccagggaaggaacgtgaaggtgtggccaccatctacaccggcgatggcaggacctactatgctgactccgtgaagggtaggttcaccatctctcgcgataacgccaagaacactgtggacctccagatgtcttccttgaaacctgaggacaccgcgatgtattactgcgcggcccgcgccgcgcccctctacagttcaggcagccccctgaccagagcaaggtataacgtgtggggtcagggcactcaggtgaccgttagcagt

SEQ ID NO: 1321 - DNA, 738 bp, synthetic construct
  source 1..738: mol_type = other DNA; note = Description of Artificial Sequence: Synthetic polynucleotide
caagttcagctccaggaatctggcggtggcctggtccagccaggtggctccctgcgcctgagttgtgcggctagtggcttcaccttcagctcctacccgatgagttgggtgcgtcaggctccagggaagggtctggagtggatctctaccatcagcgccggtggcgatactaccctgtatgcggattccgtgaagggtcgctttaccagctctcgggacaacgccaagaacacgctctacttgcagctgaacagtctgaagaccgaggataccgctatctactattgtgccaagcgcatcgactgtaacagcgggtactgctaccgccgtaactattggggccagggaacacaagttaccgtgtcaagcggaggcggttcccaggtgcagctccaggaatctggcggaggcagcgtacaggcgggaggctcactgcgcctgtcttgtgtcgcatcagccagcacctactgcacctatgacatgcactggtatcggcaggctcccggcaaaggccgcgagttcgtcagcgccattgattccgatggcaccacgaggtacgccgattctgtaaagggccgctttactatctcccagggtactgccaagaacaccgtgtacctccagatgaacagtcttcagccagaggatacggctatgtattactgcaagactgtttgtgtcgttggctccaggtggagcgactactggggtcagggaacccaggtcactgtgagtagc

SEQ ID NO: 1322 - DNA, 756 bp, synthetic construct
  source 1..756: mol_type = other DNA; note = Description of Artificial Sequence: Synthetic polynucleotide
caggtccaacttcaggaatccggcgggggtctggtgcaacctggcggtagcctccggcttagttgcgccgcaagtggattcaccttttccagctatcccatgtcctgggtgcgtcaagcgccgggtaagggtctcgaatggatttcaacaatctctgccggtggcgacaccactctctacgcggattccgtgaaagggcgcttcacctcctctcgtgacaatgccaagaacactctgtatctccagcttaactccttgaagacagaggatactgccatctattactgcgccaagcgcatcgactgtaactctggctattgttaccgccgtaactactggggacagggcactcaagtcaccgtctcctctggaggcagcggaggttccgggggctctggccaggttcagctccaggagagcggcggagggagcgtgcaggcaggtggaagcctgcgtctgtcctgtgtggcctccgcttcaacctactgcacctatgatatgcactggtatcgtcaggcccccggcaaaggtagagagttcgtgtccgccattgattccgatggtactaccagatatgccgacagcgtaaagggacgtttcacgatctctcaaggcaccgccaagaacaccgtttacctccagatgaatagcctccagccggaagatactgcaatgtattactgcaagactgtttgcgtggttggcagccgctggagcgactactggggccaggggacccaggtgaccgtctcctct

SEQ ID NO: 1323 - DNA, 732 bp, synthetic construct
  source 1..732: mol_type = other DNA; note = Description of Artificial Sequence: Synthetic polynucleotide
caggtccagttgcaggaatccggcggaggcctggtgcagccagggggctctctgaggctgagctgtgccgcgagcggcttcacattctccagctaccccatgtcttgggtgcgtcaggcccctggcaagggtctggagtggatctccaccatctctgctggcggtgacaccactctgtatgccgacagtgttaaagggcgtttcacgtcttcccgtgacaatgccaagaacactctctacctccagttgaactcactgaaaaccgaggataccgccatttattactgcgccaagcgtatcgactgcaactctggctactgttatcgccggaactactggggccaggggacccaggtgactgtcagttctggcgggggctctcaggttcagctccaggagtcaggaggcggttcagtgcaagctggaggctccctgacactcagctgtgccgcgagtgagtacgcatactccacctgtaacatgggttggtatcgccaggctccaggtaaagagcgcgagctggtctccgccttcatctccgacggctccacgtattacgccgattctgtgaaaggccgtttcacaatcacacgcgacaatgcaaagaacacagtgtatcttcagatgaactcactcaagcctgaagacaccgcgatctattactgctccgcaaactgttacagacgcctccgcaactactgggggcaaggcactcaagtgactgtttccagt

SEQ ID NO: 1324 - DNA, 750 bp, synthetic construct
  source 1..750: mol_type = other DNA; note = Description of Artificial Sequence: Synthetic polynucleotide
caggtacagttgcaggagtcaggaggtggcctggtgcagcctggtggcagcttgcgcctgtcttgcgcagcctctggcttcacattcagctcataccctatgtcttgggtcaggcaggctccaggtaaggggctggaatggatttctaccattagtgcaggcggtgacacaaccctgtacgccgactcagtcaagggccggtttacgtccagccgcgacaatgcaaagaacactctctacttgcagctcaacagtctgaagaccgaggatactgccatctactattgtgctaagagaattgattgcaacagcggctattgctaccgcagaaattactgggggcagggcacccaggtgactgtttcttccgggggcagcgggggtagcggtgggtccggtcaggtccagcttcaggagtccggcggaggcagcgtgcaggccggaggcagcctcaccctgtcttgtgccgcttctgaatacgcttattctacttgtaacatgggctggtatcggcaggctcccggtaaggagcgcgagctggtcagcgccttcatctctgacggatctacttattacgccgattccgtcaagggtcgcttcaccatcaccagagacaatgccaaaaacaccgtctatctccagatgaactctctcaagccggaggacaccgcgatttactattgctctgcgaactgttaccgtcgcctccgtaactattggggtcagggcacccaggtcacggtgtccagc

SEQ ID NO: 1325 - DNA, 753 bp, synthetic construct
  source 1..753: mol_type = other DNA; note = Description of Artificial Sequence: Synthetic polynucleotide
caggtacaactccaggagtccggcgggggactggtgcagccgggtggctcccttcgtctgagctgtgctgccagcggtttcaccttcagctcctacccaatgtcttgggtccgtcaagcgcctggtaagggtcttgagtggattagtactatcagcgctggtggcgataccacgctctacgctgattccgtcaaaggccgctttacttcttccagggataacgcaaaaaacactctttacctccagctgaactccctgaagaccgaagataccgcaatctattactgtgctaaacggattgattgcaactccggctactgttatcgccgtaattactggggccagggtacacaggtgaccgtgtcctcaggcgggggctcccaagttcagcttcaggagagtggcggtggcctggtccagccgggcggttcccttcgcctgtcctgcaccgcgtccggccttaccttcgacgatagcgtgatgggttggttccgccaggctcccggcaagggcagggaagccgtgagctgcatttcatcctcaggagccaacgctttctacgctgattctgtgaagggacgttttactatcagccgcgataacgccaagaacactctgtacctccagatgaactccctgaagcctgaggatacggctacatattactgcaagcgcggtcacgcctgcgctggatattacccgatcccatacgatgactactggggccagggaacacaggtaacagtctcctct

SEQ ID NO: 1326 - DNA, 771 bp, synthetic construct
  source 1..771: mol_type = other DNA; note = Description of Artificial Sequence: Synthetic polynucleotide
caggttcaactgcaagagtccggcgggggacttgtccagccgggaggcagtctgagattgtcctgcgcagcgtccgggttcactttcagctcttatccaatgtcatgggtccgtcaggcccctggcaaagggctggagtggatcagcaccatttctgctggaggtgacactaccctgtacgccgacagcgttaagggccgcttcacatcatccagggacaacgccaagaacacactgtaccttcagctgaactccctgaaaacagaggacaccgctatctattactgtgcgaagcgcattgactgtaacagcggctattgttatcgcaggaactattggggacagggaacccaggtgactgtaagctccggtggctctgggggctccggcggttctggtcaggtgcaactccaggagagcgggggtggcctggtgcagcctggcgggagtctgaggctttcctgcaccgccagcggccttaccttcgatgactccgtgatggggtggttccgccaagcgccaggaaaaggccgcgaagccgtctcctgtatctcctcaagcggcgcgaacgccttctatgccgactcagtgaagggccgtttcacaatctcccgcgataacgccaagaacaccctgtatctccagatgaacagcctgaagccggaagacacggcaacctactattgtaagagaggccacgcttgcgctgggtattaccctatcccttacgacgattactggggacagggtactcaggtgaccgttagctct

SEQ ID NO: 1327 - DNA, 768 bp, synthetic construct
  source 1..768: mol_type = other DNA; note = Description of Artificial Sequence: Synthetic polynucleotide
caagttcagcttcaggagtcaggtggcggatcagtgcaagtcggaggctccctgcgcctgtcttgcgctgcctccggctttacattctcttcctaccccatgtcctgggtaaggcaggctcccggcaaaggcctggagtggattagcacaatctctgccggtggcgacaccactctgtacgctgattccgtgaaaggtcgtttcacgtctagcagagacaacgctaagaacaccctctaccttcagctcaacagcctgaagacggaggacaccgctatttattactgtgcgaagcgcatcgactgtaactctggatactgctatcggcgcaactattggggtcagggtactcaggttacagtgtcatccgggggcggatcacaagtgcaactgcaagaatccggcgggggtagcgtgcaggccggtggctcattgcgtctgtcctgcaccgcctctggcgctatcgcttctggctatatcgacagtcggtggtgcatggcctggttccgccaggcccctgggaaggagcgcgagggtgtggccgcgatctggcccggtgggggcctcacagtgtatgcagactccgtaaaaggccgcttcacaattagccgcgaccacgctaagaacaccctttacttgcagatgaacaatctgaagccagaagacactgcaatgtactattgtgctgcgggttcccctcgtatgtgcccaagtcttgagttcggttttgattactgggggcagggcacccaggtcaccgtgtccagt

SEQ ID NO: 1328 - DNA, 786 bp, synthetic construct
  source 1..786: mol_type = other DNA; note = Description of Artificial Sequence: Synthetic polynucleotide
caggtacaactccaggaatctggcggaggctccgttcaggtgggtgggtctctgagactgagctgcgctgccagcggatttactttcagctcctaccccatgagttgggtgaggcaggctcccggtaagggcctggaatggattagcactattagcgctggcggggacaccactctgtacgctgacagtgtcaaggggcgctttactagctcccgcgacaacgccaagaacactctgtatctccagctcaacagcctcaaaactgaggacacagctatctattactgtgctaagcgcattgactgtaactcaggctattgttaccgccggaactactggggacaagggacccaagtgacagtttcctctggcggtagcggcggatctgggggctctggccaggtccagcttcaggagtccgggggaggctccgtccaggccggtggctctttgaggctgtcatgcacagcttccggtgccatcgcaagtggatatattgacagtcgctggtgcatggcttggttccggcaagcccccggaaaggagagagagggcgttgctgcaatctggccgggtgggggcttgaccgtctatgctgattctgtgaagggccgttttaccatcagtagagaccacgctaaaaacaccctgtacttgcagatgaataacttgaaacccgaagacaccgccatgtattactgcgccgctggctctccccgtatgtgccccagcttggagttcggctttgattattggggtcagggaactcaggtcactgtgtccagc

SEQ ID NO: 1329 - DNA, 750 bp, synthetic construct
  source 1..750: mol_type = other DNA; note = Description of Artificial Sequence: Synthetic polynucleotide
caggtgcagctccaggagtctggcggtggaagcgtgcaagtaggaggctctctgaggctgtcatgcgcagcgagcggcttcaccttcagctcttatccaatgtcttgggttcgccaggcccccggtaagggtctggagtggatctcaactatcagcgcaggcggggatacaaccctttacgccgatagtgtgaagggacgctttacctctagcagagataacgctaagaacactctgtacttgcagcttaactcccttaaaaccgaggacaccgcgatctattactgtgccaagcgcattgactgcaactctggttactgctatagaaggaactactggggccagggtacgcaggtgacggttagttccggtggaggctcacaagtgcagcttcaggagtccgggggtggctctgtgcaggctggcgggtccctgcggctttcctgcacagcccccggcttcacgtctaactcctgtggcatggactggtatcgccaggcccctggtaaagagcgtgagttcgtgagcagtatttctaccgatggaacgaccggctatgctgactccgtgaagggtcgcttcaccatctccaaggacaaagccaaagacaccgtttatttgcagatgaactccctcaagccagaggacactggcatgtatagttgcaagaccaaggacggcactattgcgacgatggagctgtgtgacttcggctactggggccagggaacccaggtgacggtgtcttct

SEQ ID NO: 1330 - DNA, 768 bp, synthetic construct
  source 1..768: mol_type = other DNA; note = Description of Artificial Sequence: Synthetic polynucleotide
caggtgcagctccaagagtctggtgggggaagcgttcaagtcgggggcagcctgagactgtcctgtgcagcttctggcttcaccttttctagctaccctatgtcctgggtgcgccaggcccccggcaaaggcctggaatggatctccaccatcagtgcgggaggtgacacaactctgtacgcggattctgtgaagggccgcttcacatctagccgtgataacgccaagaatactttgtatctccagctcaactctctgaagactgaagatacagcaatttattactgcgcaaaacggattgattgtaatagcgggtactgttaccgcaggaactactggggtcaaggcactcaggttacggtgtcttccggcggatctggaggtagcggtggcagcggtcaggtgcagctccaggagtcagggggcggttccgtgcaggctggcgggtccctgcgcctctcttgtactgcccctgggtttacatccaactcctgtggtatggactggtataggcaagctccgggaaaggagcgcgagttcgtgtcttccatcagcaccgatggcaccactggttacgccgattccgtgaagggacgctttacaattagcaaggacaaggccaaggatactgtgtacttgcagatgaacagcctgaagcctgaggacactgggatgtactcttgcaagaccaaggacgggaccatcgccacgatggaactctgcgacttcggatactggggccagggcacgcaagtgaccgtaagctct

SEQ ID NO: 1331 - DNA, 765 bp, synthetic construct
  source 1..765: mol_type = other DNA; note = Description of Artificial Sequence: Synthetic polynucleotide
caggtacagctccaggagagcggcggtggctccgtccaagtagggggcagcctccgcctttcttgtgcagcctctggttttacattttccagctacccaatgagctgggtccggcaagcgcctgggaaaggtctggagtggatttccaccatctccgccgggggcgacactaccctgtacgcagatagcgtaaagggtcgctttaccagttctcgtgataacgccaagaacactctgtaccttcagctgaatagcctcaagaccgaggataccgccatctactattgcgctaagcgcatcgactgcaactctggctattgttacagacgtaactactggggtcaaggtacgcaggtaactgtatcctctggaggcggttctcaggtacagcttcaggagagcggcggtggcagcgtgcaggccggagggtccctgcgtctctcctgcgctgcctccggctacccctactccaatggctatatgggttggttcagacaggctcctggcaaagaacgggagggggtggccacaatttacactggtgatggccgcacgtactatgccgactccgtgaaggggcgctttaccatttctcgcgataacgctaaaaacaccgtggacctccagatgtccagcctgaagcctgaagatactgcaatgtattactgtgccgcacgtgctgccccactgtactcaagtgggagcccactgactcgcgctagatataacgtgtggggtcagggcactcaggtgaccgtctcctcc

SEQ ID NO: 1332 - DNA, 783 bp, synthetic construct
  source 1..783: mol_type = other DNA; note = Description of Artificial Sequence: Synthetic polynucleotide
caagtacaactccaggaatctgggggcgggagtgttcaggtcggtggcagcctgcgtctcagttgcgccgcgtctggcttcacattttcttcctatccgatgtcttgggtgaggcaagcccctgggaagggtctcgaatggatctccacaatctctgctggcggtgataccacgctctacgccgactctgtcaaaggccgcttcacttcttcacgtgataacgccaaaaacaccctgtaccttcagctcaactccctgaagaccgaagacacagcaatctattactgtgcgaagcggattgattgcaactccggctattgttatcggaggaactactggggccagggcacccaagtgaccgtctcctctggcggttccggtggctccggcggttctggacaagtccaactccaggagagcggcggaggctccgttcaggcaggcgggtccttgaggctgagttgtgctgcatcaggctacccctactcaaacggctatatgggctggttcagacaggctccgggcaaggagcgcgagggagtggccactatctataccggcgacggtcgcacttattacgcagatagcgtaaagggtcgcttcaccatcagccgcgataacgccaagaacacggttgaccttcaaatgtctagtctcaaacctgaagacactgccatgtactattgcgccgcaagagctgcccctctgtattccagcgggagccccctgacccgtgcccgctacaacgtgtggggtcagggcacccaggtgactgtcagctct

SEQ ID NO: 1333 - DNA, 738 bp, synthetic construct
  source 1..738: mol_type = other DNA; note = Description of Artificial Sequence: Synthetic polynucleotide
caggtgcaactccaggagagtggcgggggctccgtacaggtcgggggctctctgagactctcctgtgcggccagcggatttaccttcagcagttacccgatgtcttgggtgcgtcaggccccaggcaagggcctggagtggatttccacaatcagcgctggcggtgacactacactctacgcagattccgtgaaagggcgtttcacctctagccgcgacaacgctaagaacaccctgtacttgcagttgaactccctgaagaccgaggacacggccatctactattgcgcgaagcgcatcgactgtaacagcggatactgttacaggcgcaactattggggacaggggacccaagtaaccgtgagttcaggtgggggctcccaggtgcagttgcaggagtcaggtggaggcagcgtccaggccgggggctctcttcgcctgtcctgtgtggccagcgcctctacttactgtacgtatgatatgcactggtatagacaggcccccggtaagggaagagagttcgtcagcgctattgatagcgatggcaccacacgctatgcggattccgtaaagggtaggtttacaatcagccagggaaccgcaaaaaacactgtttacttgcagatgaacagcctccagccagaggataccgccatgtactattgtaagactgtgtgtgtcgtgggttcccgttggtccgattactggggccagggcactcaagtaacagttagtagt

SEQ ID NO: 1334 - DNA, 756 bp, synthetic construct
  source 1..756: mol_type = other DNA; note = Description of Artificial Sequence: Synthetic polynucleotide
caagttcaactgcaagagtccggtggcggaagcgtccaggtgggaggctcccttcgcctgagctgtgctgccagcggtttcacattcagttcctatccgatgtcctgggtgcgtcaggccccaggcaagggtctggagtggatctctaccatctccgctggcggtgacacgactctgtacgctgatagcgttaaggggcgctttacctcctctcgcgataacgctaagaacactctctacctccagttgaatagcctcaagactgaagataccgctatctactattgcgctaagcggattgattgcaactctgggtactgctaccgccggaactactggggacagggaacccaggtgactgtgtcctctggtggctctggaggctccggcggttccgggcaggtccaactccaggaatccggcggtggcagcgtgcaggccggtggctccttgcgtctgtcctgcgtggcgagcgcttccacctactgcacctacgacatgcactggtatcgccaggctccgggtaagggccgtgaatttgtgtctgccattgattctgacggcaccacgcggtacgcagactctgttaaggggcgctttaccatcagtcagggcacggctaagaacaccgtgtacctgcaaatgaactctctccaaccggaggacactgccatgtattactgtaaaacggtttgtgttgtcggctcccgctggtccgattactggggccagggaacccaggtgacagtctcaagc

SEQ ID NO: 1335 - DNA, 732 bp, synthetic construct
  source 1..732: mol_type = other DNA; note = Description of Artificial Sequence: Synthetic polynucleotide
caggttcaactccaggagagtggcggtggctcagtgcaagtagggggcagtctgcgcctgagctgtgctgcatccggcttcaccttctctagttatcccatgagctgggtacgtcaggctccaggcaaaggtctggagtggatcagcaccattagcgctggcggagacacgactctctatgccgacagcgtgaagggccgcttcacctccagtcgggacaacgccaagaacacgctgtaccttcagttgaactcactcaagactgaggataccgcaatctattactgcgctaaacgcatcgactgtaactccgggtactgttaccgtcgcaactactggggtcaggggactcaggtcaccgtgtcttccgggggtggcagtcaggtgcagcttcaggaatccggcggaggctctgtccaggctggcggttccctgactctgtcttgcgcagcctcagagtatgcctacagcacttgtaacatgggttggtatcgccaggctcccggcaaagaacgtgagcttgttagcgcgttcatcagcgatggcagcacctattacgctgacagcgtgaagggtcgctttacaatcaccagggacaacgcgaagaacaccgtgtatctccagatgaactccctcaagcccgaggacaccgccatctattactgctccgctaattgctaccgtcggctgcgcaactactggggccaggggacccaggtaacagtctcctct

SEQ ID NO: 1336 - DNA, 750 bp, synthetic construct
  source 1..750: mol_type = other DNA; note = Description of Artificial Sequence: Synthetic polynucleotide
caggtccagctccaggagtccggtgggggaagcgtccaagtagggggatctctgaggctgtcctgtgcggcctccggcttcaccttctccagctaccccatgtcctgggtgagacaagcccctgggaaaggactggaatggattagtaccatttcagccgggggtgacacaaccctgtacgcagactccgtgaaaggacgttttaccagttcccgtgataacgccaagaacaccttgtacctccagttgaactccctgaagacagaagacacagccatctattactgtgccaagcgcattgattgcaacagcggatactgttaccgcagaaactattggggccagggcacccaggtgacagtatcaagcggcggttccggcggtagcggcggtagcgggcaagtgcagttgcaggagagcggcggtggctccgttcaggcaggaggctccctgactctctcctgtgctgcctctgagtatgcgtactccacttgcaatatgggctggtacaggcaggctcccggcaaggaacgcgaactggtgagtgcattcatctctgatggctccacatattacgccgacagcgtcaagggccggtttaccatcactcgggataatgccaagaacaccgtctacttgcagatgaacagcctgaagccagaggacacagccatctattactgctctgctaactgctaccgcagactgcgcaattactggggccagggaacccaggtgactgtgtctagc

SEQ ID NO: 1337 - DNA, 753 bp, synthetic construct
  source 1..753: mol_type = other DNA; note = Description of Artificial Sequence: Synthetic polynucleotide
caggtgcaactccaggaatccggcggaggcagcgtgcaagttgggggcagtcttcgtctgtcatgtgcagccagcgggttcaccttctcaagctacccgatgagctgggtgcggcaggctcccggaaagggcctggagtggatttccactatctccgctggcggtgacaccacactgtacgctgactccgtgaaggggcggttcacgtcatcccgtgataacgctaagaacacactgtatctccagctgaacagcctcaagaccgaggacactgcaatctactattgcgctaagagaattgattgcaactccgggtactgttacaggcgtaattactgggggcagggcacacaagtgaccgtgtccagtggcggtggcagccaggtgcagttgcaggagagtgggggtggccttgtgcagcccggtgggagtctgcgcctgtcctgcacagcctccgggctgaccttcgacgattctgtaatgggctggttccgccaggctccggggaagggccgcgaggccgtcagctgtatctccagctctggagccaacgcattttacgcggacagcgtaaagggtagattcacaatttcacgtgacaacgccaagaacaccctgtacctccagatgaacagcctgaagcccgaggataccgccacctactattgtaagcgcggccacgcttgcgcgggttactatccgatcccatacgatgactattggggccagggcacgcaggttacggtgtcttcc

SEQ ID NO: 1338 - DNA, 771 bp, synthetic construct
  source 1..771: mol_type = other DNA; note = Description of Artificial Sequence: Synthetic polynucleotide
caggtccaactgcaagagtctggcgggggttccgttcaggtcggtggctccttgcggctgagctgtgctgcctccggctttacttttagttcttatccgatgagctgggtgaggcaggctcctggcaagggcctggagtggatctccacaatcagcgctggcggggacaccacattgtacgccgactccgtcaagggcaggttcacctcctcacgcgataatgctaagaacactctgtatctccagcttaactctctcaagaccgaggacaccgccatttattactgcgcgaagagaattgattgtaactccggctactgctaccgccgtaattactggggtcagggaacccaggttacggtcagctccggtggcagtggcggtagcggaggctccggccaggtgcagttgcaggagtctggcggtggcctggtccagcctggaggcagcctccggctgagctgtactgcttcaggcctgacatttgacgatagcgtgatggggtggttccgccaagcgccgggaaagggtcgcgaggccgtctcttgtatcagttcctctggagccaacgctttctatgctgatagcgtgaagggccgcttcacaattagccgggacaatgcaaagaacaccttgtacctgcaaatgaactctctgaagcccgaagatacggctacctactattgcaagcgcggccatgcctgcgcaggatattacccaatcccctacgacgattattggggtcagggcacccaggtgaccgtgagcagc

SEQ ID NO: 1339 - DNA, 783 bp, synthetic construct
  source 1..783: mol_type = other DNA; note = Description of Artificial Sequence: Synthetic polynucleotide
caggtccaactccaggagagcgggggtggcagtgtgcagtctggcggttcccttaggctgagttgcgcagccagcggcttcacatacagcaccagcaattcatggatggcgtggttccgtcaggcccccggtaaggagcgggagggcgtcgccgctatctacacagtgggtgggtccatcttttacgctgattccgtgcgtggccgtttcaccatctcccaagatgcgacaaagaatatgttctacctgcaaatgaacacactcaagcccgaagataccgctatgtattactgcgcggcagcttctggccgcctccgtggaaagtggttctggccatacgaatataactattggggccagggaactcaggtgacagttagtagcggcggtggctctcaggtgcaactccaggagtccggcgggggaagcgtgcaggcgggagggagcctgcggctgtcatgtaccgccagcggagccatcgccagcggatacattgattcccgctggtgtatggcttggtttcgccaggcccccggcaaggaaagggagggagtcgccgctatttggcccggtggcggtctgacagtgtacgccgacagcgtaaagggtcgcttcactatcagccgtgaccacgctaagaacaccctgtacctccagatgaataacttgaagccagaggacaccgccatgtactattgcgccgctggctccccgagaatgtgcccttctctcgaatttggttttgactactgggggcaggggacccaggtcacggtttcttcc

SEQ ID NO: 1340 - DNA, 801 bp, synthetic construct
  source 1..801: mol_type = other DNA; note = Description of Artificial Sequence: Synthetic polynucleotide
caggtgcaactccaggagagtggcgggggttccgtccagagcggtggcagtctgaggctgtcctgcgccgcttccggtttcacatactccaccagtaacagctggatggcctggtttcgccaagcccctgggaaagagagagaaggagtcgccgcaatctacactgtaggaggctccattttctacgcagactctgtcagaggccgtttcaccattagccaggatgccactaagaatatgttttacctccagatgaatacactgaagccagaagacaccgctatgtattactgtgctgcggcttccggcaggctgcgcggcaagtggttctggccttacgagtataactattggggccaaggcacccaggtcaccgtgtcaagcgggggttccggtggcagcggagggagcggccaggtgcagctgcaagagtctggtggcggttccgtccaggctgggggctctctccggctgtcttgtacggccagcggtgccatcgctagtggctacatcgacagccggtggtgcatggcctggttccgtcaggctcctggaaaggaacgggaaggcgtcgccgctatttggccaggtggcggactgacggtctatgctgactctgtcaagggacgcttcaccatcagtcgcgatcacgctaagaacaccctctacctccagatgaataacctgaagcccgaggatacggccatgtattactgcgccgctggttccccaagaatgtgtcccagcctggagttcgggttcgactattggggacagggcacccaggtaaccgtgtcatca

SEQ ID NO: 1341 - DNA, 765 bp, synthetic construct
  source 1..765: mol_type = other DNA; note = Description of Artificial Sequence: Synthetic polynucleotide
caggtccagctccaggagagcggaggcggtagtgtccagtccggtggctccctgcgtctgagttgcgcagccagtggcttcacttattccacaagcaactcttggatggcatggtttcgccaggcccctgggaaggaacgcgagggtgtcgctgccatctacacagtgggcggttccattttctacgcagactccgttagaggtaggtttactatcagccaggatgctaccaagaatatgttctaccttcagatgaacacactcaagcccgaagacaccgccatgtattactgtgccgcagcctctggccgcctgcgcggtaagtggttctggccttacgagtacaattactggggtcagggcacccaggtgacagtgtccagtggtggaggctcccaggttcagcttcaggagtctggagggggctccgtgcaggcaggaggctctctgagactcagctgcaccgccccaggttttacctccaacagctgcggcatggactggtatcgccaggcccccggcaaggaacgcgagttcgtgagttctatctccaccgatggaacaacgggttacgccgattctgtgaagggccggtttacaatctccaaggataaggccaaggacactgtgtacctccagatgaactctttgaaaccagaagacacaggcatgtatagctgtaagaccaaggatgggaccatcgcgactatggaactgtgtgacttcggatactggggccaggggacccaggtcacagtgtcctcc

SEQ ID NO: 1342 - DNA, 783 bp, synthetic construct
  source 1..783: mol_type = other DNA; note = Description of Artificial Sequence: Synthetic polynucleotide
caggtccagctgcaagagagcggaggcggtagtgtgcagagcggcggaagcctgcgcctcagctgcgccgcgtccggctttacctacagcacaagtaactcttggatggcctggttccggcaggctcccggcaaggaaagggaaggcgtggccgcaatctacacggtcggaggttctattttctacgccgatagcgtcagaggccgcttcacaatctctcaggacgcaaccaaaaatatgttctacttgcagatgaacacactcaagcccgaggacaccgcgatgtattactgtgccgctgcatccgggcggctgagaggaaagtggttctggccttatgagtacaattattggggtcagggcactcaggtgactgtgtcctctggtggctccggtggcagtgggggcagcggtcaggtgcagcttcaggagtccggtggagggagcgtccaggctggcggttccctcaggctgtcctgcacagcaccgggcttcactagcaacagctgcggtatggattggtatcgccaggcaccgggtaaggagcgcgaatttgtctcatctatcagcaccgatgggacaaccgggtacgctgatagcgtgaaaggtaggttcaccatctccaaggacaaggcaaaagataccgtgtacctccagatgaactctctcaagcccgaggacaccggaatgtatagctgcaagacaaaggacggcaccattgcaacaatggagctttgtgactttggctattggggccagggcacccaggtaacggtctcttca

SEQ ID NO: 1343 - DNA, 780 bp, synthetic construct
  source 1..780: mol_type = other DNA; note = Description of Artificial Sequence: Synthetic polynucleotide
caggtccagcttcaagaatccggcgggggctccgtacaatcaggagggtcactcaggctgagttgcgcagcctctggattcacgtactccacaagcaattcctggatggcctggtttagacaggcacccggcaaggagcgtgagggggtggctgccatctacactgtgggtggctccatcttctatgcggacagtgttcgcgggcgttttacaatctcccaggacgccaccaagaatatgttctacttgcagatgaacacactgaaaccggaggacaccgccatgtattactgtgcagccgcgtcaggccgcctgcgggggaagtggttctggccatacgagtacaactactggggtcagggcacccaagtgaccgtgagttccgggggaggttcccaggttcagcttcaggagtccggtggcgggtctgtgcaggccggtggctcccttcggctctcctgcgccgcgagtggctatccttattccaacggctacatgggctggttccgtcaggcacccggcaaggaacgggaaggcgtcgctaccatctatacaggtgatgggcggacttattacgcagactccgtgaagggccgctttactatcagtcgcgacaacgcaaagaatacagtggacttgcaaatgagttccctcaagcctgaggacactgctatgtactattgtgctgcccgtgcagcgccactgtatagttccggctcaccgctgacccgcgctaggtataacgtatggggtcagggcacacaagtgacggtgtcaagc

SEQ ID NO: 1344 - DNA, 798 bp, synthetic construct
  source 1..798: mol_type = other DNA; note = Description of Artificial Sequence: Synthetic polynucleotide
caggtgcaactccaggagtccggcggaggcagtgtgcaatccgggggttctctgcgcctctcttgcgctgcctctgggtttacatattccacatccaactcctggatggcctggttccgccaggctcccggcaaggagagagagggggtggccgcgatctacaccgttggtggctctatcttctatgccgacagcgttcggggccgctttaccattagccaggatgcaactaagaatatgttctaccttcagatgaacacactgaagccagaggatactgcaatgtattactgcgccgcagcttctggcagactgcgcggaaaatggttctggccttatgagtacaattattgggggcagggcacccaggtcacagtaagctccggtggctccggcggtagcggaggctccggccaagtccaacttcaggaaagcggtggcgggtctgtgcaggccggtggctccctccgcctgtcttgcgcggcttccggctatccatacagtaacggctacatgggttggttccggcaggcccctggcaaggagcgtgagggcgttgctacgatctatacaggtgacggaaggacttactatgctgacagcgtaaaggggcgcttcaccatttctcgtgacaacgcaaagaacacagtggacctccagatgagcagtctgaagcctgaggacaccgcgatgtactattgtgccgctcgggccgctcctctgtattccagcggcagccctctgactagggctagatacaacgtctggggacagggcactcaggtgactgtgagcagc

SEQ ID NO: 1345 - DNA, 753 bp, synthetic construct
  source 1..753: mol_type = other DNA; note = Description of Artificial Sequence: Synthetic polynucleotide
caggtgcaactccaggagtctggagggggctccgtgcagagtggcggaagcctgaggttgtcctgtgccgcgagtggattcacctactccacctccaacagctggatggcctggtttagacaggctccaggtaaggaaagagagggcgtggccgcgatctacaccgtagggggctccatcttctatgcagatagcgtgaggggccgcttcacaatcagtcaggatgccaccaaaaatatgttttacctccagatgaacacattgaagccagaggacaccgccatgtactattgcgccgctgcctctggtaggctgaggggcaaatggttctggccctatgaatataactactgggggcagggcacccaggtaacggtgtcaagcggtgggggctctcaggtgcagctccaggagtccggcgggggcagcgtacaggctggaggtagtctgcgcttgagttgcgtcgcgtcagcctctacctattgcacatacgacatgcactggtatagacaggccccaggcaagggaagggagttcgtgtccgcaatcgactctgatggcacaaccagatacgcagactccgtaaagggtcgcttcaccatcagccagggcacagcgaagaacacagtgtacctccagatgaactccttgcagcctgaggatactgccatgtactattgcaagactgtgtgcgttgtcggatctcgctggtcagactactggggccagggaacacaggtgacagtgtcctcc

SEQ ID NO: 1346 - DNA, 771 bp, synthetic construct
  source 1..771: mol_type = other DNA; note = Description of Artificial Sequence: Synthetic polynucleotide
caggtgcaactccaggagtctggaggtggctctgtccaaagcggtggctcccttcgcctgagctgtgccgctagtggattcacgtactctacgtcaaatagctggatggcgtggttcagacaggcccctggcaaggagagggagggtgtggctgcgatctatactgtgggcggttccatcttctatgccgattccgtgcgcggtcggtttaccatctctcaggacgctaccaagaatatgttttacttgcagatgaacactctgaagccagaggataccgcgatgtactattgcgcagcggcctctggtaggctgagaggcaaatggttctggccttatgaatacaactattggggacagggaactcaggtgacggtctcttccggtggctctgggggcagcggtgggagcggccaagtgcagcttcaggagtctggcggaggcagcgttcaagcaggcggtagcctgagactctcatgtgtagcctccgcttccacttactgcacctacgacatgcactggtatcgtcaggctcctggcaagggccgcgagtttgtgtccgccatcgactccgacggcacaacgcggtacgctgacagcgtgaagggccgctttaccattagccaaggcaccgccaagaatacagtgtacctgcaaatgaatagcctgcaaccggaggataccgcgatgtactattgcaagacggtctgtgttgtgggcagtcggtggagcgactactgggggcaaggtacacaagtcactgtgtcctcc

SEQ ID NO: 1347 - DNA, 747 bp, synthetic construct
  source 1..747: mol_type = other DNA; note = Description of Artificial Sequence: Synthetic polynucleotide
caggtgcagctccaggaatctggaggtggctctgtgcagagtgggggcagccttcgcctgtcctgcgctgccagcggcttcacatacagtacgtcaaactcctggatggcctggttccgtcaagcgcctggaaaggaacgcgagggagtggctgcgatttataccgtcggcgggtctattttttacgccgactccgtcagaggacgtttcacgatctcccaggacgccacgaagaatatgttttatctccagatgaacacacttaaacccgaagacaccgcaatgtattactgcgctgccgcatctggccgcctccggggcaaatggttttggccttacgagtacaattactggggccagggaacacaggttaccgtgagcagtggaggcgggtcccaggttcagttgcaggagtcaggcgggggaagcgtgcaggccggaggttcactgaccctgtcttgtgcagcgtctgaatacgcctacagcacctgtaacatgggatggtatcgccaggctcctggaaaggaaagggagctggtgtctgcctttatctctgacggcagcacttattacgctgactccgtgaagggacgctttaccatcacccgcgacaacgcgaagaacactgtgtatcttcagatgaactccctgaagcccgaagacaccgcgatctactattgctccgctaattgttaccgtcgcctccgcaactattggggccaagggacccaggtgaccgttagttcc

SEQ ID NO: 1348 - DNA, 765 bp, synthetic construct
  source 1..765: mol_type = other DNA; note = Description of Artificial Sequence: Synthetic polynucleotide
caagtccagcttcaggagtccggcggtggcagcgtgcagtctggaggctccctgcgcttgtcctgcgccgcttccggtttcacgtattccacaagtaatagttggatggcttggtttagacaggcccccggcaaagagcgcgagggtgtggctgccatctataccgtcggtgggagcatcttttacgccgattccgtgcgtggccgcttcaccatcagccaggatgccacaaagaatatgttttacttgcagatgaacaccctgaagcccgaagacaccgctatgtactattgcgcggcagcttctggacggctgcgcggtaagtggttttggccatacgagtacaactattggggccagggcactcaggtgaccgtgtcttccgggggctccggcgggagcggtggctctggccaggtgcagctccaggagtccgggggtggctctgtccaggctggaggcagtctgaccctgtcctgtgccgcgtctgagtacgcctactccacttgtaatatgggctggtatcgtcaggcacctggcaaagaacgcgaactggtgtccgcatttatttccgacggtagtacctattacgctgattccgtgaagggacgcttcaccatcacacgggataacgccaagaacactgtgtatcttcagatgaactccttgaagcccgaagacaccgctatctactattgcagcgccaactgctacagacggctgcgtaactactggggccagggcactcaggtgactgtctcctct

SEQ ID NO: 1349 - DNA, 768 bp, synthetic construct
  source 1..768: mol_type = other DNA; note = Description of Artificial Sequence: Synthetic polynucleotide
caggtgcagcttcaggaatccggcgggggcagcgtccagagcggcggttccctccgcctcagctgtgcggcttctggattcacctattctacaagcaattcatggatggcgtggtttcgccaagcgccgggcaaagagcgtgagggcgttgcggctatttacactgtcggaggctccatcttctacgcagactcagtgcgtggccgtttcactatctcccaggacgccactaagaatatgttctatctccagatgaataccctcaaaccagaagacaccgcaatgtattactgcgctgccgcatctggccgtctgagaggtaagtggttttggccttacgagtacaactactggggacaaggcactcaggtcacagtctcctcaggcggtggctcccaggtgcagctccaagagtcaggcgggggtctggtccagcctggcgggtcccttaggcttagctgtaccgcgtccggtctcaccttcgatgacagcgtcatgggatggttccgccaggccccaggcaaggggagggaggcagtgagctgcatctccagctccggcgctaacgccttttatgcggacagtgtcaaaggcaggttcacgatttctagggataacgctaagaacaccctgtacctccagatgaacagcctcaaaccggaggataccgcgacttactattgcaaacgtggtcacgcctgcgctggttattaccccatcccgtatgatgactattggggccaaggcacccaggtgactgtttcttcc

SEQ ID NO: 1350 - DNA, 786 bp, synthetic construct
  source 1..786: mol_type = other DNA; note = Description of Artificial Sequence: Synthetic polynucleotide
caggtccagttgcaggagtcaggcgggggctctgtgcagtctggaggcagtctcagactgtcttgcgcggcttccggcttcacatactccacttccaacagttggatggcctggttcaggcaagcgccgggcaaggagagagagggtgtagcggcaatctatactgtcggcggttcaattttttacgcggactctgttcgtggcagattcaccatttcccaggacgccacaaaaaatatgttctacctccaaatgaacaccctcaagcctgaggacactgctatgtattactgtgcggctgcctcaggccgtctgcggggtaagtggttttggccctacgagtacaactactggggccaggggacgcaggtgacagtcagctcagggggcagcggcgggtccggcgggagtggccaggtgcagctccaggaatctggcggaggtcttgtccagcctggcgggtctttgcgtctgtcctgtaccgcaagtggtctgaccttcgatgactcagttatgggatggttcagacaagcgcctggtaagggccgcgaggcggtgtcatgtatctcttccagcggagccaacgctttttacgccgactccgtgaaaggcaggtttacgattagtcgggataatgccaagaacaccttgtacctccagatgaacagcttgaagcccgaagacactgctacctattactgtaagcgcggtcacgcctgcgcgggctattacccaatcccctacgatgactactggggccagggaacccaggtgacagtttccagc

SEQ ID NO: 1351 - DNA, 786 bp, synthetic construct
  source 1..786: mol_type = other DNA; note = Description of Artificial Sequence: Synthetic polynucleotide
caggtgcagctgcaagaatccggcggtggctccgttcaggccggaggctcattgcgtctctcctgtcgtgcgtctgggtccacctactctaactattgcctggggtggttccggcagattacgggtaaggaacgcgaaggagttgccgtgattaactgggtcggtggaatgctgtactttgctgactccgtcaagggtcgcttcaccgtctcccaggaccaggctaagaacaccctgtacttgcagatgaactccctcaagcctgaggacaccgcaatgtattactgtgccgctgagtcagtcagctccttctcctgcggcgggtggctcactcgccccgacagagtcccctattgggggcagggaacccaggtgactgtctctagcggtgggggctcccaggtgcagttgcaggaatctggtgggggctccgtccaagccggtggctcacttaggctgtcctgtacggcaagcggggccatcgcctctggttatatcgactcacggtggtgtatggcatggttcagacaggctccagggaaggagcgggagggagtcgctgccatctggccgggcgggggcctcaccgtttacgcagatagcgtgaagggtaggtttaccatctctcgcgaccacgccaaaaatactctgtacctccaaatgaataacctgaagcccgaagataccgccatgtactattgcgccgctggctccccgcgcatgtgcccttctctggagttcggcttcgattattggggacaaggaacccaggtgacagtgtcttcc

SEQ ID NO: 1352 - DNA, 804 bp, synthetic construct
  source 1..804: mol_type = other DNA; note = Description of Artificial Sequence: Synthetic polynucleotide
caggtacagcttcaggaaagcgggggaggctcagtgcaggctggcggaagccttcgcctgtcatgtcgggcctctggttccacctacagtaactactgcctgggctggttccgccagatcactggcaaggaacgcgagggcgtcgcggtcatcaactgggtcggcggaatgttgtacttcgcagatagcgtcaagggcaggttcacagtctcccaggatcaggccaagaacaccctgtatctgcaaatgaactccctcaagcctgaagataccgccatgtattactgcgcagccgagtctgtctcttcattctcttgcgggggttggctgacccgtcctgacagggtgccatactggggccagggtacacaagtcaccgtgtcttcaggaggttccggtgggtcaggaggttccgggcaagttcagctccaagagagtggtggcggtagcgtgcaggcaggcggttcacttcgtctgtcttgcacagccagtggggctatcgcctccggctacattgacagcagatggtgtatggcctggttccggcaggccccaggcaaagaaagagaaggggtggcagccatctggccgggtgggggcctgacggtctatgctgacagcgtgaagggccgcttcactatctcaagggatcacgccaagaacaccttgtacttgcagatgaacaatctgaagcccgaagacaccgcaatgtattactgtgccgcaggtagcccccgcatgtgcccatccctggagtttggattcgactactggggccagggaacccaggtgaccgttagctct

SEQ ID NO: 1353 - DNA, 768 bp, synthetic construct
  source 1..768: mol_type = other DNA; note = Description of Artificial Sequence: Synthetic polynucleotide
caggttcagcttcaggagagcggcggtgggtccgtgcaggccggtggctccctgcgcctgagctgccgcgccagcggaagcacttacagcaattattgtcttggctggttccgtcagatcacaggcaaagagcgcgaaggcgtggccgttatcaactgggtcggcggtatgctgtatttcgccgactctgtgaaaggtcgctttacggtctctcaggatcaggccaagaacacgctttacttgcaaatgaactcactgaagcccgaagacaccgccatgtattactgtgccgcagagtctgtcagctccttttcatgcggaggttggttgactcgccccgaccgtgttccttactggggccagggcacgcaagtgaccgtttcctctggaggcggaagtcaggtgcagttgcaggagtccgggggcggtagcgtgcaggccggtggcagtctgcgtctgagttgtactgcccccggcttcacctccaactcctgtggcatggactggtatcgccaggcccccggaaaagaacgtgagttcgtatctagcatctccaccgatgggaccacaggttatgctgattccgtaaagggtaggttcactatcagcaaggataaagccaaagataccgtgtacctccagatgaatagccttaaaccagaggatacgggaatgtatagttgcaagaccaaggatggaactatcgcgacaatggaactctgcgacttcggctactggggccagggaactcaggtgaccgtgtcctcc

SEQ ID NO: 1354 - DNA, 786 bp, synthetic construct
  source 1..786: mol_type = other DNA; note = Description of Artificial Sequence: Synthetic polynucleotide
caggttcagttgcaggaatccgggggcggaagcgtgcaagcagggggtagtttgcgcctgtcatgccgcgccagcggctccacctacagcaattattgtctgggttggttccgccagatcactggcaaggagcgcgaaggggtggccgtgattaactgggtgggcggtatgttgtacttcgctgactccgtaaagggacgcttcactgtcagccaggaccaggctaagaacactctgtatctccagatgaactcactgaagcctgaggataccgccatgtattactgcgctgccgagtccgtctccagcttttcctgcggcggatggctgactcgccctgaccgcgtgccgtactgggggcaaggcactcaggtgacagtgtctagcggagggtctgggggctctggtggaagcgggcaggtgcagcttcaggaatctggcggtgggagcgtacaagcgggcggatctcttcgtctgtcctgtaccgctcctggctttacgtccaattcctgtgggatggattggtacagacaagccccaggtaaggagcgcgagttcgtgtcctctatcagcaccgacggaactaccgggtacgctgactcagtgaagggtcgcttcaccatcagcaaggataaggccaaggataccgtgtacctgcaaatgaacagtctgaagccagaagataccggcatgtactcatgcaagacgaaagatgggactatcgccactatggaactgtgcgattttggctactgggggcagggcactcaggtgactgtctcaagc

SEQ ID NO: 1355 - DNA, 783 bp, synthetic construct
  source 1..783: mol_type = other DNA; note = Description of Artificial Sequence: Synthetic polynucleotide
caggtccagctccaggaatctggtggaggtagcgttcaggccgggggctccctccgcctgtcatgcagggccagcggctctacctattccaattactgcctcgggtggttcagacagatcacaggaaaggagcgcgagggcgtggcagtcatcaactgggtaggcggtatgctgtatttcgcggatagtgtgaagggaagattcaccgtgagtcaggatcaggctaagaacaccctgtatctccagatgaactccttgaagcccgaggacactgccatgtattactgcgcagccgaatctgttagctccttcagctgtggtggctggctgacccgcccagatcgcgtgccatattggggccagggcacacaggttactgtctccagtggcgggggcagccaagtgcagttgcaggagagcggaggcggaagtgtgcaggcaggcggatctctgagactctcttgtgctgcctccggctatccatattctaatggctacatgggatggttccgccaagcaccgggcaaagagagagaaggggttgctaccatctataccggcgatggcagaacctattacgcggactccgtgaagggacgcttcaccatcagccgtgataacgccaagaacactgtggacctccagatgtcttccctgaagcctgaagacaccgctatgtactattgtgctgcacgcgccgcgccactttacagtagcggttctcctcttacccgcgctcgctacaacgtctggggccagggtactcaggtgacagttagtagc

SEQ ID NO: 1356 - DNA, 801 bp, synthetic construct
  source 1..801: mol_type = other DNA; note = Description of Artificial Sequence: Synthetic polynucleotide
caagtgcagttgcaggaaagcggaggcgggagcgtacaggcgggcggttctctgcggctgagctgccgcgcatctggttccacatacagcaattattgtctgggttggtttaggcagatcactggtaaggagagggaaggggtcgcagttataaattgggtgggtgggatgctctacttcgccgattcagtgaagggccgcttcaccgtgagtcaggatcaggcgaagaatactctgtacctccagatgaatagcctgaagcccgaggacaccgccatgtattactgcgccgcagagagtgtcagctcctttagctgcgggggctggctgacccgcccggaccgcgtgccctactggggccaggggacccaggttaccgttagctctggcggtagcgggggctctggaggcagcggacaagtccagctgcaagaatccgggggaggcagcgtacaggctggcgggtctctgcgcctgtcctgcgccgcttcaggatacccgtatagcaacggctatatgggttggttcagacaggcccccggcaaggaacgtgaaggagtggccaccatctacaccggcgacgggcgcacctattacgctgattctgtgaagggccgctttacaatcagccgcgataacgctaagaacaccgttgaccttcaaatgtccagcctgaagccggaggataccgccatgtattactgtgcagcccgcgccgcaccactctacagctccggttctcccctcacaagggctcggtacaatgtttggggccagggcacccaggtcaccgtctctagc

SEQ ID NO: 1357 - DNA, 756 bp, synthetic construct
  source 1..756: mol_type = other DNA; note = Description of Artificial Sequence: Synthetic polynucleotide
caggtgcagctccaggaatcaggtgggggcagcgtacaggcagggggttcactccgcctgtcttgccgggcctctggcagtacatactccaattattgcctgggttggtttcgccaaattaccggcaaggagcgggagggcgtcgctgtaatcaactgggtgggcgggatgctctattttgctgactccgttaagggtcgtttcacggtcagccaggaccaggccaaaaatacactgtatctccagatgaactccctcaaacccgaagacaccgccatgtattactgtgctgccgagagtgtcagctctttttcctgcggcgggtggcttacccgcccggaccgtgtcccatactggggtcaaggcacccaggttaccgtctcatccggcggaggcagccaggtgcaactccaggagagcgggggcggtagcgtgcaggcaggcggaagcctgcgtctctcctgtgtggcttccgcgtccacctactgtacctatgatatgcactggtatcgccaggctcctggaaagggccgcgagttcgtgagtgctattgattccgatggcaccactcgctacgctgactccgtgaagggacgtttcaccatctcccagggtacagctaagaacaccgtgtacctccagatgaactccctccagcccgaggataccgcaatgtattactgcaagaccgtttgtgtagtgggctcacgctggtccgactattggggccaggggacccaggtgactgtatcatct

SEQ ID NO: 1358 - DNA, 774 bp, synthetic construct
  source 1..774: mol_type = other DNA; note = Description of Artificial Sequence: Synthetic polynucleotide
caggtccagcttcaggaaagcggtgggggctccgtgcaggccggaggctccctgcgtctgagctgtcgggcctctggttccacctactccaactactgtctgggctggttccgccagattacaggcaaggaacgcgagggtgtggcggtcataaattgggtgggtggaatgctgtatttcgcggatagcgtgaaagggcgcttcaccgtgtctcaggaccaggctaagaacacactgtacttgcagatgaacagcctgaagcccgaagacactgccatgtactattgtgccgctgagtctgtctcctctttctcctgcggcggatggctgacccgccccgacagggtgccttactggggtcagggcacccaggtgacggtttctagtggtggctcaggtggctccggcggttccggccaggtccagttgcaggagtctggaggtggcagcgtgcaggccggtggcagcctgcgcctgtcatgtgtcgcttctgcgagcacctattgtacctatgatatgcactggtatcgccaggccccaggcaagggtagggagtttgtgtccgcgattgactctgacggcaccacgcgctatgcggattccgtgaaggggcgttttacaatctcccagggcaccgctaagaacactgtttatcttcagatgaacagcttgcagcctgaggacaccgcgatgtattactgtaaaactgtctgtgtagtgggctccaggtggtctgactactggggtcagggcacccaggtgacggtttccagc

SEQ ID NO: 1359 - DNA, 750 bp, synthetic construct
  source 1..750: mol_type = other DNA; note = Description of Artificial Sequence: Synthetic polynucleotide
caggtgcagttgcaggaatctgggggtggctctgtgcaggcgggcgggtccctgcgcttgtcctgccgcgcttctggttctacctactccaactattgtctgggctggtttaggcagatcaccggaaaggagcgcgaaggtgtggctgttataaattgggtgggcgggatgctctattttgcagactccgtcaagggccgcttcaccgtctcacaggatcaagccaagaatacgctgtatcttcagatgaacagcctgaagcccgaggatacagccatgtattactgcgccgcagagtctgtgtcttccttttcttgcggaggctggctcacacgcccggaccgcgtgccctactggggccagggcacccaggtgaccgtatccagcgggggcggttcccaagtgcagctccaggagtctggcggagggtccgtgcaggctggtgggagtctgaccttgagttgcgcagccagcgaatacgcttactccacttgcaacatgggttggtatcgtcaggctcccggtaaagagcgcgagctggtctctgcattcatctcagatggctctacttactatgctgactccgtgaagggtcggtttactatcacccgcgacaacgccaagaacacagtgtacttgcagatgaactccctgaagcccgaggataccgccatttactattgttccgccaactgttacagacgcctgcgcaactattgggggcagggaacacaggttactgtgtcctct

SEQ ID NO: 1360 - DNA, 768 bp, synthetic construct
  source 1..768: mol_type = other DNA; note = Description of Artificial Sequence: Synthetic polynucleotide
caggtgcagttgcaggagagcggaggtggcagcgtccaggccggaggttctctgcgtctgagctgccgtgcatccggtagtacatactctaactactgtctcggctggttcaggcagatcacaggcaaggaaagggagggtgttgccgtaatcaactgggttggcggtatgctctacttcgctgactccgtgaagggtagatttaccgtgtctcaggaccaagctaagaacaccctgtacttgcagatgaacagcctgaaaccggaagataccgccatgtactattgcgctgccgagtccgtgtcctctttcagctgcgggggttggctgaccagacctgatcgcgttccgtactggggtcaaggcacacaggttaccgtgtcaagcggtggctctggaggctccggtgggtccggtcaggtccagttgcaagagtctggaggtggcagcgtccaggccggaggctccctcaccctgagttgtgcggccagtgagtacgcctactccacttgcaacatgggatggtatcgccaggccccaggaaaggagcgcgagctggtctccgctttcatctccgacggatctacctattacgccgactctgtgaagggacgttttactatcactagggataacgcgaaaaacactgtgtacctccagatgaactctctcaagcctgaggacacggccatctactattgctctgcgaactgttacagacggctgagaaattattggggacagggtactcaggtgaccgttagcagc

SEQ ID NO: 1361 - DNA, 771 bp, synthetic construct
  source 1..771: mol_type = other DNA; note = Description of Artificial Sequence: Synthetic polynucleotide
caggttcagctccaggaatctgggggaggctctgtccaagctggcggttccttgcgtctgtcttgtagggcctctgggagcacctactccaattactgtctggggtggtttcggcagatcaccggcaaagaacgcgagggcgtggccgtcatcaactgggtgggcggaatgctgtactttgccgactctgtgaagggccgcttcacggtgtcacaggaccaggccaagaataccctgtatcttcagatgaactctctcaagcccgaggacactgctatgtattactgtgctgcggagagcgtctcatccttcagctgtggtggctggctgacacgcccggaccgtgtcccttattggggtcagggaacccaggtgaccgttagctcaggaggtggatctcaggtgcaactccaggagagcggcggtggcctggtgcaacccggaggtagcttgcgcttgtcctgtactgcctctggactcaccttcgatgactcagtaatgggttggttcagacaggcccccggaaagggcagggaggcagtgtcttgtattagctccagcggggctaatgcgttctacgccgattccgtcaagggcaggtttaccattagtcgcgataacgccaagaacaccctttacttgcagatgaacagcctgaagcccgaggacacagccacctattactgtaagagaggtcacgcctgtgctggctattacccaattccttacgatgactactggggacagggaacccaagtcactgtctcttct

SEQ ID NO: 1362 - DNA, 789 bp, synthetic construct
  source 1..789: mol_type = other DNA; note = Description of Artificial Sequence: Synthetic polynucleotide
caggtccagcttcaggagtccgggggcggttccgtccaggccgggggatcacttcgcctgtcttgtcgcgcctcaggctctacttactccaattattgcctcggttggttccgccaaatcaccggcaaagaacgggagggagtagccgtaattaactgggttgggggaatgctgtatttcgccgacagtgtgaagggccgcttcaccgtgtctcaggaccaggcaaagaataccctgtatctccagatgaactccctgaagccggaggacactgccatgtattactgcgccgctgagtccgtgtccagcttctcctgcggtggctggctgacccgcccagatcgtgttccttattggggccagggcactcaggtcacagtcagctctggaggctcaggaggttctggcggtagtggtcaggttcagctccaggaaagcggaggcggattggttcagcctggtggaagtctgcgcctctcttgcaccgcctccggcctgacatttgacgatagcgtgatgggctggttccgccaggctccgggaaagggtagagaggctgtgtcttgtatcagctcttccggggcgaacgccttctacgccgactccgtgaagggccgtttcaccatctcacgcgacaacgcaaagaacactctgtatctccagatgaacagtctgaagcccgaagacacggcgacctactattgcaagcgcggccacgcctgcgccgggtactatcccatcccatacgatgactattggggccagggaacccaagtgaccgtatcttca

SEQ ID NO: 1363 - DNA, 786 bp, synthetic construct
  source 1..786: mol_type = other DNA; note = Description of Artificial Sequence: Synthetic polynucleotide
caggtgcagcttcaggagagtggtggaggctccgtgcaggccggtggcagcctccgtctctcttgcagagcctcaggaagcacctacagcaattactgtttggggtggtttcggcagtcaacgggcaaggagagagagggcgtggccgttatcaactgggtgggcggtatgctgtacttcgccgactctgtgaagggtcgcttcacagtgagccaggaccacgcgaagaatacagtgactctccagatgaactccctcaagcccgaggacaccgccatgtactattgtgcggctgagtccgtatcctctttttcctgcgggggctggctgactaggcctggccgtgtcccatactgggggcagggcactcaggtcacagtcagcagtggaggcggtagtcaggtccagttgcaggaaagcggcggaggttccgtccaggccggaggttccctgcgcctgagctgcaccgcttccggcgcaatcgcctctggttacatcgactcccgctggtgtatggcctggttccgccaggcccctggaaaggagcgcgagggtgtcgctgcgatctggcctggtggaggcctgactgtctatgctgattccgtaaagggccgtttcactatctctcgcgatcatgccaaaaacaccctgtacttgcagatgaataacctgaagcccgaagacactgccatgtattactgtgccgcaggctctcctagaatgtgcccttccctggagttcgggtttgattattgggggcagggcacccaggttactgtgtcttcc

SEQ ID NO: 1364 - DNA, 804 bp, synthetic construct
  source 1..804: mol_type = other DNA; note = Description of Artificial Sequence: Synthetic polynucleotide
caagtccagctccaggagagcgggggaggctccgtgcaggccggtggcagcctccgcctcagctgccgtgcttcaggaagcacctacagcaactactgcttgggttggtttcgtcagagcaccggaaaagagcgcgagggtgtggctgtgattaactgggtcggagggatgctgtattttgcggatagcgtgaaggggcgcttcacagtgtctcaggatcatgccaagaacacagtgacccttcagatgaacagcctcaagcctgaggacaccgccatgtattactgcgctgccgagtccgtcagctccttcagctgcgggggctggctcacccgccctggccgcgtgccctattggggccagggaacccaggttactgtttccagtggagggtccgggggctctggaggcagcggccaggtacagttgcaggaatccggcgggggctcagtccaggcgggaggttccttgcgcctgtcctgtaccgcgtccggtgcaatcgcctccggctatattgattccagatggtgtatggcatggttccgccaggctcccggtaaggaacgggagggggttgcggccatctggccaggagggggtctcaccgtgtatgccgacagtgttaagggccgtttcactatcagcagggaccatgcaaagaacacgctgtacctccaaatgaacaatctgaagccggaagacaccgccatgtattactgtgctgccggtagtcctagaatgtgtccatctctggagttcggttttgattactggggtcagggcacacaagttaccgtgtctagc

SEQ ID NO: 1365 - DNA, 768 bp, synthetic construct
  source 1..768: mol_type = other DNA; note = Description of Artificial Sequence: Synthetic polynucleotide
caggtacaactccaggagtctggtgggggcagcgtacaggccggaggctctctcagactctcatgtcgcgcgagcggctccacctatagcaactattgcctggggtggttcagacagagcactggtaaggagcgtgaaggtgtggcagttatcaactgggtcgggggaatgctgtatttcgccgacagcgtgaagggccggttcactgtgtcccaggatcatgccaaaaacaccgtcaccctccagatgaactccctgaagcccgaggacacagctatgtattactgtgctgcggagagcgttagctctttcagctgtggtggctggctcacccggccaggccgtgtcccatattggggacagggcacccaggtgacagtgtctagcggcggtggctcccaggtccagcttcaggagtccggcggtggatctgtgcaggcaggcggttccctcaggctgagttgtaccgcccccggcttcaccagcaacagctgcggtatggactggtatcgccaggctcccggaaaggagagagagttcgtgagttctatctccactgatgggacgaccggctacgccgactccgtgaaggggcgcttcactatctctaaagataaggctaaggataccgtctacttgcagatgaatagcttgaaacctgaagataccggcatgtactcctgcaagaccaaggatgggaccattgctacgatggaactctgtgacttcggctactggggacagggcactcaggtgaccgtctccagt

SEQ ID NO: 1366 - DNA, 786 bp, synthetic construct
  source 1..786: mol_type = other DNA; note = Description of Artificial Sequence: Synthetic polynucleotide
caggtgcagcttcaggagtctggaggcggatctgtgcaggcaggcggtagtctgcgtcttagctgccgtgcctctggctcaacctattccaattattgcctcggctggtttcggcagtccaccggcaaggaaagggaaggcgtggcggtcatcaactgggttgggggtatgctgtatttcgccgacagcgtgaagggccgttttacagtgtctcaagaccatgctaagaataccgttaccctccagatgaactctctcaaaccggaagacactgctatgtattactgcgcagccgaatccgtttctagcttcagctgcgggggttggctgactaggcctgggcgcgtgccctattgggggcagggtacacaggtaaccgtttccagcggaggctctggcgggagtggcggatctggccaggtgcagttgcaggaatctggaggcggatctgtccaagctgggggcagcctccgtctgtcatgtaccgcccctgggttcacttccaactcctgcggcatggattggtatcgccaggcacctgggaaggagcgcgaatttgtaagctcaatctccacagatggcaccactggctatgctgacagtgttaaaggccggttcaccatctccaaggataaggctaaggatactgtataccttcagatgaactctctgaaacctgaagacacaggaatgtattcctgtaagacgaaggatggcaccatcgctacaatggagctttgcgattttggctattggggacagggcacacaggtgacggttagtagc

SEQ ID NO: 1367 - DNA, 783 bp, synthetic construct
  source 1..783: mol_type = other DNA; note = Description of Artificial Sequence: Synthetic polynucleotide
caggtgcagctccaggagtctggtggcggttccgtgcaggccggaggcagcctgcgcctgtcctgccgcgcctctggatctacatactccaattactgtctggggtggttcagacagagtactggaaaagagcgcgaaggtgtagccgtcataaattgggtcggcggtatgctgtacttcgccgacagcgtgaagggaaggtttactgtgtcccaggaccatgctaagaataccgtgaccctgcaaatgaactcccttaaacccgaggacaccgctatgtactattgcgcggctgagtccgtgtccagcttttcttgcggaggctggctcacccgtccaggccgtgttccttattggggacagggcacccaggtgacggtctcctctggtggaggttcccaggtgcagctccaggagagtggaggcgggtcagtacaggctggcggaagcctccgcttgagctgcgctgcctccggctatccctactcaaacggctatatgggatggtttcgccaggcccccggaaaggaacgcgagggcgtggccaccatttatactggcgatggccggacctactatgctgactctgtgaaaggccgctttaccatcagccgtgacaacgccaagaacactgttgatttgcagatgtctagcctgaagcccgaagacaccgctatgtattactgtgcagctcgggctgcccctctgtactcctctggaagccccctcactcgggccagatacaacgtgtggggacaggggacccaggtcaccgtgtcaagt

SEQ ID NO: 1368 - DNA, 801 bp, synthetic construct
  source 1..801: mol_type = other DNA; note = Description of Artificial Sequence: Synthetic polynucleotide
caggtgcagttgcaggagtctggcggtgggtccgtccaggctggcggttcccttcgcctgtcttgccgtgcctcaggcagtacctacagcaactactgtctcggttggttccgccagtccacgggcaaggagcgcgaaggtgtggctgttatcaactgggtgggaggtatgctgtactttgccgactccgttaaggggcgctttaccgtgagccaagaccacgcgaaaaacacggtaactttgcagatgaactctcttaaacccgaagataccgctatgtattactgcgcggcagagtctgtgtcttccttctcctgtggcggatggctgaccaggcctgggcgcgtcccgtactggggtcagggcactcaggtgacagtcagctccggcggaagcggtggctccggtggcagtgggcaagtgcaactccaggagtcaggaggtgggagcgttcaagcgggcggtagtcttcggctgagttgtgctgcgagtggctatccgtactccaacggctatatgggttggttccgccaggcccctggcaaggagcgggagggcgtggccactatctacaccggcgatggccgtacctattacgccgactccgtgaagggacggtttaccatctcacgcgacaacgcgaagaacacagttgacctccagatgtcctcactgaagccagaggatactgccatgtattactgtgctgcccgcgcagcccctctgtactctagtggttcccctctcacaagagccagatacaacgtctggggacaaggcacacaggtgactgtgagttcc

SEQ ID NO: 1369 - DNA, 756 bp, synthetic construct
  source 1..756: mol_type = other DNA; note = Description of Artificial Sequence: Synthetic polynucleotide
caggtacagctccaggagtcaggtggcggttccgtccaggcaggaggtagtttgcgtctgtcctgtcgtgccagcggatctacctactctaactactgcctgggatggttccgccagtctaccggcaaggagagagagggggttgctgttatcaactgggtcggcgggatgctctatttcgccgactctgtgaaaggccgctttactgtgtcccaggatcacgctaagaacaccgtaacgctccagatgaacagcctgaagcctgaagacacagccatgtattactgtgccgctgagagcgtgtccagcttctcttgtggcggatggctcacccgccccggtcgtgtgccctactgggggcagggaacccaggtcacagtaagctccggcggtggcagccaggtgcagttgcaggagtctggtggcgggtctgttcaggcgggaggctccctgagacttagctgtgttgcgtccgcatccacctactgcacttacgatatgcactggtatcgccaggctcctggcaagggccgtgagttcgtgtccgctattgattccgacggcaccactcgctatgccgatagtgtcaaggggaggtttaccatctcccaaggtacagcgaaaaatacagtttacctccagatgaacagcttgcagcccgaggacacggctatgtattactgtaagacggtgtgcgtcgtgggcagtcggtggtccgattactggggccaggggacccaggttactgtctccagc

SEQ ID NO: 1370 - DNA, 774 bp, synthetic construct
  source 1..774: mol_type = other DNA; note = Description of Artificial Sequence: Synthetic polynucleotide
caggtacagcttcaggagtccggcggtggctctgtccaggctggcggttccctcaggctgtcttgcagggcttctggttccacctacagcaactactgtttgggatggttccgccagtccacaggtaaggagcgcgagggagtggcggtcatcaactgggtaggaggcatgttgtacttcgccgactctgtgaaaggcagattcactgtcagccaggaccatgccaagaacacagtcactttgcagatgaactctctgaaaccagaggacactgctatgtattactgtgctgccgagtcagtcagctccttctcctgcggagggtggctcaccagacctggccgcgtgccgtactggggccaggggacgcaggtgaccgtgtccagtggcgggagcggaggttctggtggctcaggccaggttcaactgcaagagtccggtggaggttctgtgcaggccggtggctccctgcgtctctcctgcgtggcctctgcctccacttactgtacctatgatatgcactggtatcgccaggccccaggcaagggccgtgagtttgtgagcgccattgacagtgatggcaccactaggtatgccgattccgtgaagggtcgcttcaccatcagtcagggcactgccaagaacactgtgtatctccagatgaacagcttgcagcccgaggacaccgccatgtattactgcaagaccgtctgcgtcgtgggaagccgctggagcgactattggggccaggggacccaggtgaccgtctcatcc

SEQ ID NO: 1371 - DNA, 750 bp, synthetic construct
  source 1..750: mol_type = other DNA; note = Description of Artificial Sequence: Synthetic polynucleotide
caggtgcaactgcaagagtccggcggaggctccgttcaggctggcgggtctctgcggctctcctgccgcgccagcggctctacttatagcaactactgcctgggatggttcagacagagtacaggtaaggagagggagggagtcgctgttatcaactgggttggcggtatgctctatttcgcggactccgtgaagggccggttcaccgtgagccaggaccacgccaagaacaccgtgacactccagatgaacagccttaaacctgaggacaccgctatgtactattgcgcagccgaaagtgttagctctttttcctgtggtggctggctgactcgccctgggcgcgttccatattggggtcagggcacccaggtgacggtttcatccggcggaggcagtcaagtgcagcttcaggaatccggcgggggatctgtgcaggctgggggcagtctgaccctgtcctgtgctgccagcgagtacgcctactccacttgcaatatgggatggtatcgccaggcaccgggaaaggagcgtgagctggtcagtgcatttatcagcgatggctccacctattacgccgattctgttaagggccgcttcaccatcacccgcgacaacgccaaaaacaccgtatatttgcagatgaatagcttgaagcccgaagatactgccatttattactgctctgctaattgctacagacgcctgcgcaactattggggccaaggcacacaggtgacagtaagctcc

SEQ ID NO: 1372 - DNA, 768 bp, synthetic construct
  source 1..768: mol_type = other DNA; note = Description of Artificial Sequence: Synthetic polynucleotide
caggtgcagctccaggaatctggcggtgggagcgtccaggcgggcgggagcctccgcttgagctgccgcgctagtggtagcacctacagtaactattgcctcggctggttcaggcagtccaccggcaaggagcgcgaaggcgttgccgtcattaactgggttggaggtatgctgtactttgccgacagcgtaaagggtcgttttacggtaagtcaagatcatgctaagaacactgtgacattgcagatgaacagcctgaagccggaggatactgccatgtattactgcgcggctgagtctgtaagctctttctcatgcggtggatggctcacccgtccgggtcgcgttccgtactggggtcagggcacgcaagttaccgtttctagcggaggcagtgggggctctgggggttccggccaggtccagcttcaggagtctggcggtggctccgttcaagccggtggctctctgacactgtcctgtgccgcttctgagtatgcgtacagcacttgcaacatgggatggtatcgccaggcccccggaaaagagcgcgagctggtttccgcatttatttccgacggcagcacctattacgccgattccgtgaagggaaggttcactattacccgcgacaacgcaaagaataccgtctacttgcagatgaactccctgaagcccgaggacaccgctatctactattgctccgcaaattgctaccggcgtctccgcaactactggggccagggtacgcaggtgacagtcagctcc

SEQ ID NO: 1373 - DNA, 771 bp, synthetic construct
  source 1..771: mol_type = other DNA; note = Description of Artificial Sequence: Synthetic polynucleotide
caggtccagcttcaggagagcggcggtggctccgtccaggccggaggctctctgcgcttgtcctgccgtgcctccggttccacatacagcaactactgtctggggtggttccgtcagagcactgggaaggagagagagggcgtggctgtcatcaactgggttggcgggatgctgtactttgcggattcagtcaagggaaggttcactgttagccaggaccacgctaagaacaccgtaactctccagatgaactccctgaagcccgaggatacagccatgtattactgtgctgccgagtccgtgtccagcttctcctgtggtggctggctcactcgcccagggagagtcccatactggggacaggggacccaggtcacagtgagttccggcggaggctctcaggtgcagctgcaagagtctggcggaggtcttgtgcagcctggcggttccctgcgtctgagttgtaccgcatctggtctcacttttgacgatagcgtcatgggatggttccgccaggcaccggggaaaggccgcgaggccgtctcctgtattagttcctctggtgccaacgctttctacgctgattccgtgaaaggacggtttaccatctcccgcgataacgccaaaaacaccctgtatctccagatgaactctctgaagccagaggacactgcgacctattactgtaaacgcggtcatgcttgtgccggatattaccccatcccctatgacgattactggggacagggcacccaagttaccgtgtctagt

SEQ ID NO: 1374 - DNA, 789 bp, synthetic construct
  source 1..789: mol_type = other DNA; note = Description of Artificial Sequence: Synthetic polynucleotide
caggtgcagctccaggaaagcggagggggctcagtccaggccggaggctctctgagactctcttgccgtgcatccggcagcacttattccaactattgtctgggctggtttaggcagagcacaggcaaggagcgcgaaggtgtcgcagtgattaactgggtcggcgggatgttgtacttcgccgatagcgtcaaggggcggtttacagtgtcccaggaccacgccaagaacaccgtgacccttcagatgaatagcctgaagcccgaagatacagcaatgtattactgtgcggctgagtccgtgtcttccttcagctgcgggggctggctgaccagacctggccgcgttccgtactggggacagggaactcaggtgaccgtttcctctggcggatcaggaggctccggcggttctggccaggtgcagttgcaggagtctggtggaggcctggtacaacccggcggttctttgcgcctctcatgcactgcgagcggtcttacatttgatgactctgtaatgggctggttccgtcaggctcctggcaagggacgtgaggccgtgagctgcatttccagctccggcgcgaatgccttttacgctgattccgtgaagggaagattcaccattagtagagacaacgctaagaacaccctgtatttgcagatgaactctctgaaacctgaggatacagctacctattactgcaagcgcggtcacgcttgtgctggctattacccgatcccttacgatgactactggggacagggcacccaagtgacagtctcttcc

SEQ ID NO: 1375 - DNA, 786 bp, synthetic construct
  source 1..786: mol_type = other DNA; note = Description of Artificial Sequence: Synthetic polynucleotide
caggtgcagcttcaggagtccggcggtggctccgtgcaggcgggcgaatcccttcgtctgagctgccgcgcttctggctccacctactctaactattgtctgggctggtttcgtcagatcaccggcaaagagcgcgagggagtggccgttataaattgggtaggcggtatgctgtactttgctgactccgtgaaggggcggttcacagtttcccaggatcaggcaaagaatactgtttatctggaaatgaactccctgaagcctgaggacactgctatgtattactgcgccaccgagtccgtgtccagcttttcatgtggcggttggctgacccgccctgatcgggtcccttactggggtcaggggacacaggtaacagtgtccagtggtggcgggtcccaggtgcaactccaggaatctgggggcggttccgttcaggctggcgggtcccttcgcctgtcctgcaccgcgtccggtgctatcgcttcaggttatatcgactcccgttggtgtatggcttggtttagacaagctcctggcaaagaacgcgagggcgtcgctgccatctggccaggaggcggtcttaccgtctacgccgacagcgtgaagggccggtttaccatctcacgtgaccacgccaagaacacactgtacctccagatgaataacctgaagccggaagatacggccatgtattactgtgcagccggaagcccccgcatgtgcccatctcttgagttcgggtttgactattggggacagggaacccaagtcactgtgtcctct

SEQ ID NO: 1376 - DNA, 804 bp, synthetic construct
  source 1..804: mol_type = other DNA; note = Description of Artificial Sequence: Synthetic polynucleotide
caggtccagctccaggagtcaggagggggcagcgtacaggccggagagtccctgagacttagttgccgcgccagcggatctacctactctaactactgcctcggctggttcaggcagatcaccggcaaggagagagagggtgtggccgtaatcaactgggttgggggaatgctgtacttcgccgactccgtgaagggtaggttcactgtttctcaggaccaggcaaagaatactgtgtatctggagatgaactccctgaaacccgaagatactgccatgtattactgtgccaccgagagcgtgtcctctttctcctgtggaggctggctcacgcgccctgatcgcgtgccctattggggacagggtactcaagtcaccgtgtcaagcggaggcagcgggggctctggaggcagcggtcaggtccagctgcaagagagcggtggaggttcagtacaggctggcgggtcactgcgtctgagttgtactgccagtggagccatcgcgtctggctacatcgactctaggtggtgcatggcctggttccggcaggctcctgggaaggagagagagggagtggccgcgatttggccaggtgggggcctgaccgtctacgccgatagcgtcaaggggcggttcaccatcagccgcgatcacgctaaaaataccctgtaccttcagatgaataacctgaagccagaagacacagctatgtactattgtgccgctgggtctccccggatgtgtccaagtctggaatttggcttcgactactgggggcagggcacacaggttactgtgagttcc

SEQ ID NO: 1377 - DNA, 768 bp, synthetic construct
  source 1..768: mol_type = other DNA; note = Description of Artificial Sequence: Synthetic polynucleotide
caggtccagttgcaggagtccggcggtggctccgtgcaggccggtgagtctctgagactgtcttgccgcgctagtgggtccacatacagtaactactgcctgggctggttccgccagatcactggtaaggaaagggaaggcgttgctgttatcaactgggtgggcggtatgctgtacttcgctgactccgtcaagggccgcttcaccgtctctcaggatcaggctaagaatacagtctatctggaaatgaacagcctgaagcccgaagatactgctatgtactattgtgctaccgagtctgtctctagcttttcttgcggaggctggctgacccgcccggacagggtcccttactggggccagggcactcaggtgaccgtatctagcggtggcggttcacaggtgcaactccaggagagcggtggcggatctgtgcaggccggaggcagccttcgcttgagctgcacggcccccggctttaccagtaacagctgtggcatggactggtatcgccaggcccccggaaaggagcgcgagttcgtcagctccatctccactgacggaactaccggatatgctgactctgtcaaaggtcgcttcaccatctctaaggataaggcaaaggacacagtctatctgcaaatgaacagtctcaagccagaggacacaggtatgtactcctgcaagaccaaggatggcactattgccacaatggaactttgtgatttcggctactggggacagggcacccaagttactgtttctagc

SEQ ID NO: 1378 - DNA, 786 bp, synthetic construct
  source 1..786: mol_type = other DNA; note = Description of Artificial Sequence: Synthetic polynucleotide
caggtgcaacttcaggaatcagggggtggctccgtgcaggctggtgagtcactgcgtctttcttgcagggcctctgggtccacctactccaactactgcctgggttggttcaggcagatcaccggcaaggagagagagggcgtggccgttataaattgggtaggaggtatgctgtacttcgccgacagcgtcaagggacgcttcactgtcagtcaggatcaggccaagaacactgtgtaccttgagatgaactctctgaagcctgaagacacagccatgtattactgtgccacagagagtgtctctagcttcagctgcggtggatggctgacccgtcctgaccgcgttccctactggggccagggcactcaggttactgtgtctagcggagggagcggagggtcaggtggctctggccaggtccagttgcaggagtctggtgggggctctgtgcaagctggcgggtctctgagactgtcctgtaccgcacccggcttcacatccaatagctgcggcatggactggtatagacaagcgcctgggaaggagcgcgagtttgttagctccatcagcacagacggcacaacgggctatgccgactctgtgaaagggcgctttaccatttctaaggacaaggccaaggacaccgtctatctccagatgaacagcctgaagcctgaggacacaggcatgtatagctgcaaaacgaaggacgggaccatcgcaacgatggagctgtgtgactttgggtactgggggcagggcacccaggttaccgtctcttcc

SEQ ID NO: 1379 - DNA, 783 bp, synthetic construct
  source 1..783: mol_type = other DNA; note = Description of Artificial Sequence: Synthetic polynucleotide
caggtgcaactccaggagagcggtggaggtagcgtgcaagctggtgagagtctgcgcctcagctgccgcgcttccggctcaacttacagcaattactgcctgggttggttccgtcagatcaccggaaaggagagagagggggtagcagtcatcaactgggtcggcggaatgctctattttgccgactccgttaaaggacgcttcaccgtgtctcaagaccaggctaagaacacagtgtatctggagatgaactctctcaagccagaggataccgccatgtactattgcgccactgaatccgtgtcttccttctcatgtggcgggtggctcactcgtcctgatcgggtgccatactgggggcagggcacccaggtcaccgtctctagtggtggaggcagccaggtccagttgcaggagtctgggggcggttctgtccaagctggtggctcactccgtctgtcctgcgccgcgagcgggtatccatactcaaatggctacatgggatggttccgtcaggctccaggaaaggagcgtgagggggtcgcgaccatttataccggcgacggacgcacctactatgccgactccgtgaaggggaggtttaccatcagtcgcgataacgccaagaacaccgtggatctccagatgagttccctgaagcctgaagacaccgctatgtattactgcgcggcacgtgccgcaccgctttacagtagcggcagtcccctgacccgcgcgaggtataacgtgtggggccagggcacccaggttacagtgtcttct

SEQ ID NO: 1380 - DNA, 801 bp, synthetic construct
  source 1..801: mol_type = other DNA; note = Description of Artificial Sequence: Synthetic polynucleotide
caggtgcagctccaggagtctgggggcggttctgtccaagctggcgagagcctgcgcctgtcctgccgggcttccggttccacctattctaactattgtctgggttggtttcgccagatcactggaaaggagagggagggtgtggcagttatcaactgggtgggtgggatgctctatttcgccgattcagttaagggacgcttcacagtgagccaagaccaggctaagaacacagtctacctggagatgaacagcctgaaaccggaagacacggcaatgtattactgcgcgaccgagagcgtgtctagttttagctgtgggggctggctgacgagacccgacagggtgccttactgggggcagggtactcaggttaccgtctcttccggtggcagtggtggcagcggaggcagcggccaggtgcagctgcaagaatctggcggtggcagcgttcaggcgggaggttcccttcgcctgtcttgtgctgcatccggctacccttactctaacggttacatgggctggtttcgtcaagcccccggcaaggaacgtgagggggtggcgacaatttatacaggtgatggccgcacttattacgctgactccgttaagggacgcttcaccatctcccgcgataacgccaagaatacggtggacctccagatgtcctctctcaaacctgaggacaccgcaatgtactattgcgccgctcgcgccgcgccgctctacagtagcggcagcccactgactcgcgcccgctacaatgtgtggggacagggaacccaggtgaccgtgagcagt

SEQ ID NO: 1381 - DNA, 756 bp, synthetic construct
  source 1..756: mol_type = other DNA; note = Description of Artificial Sequence: Synthetic polynucleotide
caagtgcagctccaagagtccggtggaggctccgtgcaggctggcgagtccctgcgtctgtcctgccgcgcgtctggtagtacttactctaactattgtctcggttggttcaggcagatcaccggcaaagagcgcgaaggagttgccgttatcaactgggtgggcggtatgctctatttcgccgacagcgtgaaagggagattcactgtgagccaggaccaagctaagaacacagtgtatcttgagatgaacagcctcaagcctgaggacaccgctatgtattactgtgccacagaatctgtgtcttccttctcatgtgggggttggctcaccaggccggacagggtcccatactggggccagggcacccaggtgaccgtgtctagcggaggtggcagccaggtgcagttgcaggagtccggtgggggctccgtgcaggctggaggctcacttcggctcagctgcgtggcctcagcgtctacctactgcacatacgatatgcactggtatcgtcaagcacccggcaaaggccgcgagttcgtcagcgccattgattccgacggtacaacccgttacgctgactccgtcaaggggcgttttaccatttcccaggggaccgctaagaacaccgtttatcttcagatgaacagcctccagccggaagacacagccatgtattactgtaaaaccgtgtgcgtagtgggctccagatggtcagactattgggggcagggcacccaggtaaccgtgtcctct

SEQ ID NO: 1382 - DNA, 774 bp, synthetic construct
  source 1..774: mol_type = other DNA; note = Description of Artificial Sequence: Synthetic polynucleotide
caggttcagcttcaggaatcaggaggtggctcagtgcaggcaggagagtctctccgcctgtcctgtcgtgccagcggatctacgtattccaactactgcctcggttggttcaggcagatcaccggcaaagagcgcgaaggagtggcggttatcaactgggttggcggaatgctgtacttcgcagacagtgtcaagggcagattcactgtgtcccaggaccaggccaaaaacacagtgtacctggagatgaatagtttgaagccggaagatacagccatgtattactgcgccaccgagtctgtctccagcttttcttgcggaggctggctgacccgcccagaccgcgtcccctactggggccagggaactcaagtcaccgtgtcttccggtgggagtggtggcagcgggggctccggccaggtgcagttgcaggagtccggtggcggaagtgtccaggccgggggctccttgagactttcatgcgtcgcctctgcctccacctactgcacttacgacatgcactggtatcgccaggctccgggtaagggacgggagttcgtatctgccatcgactccgacgggaccacacgctacgcggacagcgtgaaaggcaggttcaccatcagtcaggggaccgccaagaatacggtttacctccagatgaactctcttcagccggaggacacggctatgtattactgcaaaactgtgtgcgtggttggaagcagatggtctgattactggggtcagggcacccaggtgactgtatcaagc

SEQ ID NO: 1383 - DNA, 750 bp, synthetic construct
  source 1..750: mol_type = other DNA; note = Description of Artificial Sequence: Synthetic polynucleotide
caagtgcagctgcaagaaagtggcggtggcagtgtgcaagctggagagtccctcagactgagttgtagagccagtggtagcacatatagcaattactgcctgggttggtttcgtcagatcaccggcaaggagagagaaggcgtggccgtcataaattgggtcggcggtatgctgtactttgcagattccgtcaagggccgctttacggtcagccaagatcaggccaagaatactgtgtatctggaaatgaacagtctgaaaccggaggacaccgctatgtattactgcgctactgaatccgtctcctcttttagttgcggtgggtggctcaccagaccggatcgcgtgccctattggggccagggcacccaggtgacggtgtcctcaggaggcggatcacaggtgcagctccaggagagcgggggcgggagtgtgcaggccggtggcagcctgaccttgtcatgtgcggctagtgagtacgcctattctacctgtaatatgggctggtatcgccaggcacccggaaaagagcgcgagctggtgtccgcgttcattagcgatgggtctacctattacgccgattccgtgaagggcaggttcaccatcacacgcgacaacgctaagaacaccgtatacctccagatgaacagcctgaagccagaagacacggccatctattactgctctgctaattgctaccgcaggctgcgcaactactggggacagggcactcaggtgactgtgtctagt

SEQ ID NO: 1384 - DNA, 768 bp, synthetic construct
  source 1..768: mol_type = other DNA; note = Description of Artificial Sequence: Synthetic polynucleotide
caggtgcaacttcaggagtccggtggcggtagtgtgcaggctggcgagtctctgcgtctgtcttgccgcgcgtccggctccacctactccaactactgcctgggttggttccgccagattaccggcaaagaaagggagggcgttgcggttattaactgggtgggcgggatgctgtacttcgcagattctgtgaagggtaggtttacagtctcacaggaccaggctaagaacacggtgtacctggaaatgaacagtctcaagcccgaagacaccgccatgtattactgcgctacagagtctgtttcctcttttagctgcggtgggtggctgacccgccctgaccgtgtgccttactggggacaggggacccaggtcactgtaagctctggagggtccggtggctccggcgggagcggccaggtacagctccaggagtccggcgggggaagtgtgcaggccggaggcagcctcaccctgagctgcgcggcatccgagtacgcctattctacctgtaacatggggtggtacaggcaggctccgggcaaggagagagagttggtttctgcttttatcagtgatggcagtacctattacgcggattccgtgaaagggagattcaccattacacgtgacaacgctaagaacaccgtttatttgcagatgaactccctcaagcccgaggatacagccatttactattgctctgccaactgctatcgtcgcctgcgcaactactggggacaggggacacaggtgaccgtgtccagt

SEQ ID NO: 1385 - DNA, 771 bp, synthetic construct
  source 1..771: mol_type = other DNA; note = Description of Artificial Sequence: Synthetic polynucleotide
caggtccagctccaggagtccgggggtggctccgtgcaggctggcgaatctttgcgcctctcatgcagagcttccggctccacctatagcaactattgtctgggttggtttcgccagatcaccggcaaagagcgtgaaggcgtcgccgtcatcaactgggtcggcgggatgctgtactttgcggactctgttaagggtcgtttcacagtcagtcaggatcaagcgaagaacaccgtgtacctggagatgaactccctgaagccggaggacaccgcaatgtattactgtgccactgaatctgtgagcagttttagctgtggcggttggctgacccgccctgaccgcgttccctactgggggcagggcacccaagtaaccgtgtcttccgggggcgggtctcaggtccagctccaggagtctggagggggccttgtccagcccggaggcagcctgcgcctgtcttgcacggctagtggcctgacattcgacgatagcgtgatgggctggttcagacaggctccggggaagggccgtgaggccgtttcttgtatctctagctctggtgctaacgccttctatgccgactccgtgaagggccgcttcacaatcagccgtgacaacgccaagaacacgctgtatcttcagatgaactccctgaagcctgaggataccgccacatattactgtaagcgcggtcacgcctgtgcaggctattaccccatcccctacgatgactactggggtcagggaacccaggttacggtttcatct

SEQ ID NO: 1386 - DNA, 789 bp, synthetic construct
  source 1..789: mol_type = other DNA; note = Description of Artificial Sequence: Synthetic polynucleotide
caggtgcaacttcaggagagcgggggtgggagcgtgcaggcgggcgagagcctgcgcctgtcctgccgtgcgtctggctccacctacagtaactactgcctcgggtggtttcgccagattacgggcaaggagcgcgaaggtgtggccgttatcaactgggtgggtggaatgctctactttgccgattctgtgaaaggacgctttaccgtgtctcaggatcaggctaagaatacagtttacctggagatgaactctctcaagcctgaggatacagcgatgtactattgtgcaaccgagtccgtctcttccttcagctgcggcgggtggctgacccgtcctgaccgcgtgccatactggggtcaaggtacacaggtgacagtcagctctggtggcagcggcggtagcgggggcagtggccaggtccagttgcaggaaagtggaggcggtctggttcaacctgggggctccctgcgcctgtcttgcacagcctctggactgacgtttgatgactccgtgatgggctggttcagacaggctcctggtaagggccgcgaggccgtcagctgtatcagtagctccggggccaacgctttctatgcagactctgtcaaaggcagattcactatcagccgcgacaacgccaagaacacactgtatttgcagatgaacagcctgaaacctgaagatactgctacatactattgtaagcgcggccatgcctgtgctgggtattaccctatcccctacgatgactactggggccagggcacgcaggttacagtaagcagt

SEQ ID NO: 1387 - DNA, 759 bp, synthetic construct
  source 1..759: mol_type = other DNA; note = Description of Artificial Sequence: Synthetic polynucleotide
caggtgcagctccaggaatccggtggcgggtccgtgcaggctggcggttccctccgtctgtcctgtgtggcctccgggtacgtcagctgtgactactttctgccatcctggtatcgccaggcccccggtaaggagagagagttcgtgtctatcattgatggcactggcagcacttcttacgccgcatctgtgaaggggcgcttcacagcctcccaggatagaggcaaaaacattgcctaccttcagatgaactctttgaaacccgaggatactgccatgtattactgcaaagcgagctgtgtccggggccgcaccatctccgaatactggggacagggaacccaggtcacggtctcctctggtggcgggtcccaggtgcagcttcaggagagcgggggaggttccgtgcaggccggaggctctctcaggctcagctgcacagcgtccggcgctattgccagcggatatatcgacagtcgttggtgtatggcctggtttcgccaggctccgggcaaggagcgtgagggagtcgctgccatttggcccggcgggggactgaccgtgtatgcggactctgtgaaaggaagattcaccatctctcgggatcacgctaagaataccctgtatctccagatgaataacctgaagcccgaggacaccgccatgtattactgcgccgcaggatcaccccgcatgtgtccgtctctggagttcggtttcgactactggggccaaggcacccaagtcactgtgtcttct

SEQ ID NO: 1388 - DNA, 777 bp, synthetic construct
  source 1..777: mol_type = other DNA; note = Description of Artificial Sequence: Synthetic polynucleotide
caggtgcaactccaggagtccgggggtggctccgtacaggctggaggcagcctccgtctcagttgtgttgccagcggctatgtaagctgcgactatttcctgccttcttggtatcgccaggcacctgggaaggagcgtgagttcgtgtccatcattgatggcacaggcagcacctcctatgccgcttcagtcaagggacgctttacagcctcccaggaccgtggcaagaacatcgcctaccttcagatgaactccctgaagcctgaggacacagccatgtattactgtaaggcttcctgtgtgcgtggccggaccatctctgaatactggggacagggcacgcaggtgacggtcagctctgggggtagtggcgggtccggcgggagtggacaggtgcagcttcaggagagcggtggcggatctgtccaagccggtggcagccttaggctctcttgcactgccagcggggccatcgcttcaggatatattgatagccgctggtgcatggcctggttccgccaggccccagggaaagagcgtgaaggcgtggcagccatctggccgggtggcggtctgaccgtctacgccgactctgttaaaggaagatttaccatttcccgcgatcacgctaagaacactctgtatcttcaaatgaataacctgaaacctgaagacaccgctatgtattactgtgctgccggtagcccgaggatgtgcccaagccttgagttcggcttcgactattggggccagggaactcaagtgaccgtgagcagc

SEQ ID NO: 1389 - DNA, 741 bp, synthetic construct
  source 1..741: mol_type = other DNA; note = Description of Artificial Sequence: Synthetic polynucleotide
caggtgcagctccaggagtctggtgggggttccgtccaggctggcggttccctgaggctctcatgcgtggccagcggttacgtgtcttgcgactatttcctgccctcatggtatcgtcaggcccctggcaaggagcgcgagttcgtgtcaattatcgacggcacaggcagtaccagctatgcagccagcgttaagggccgttttaccgcgtcacaggatcgcgggaagaatatcgcctacctccagatgaacagtctgaaacctgaagatacagcgatgtattactgtaaggccagctgtgtgaggggtcggacgatctctgaatactggggccaaggaacccaagtaactgtgtccagcggaggcggatctcaggtgcagcttcaggaatccggcggtggcagcgtccaggccggagggagcctgcgtctttcctgcaccgctcctggcttcaccagcaacagttgcgggatggattggtatcgtcaggctcccggcaaggaacgggagttcgtgtccagtatcagcactgatggcactaccggatacgctgattccgttaagggtcgtttcaccatctccaaagataaggccaaagacaccgtgtatctccagatgaactccctgaaaccagaagacacaggtatgtattcttgtaagactaaagacggcaccatcgcgacaatggagctgtgtgatttcggatactggggtcagggaacacaggtgactgtgtcctct

SEQ ID NO: 1390 - DNA, 759 bp, synthetic construct
  source 1..759: mol_type = other DNA; note = Description of Artificial Sequence: Synthetic polynucleotide
caagtacagttgcaggagtctggcggaggctccgtgcaggcgggcgggagcctgaggctgagttgtgtggcctcagggtatgtgtcctgtgactactttctcccgagctggtatcgccaggctccagggaaggagcgtgagttcgtgtctattatcgacgggactggatctacctcttatgccgcatctgtcaaggggcgcttcaccgcctctcaggatcgcggaaagaacatcgcctacttgcaaatgaacagcctgaagcccgaggacactgccatgtattactgtaaagcctcttgtgtgagaggccgcactatttcagagtactggggacagggaacccaggtcactgtcagcagtggaggttctggcggttctggtgggtcaggacaggtacagttgcaggaaagcggaggcggttccgtgcaggccggaggctccctgaggctgtcttgcacagctcctggtttcacatctaacagttgcggcatggactggtatcgccaggccccagggaaggagagggaatttgtgtctagcatcagcaccgacggaaccacaggatacgccgactccgtcaagggtcgttttactatcagtaaggacaaggctaaggatactgtctacctgcaaatgaacagtctgaagcccgaggacaccggcatgtatagctgtaagactaaggatggaactattgcgactatggagctgtgtgacttcgggtattggggccagggtacacaagtaactgtgagttct

SEQ ID NO: 1391 - DNA, 756 bp, synthetic construct
  source 1..756: mol_type = other DNA; note = Description of Artificial Sequence: Synthetic polynucleotide
caggtacagctccaggagagcggtggcggttccgtccaagcaggcggttccctcagactgtcatgcgtcgcaagcggctacgtgtcatgtgattacttcctgccctcctggtacaggcaagcgccaggaaaggaaagggagtttgtctccattatcgacggcaccggaagcacaagttacgccgcgtctgttaagggccgcttcaccgcttctcaagatcgcggcaaaaacatcgcctacctgcaaatgaacagcctcaaaccagaggacaccgcgatgtattactgcaaggcttcttgtgtgcgtggtcggacgatttccgaatactggggccaaggcacccaggtgactgtttctagcggtgggggcagccaggtccagttgcaggagagtggcggtggcagcgttcaggctggcgggagcctgagactcagctgcgctgcgtctggttacccctattccaacggctatatgggctggttcagacaggcaccagggaaggagcgcgagggggtggccaccatctacaccggcgatggccgcacatattacgctgattcagtgaagggaagattcactatcagtagggacaacgctaagaataccgtggatctccagatgagttcactgaagccggaggataccgcgatgtattactgcgcggctcgcgcagcccctctctacagtagcggctcccctcttacgcgggctagatacaacgtgtggggccagggaacccaggttactgtgagcagt

SEQ ID NO: 1392 - DNA, 774 bp, synthetic construct
  source 1..774: mol_type = other DNA; note = Description of Artificial Sequence: Synthetic polynucleotide
caggttcagctgcaagagtccggcgggggctccgttcaggccggaggctctctcaggctgagctgtgtcgcctccggctatgtgagctgtgactactttctgccatcctggtatcgccaggcccctggcaaggaacgcgagtttgtctccatcattgacggcaccggctccacatcctacgcggcttccgtgaaggggcgtttcaccgcgtcccaagatcgcgggaagaatatcgcctacctccaaatgaactctctcaagccggaggacactgctatgtattactgtaaggcatcctgtgttcgcgggcggacaatcagcgaatactggggccagggcacccaggtaactgtatccagcggaggctctggaggttctggtggctccgggcaggtccagctccaggagtctggcggtggctccgtgcaggctggtggcagccttcgtctgtcttgcgctgcctctggttatccttactccaatggctacatgggctggtttcgccaggccccagggaaggagagggagggcgtggccactatctacaccggcgatggccgcacctactatgctgacagcgtgaagggcagattcaccatcagcagggataacgcaaagaacacagtggaccttcagatgagtagcctgaagccagaggacaccgctatgtattactgtgcggccagggcagctccgttgtactcttccggttcccctctgaccagagcgagatataatgtgtggggacagggcacccaggttaccgtcagttcc

SEQ ID NO: 1393 - DNA, 729 bp, synthetic construct
  source 1..729: mol_type = other DNA; note = Description of Artificial Sequence: Synthetic polynucleotide
caagtgcagttgcaggagagcgggggtgggtccgtccaggctgggggctcactgcgtctgagctgtgtggcctctggttacgtgtcctgtgactatttcctgccttcttggtatagacaggccccaggcaaagaaagggagttcgtgtctattatcgacggcaccggcagcactagctatgcggccagcgttaaggggcgtttcacagccagccaggatcgcggcaagaacatcgcctatttgcagatgaactccttgaagcccgaggacaccgccatgtactattgcaaggccagctgcgtgcgcggcaggaccatttccgagtactggggccaaggcactcaggtgacagtgtcttccggtggcggtagtcaggtgcagttgcaggagtccgggggaggcagcgtgcaggccggtgggtccctccgcctgagctgtgtggcgtccgcaagcacctactgtacctatgatatgcactggtacaggcaagcccctggcaagggccgcgagtttgtctctgctatcgactcagacgggaccactcgctacgctgacagtgtaaaggggcgcttcactattagccagggcacagccaagaacaccgtgtacctccagatgaatagcctccagcccgaggacactgccatgtattactgcaagaccgtatgcgtggttgggagtcgctggtcagattactggggtcagggtactcaggtgaccgtctccagc

SEQ ID NO: 1394 - DNA, 747 bp, synthetic construct
  source 1..747: mol_type = other DNA; note = Description of Artificial Sequence: Synthetic polynucleotide
caggtgcagttgcaggaatccggcggtggctcagtccaggccgggggctccctgaggctgtcatgcgtcgccagcggatatgtgtcttgcgactattttctgccctcctggtatcgccaagctcccggcaaggagagagaatttgtttctatcattgacgggacaggttccacttcctacgctgccagcgtcaaaggccgcttcacggcgagccaggataggggcaaaaacatcgcctacctgcaaatgaactctctcaagcccgaggacactgccatgtattactgtaaagccagctgtgtgcgcggtcgcactatctctgaatattggggccagggcacccaggtgaccgtctcctctggaggttcagggggctccggtggcagcggtcaggtccagctccaagagtctgggggcggtagtgtgcaggcgggcggttccctcagactctcctgcgtggcctccgcctctacctattgcacctacgatatgcactggtatcggcaggctccaggaaagggccgggagttcgtgagcgcgattgactccgatggcactacccgttatgccgattccgttaagggacggttcacaattagccagggaaccgcgaagaacaccgtgtacctgcaaatgaactctctccagccggaggatactgccatgtattactgtaagactgtgtgcgtcgttgggtccaggtggtccgattattggggccagggaactcaggttaccgtgtccagc

SEQ ID NO: 1395 - DNA, 723 bp, synthetic construct
  source 1..723: mol_type = other DNA; note = Description of Artificial Sequence: Synthetic polynucleotide
caagtgcagctccaggagtctggcggtggctctgtgcaagcgggcggttctctcagactcagctgcgtggccagcggctacgtgtcctgcgattacttcctgcctagctggtatcgtcaggcccccggcaaggaacgcgagttcgtcagcattatcgacgggactgggtcaacctcctatgcagcctccgtaaaaggcaggttcaccgccagtcaggatcgcggcaagaatatcgcgtacctccagatgaactctttgaaacctgaggatacagctatgtattactgtaaggctagttgtgtgcgtgggcgcaccatctccgaatactggggccagggaactcaggtcactgtttctagtgggggcggaagtcaggtgcagttgcaggagtctggaggcggttcagtccaggctggcggatctctgacgctctcttgtgcagcctctgagtatgcctatagcacctgcaacatgggatggtacagacaggctcctggtaaggagcgcgaattggtgagcgctttcatctctgatggttccacatattacgctgattccgtgaagggccgctttacgattacacgcgacaatgcgaaaaacacagtgtacctccagatgaactccctcaaaccagaagacactgcaatctactattgttctgctaactgctatcgccgtctgcgcaactactgggggcaaggtacgcaagtgaccgtctccagc

SEQ ID NO: 1396 - DNA, 741 bp, synthetic construct
  source 1..741: mol_type = other DNA; note = Description of Artificial Sequence: Synthetic polynucleotide
caggtccagctgcaagagagcggcggtgggtctgtgcaggccggaggcagcctgcgtctcagctgcgtcgcttctggatatgtcagctgtgactacttcctcccatcttggtacagacaagcgccggggaaggaacgcgagttcgttagcattatcgacggcactggaagtacctcttatgccgcttccgttaaaggacgcttcacggcctctcaggatcgcggcaagaatatcgcctaccttcagatgaacagcctgaagccagaggacaccgctatgtattactgcaaggccagctgtgtgagagggcgcaccatcagcgaatactggggccagggcacccaggtgaccgtatctagtggcgggagcggtggctccggtggcagtggccaggtgcagctgcaagagagtggtgggggcagtgtgcaggctgggggttccctgacgctgtcctgtgcggccagcgagtatgcttactcaacgtgcaatatgggttggtatcgccaggcccctggtaaggagcgcgaactcgtctctgcatttattagcgacggctccacttattacgccgacagcgtgaaggggagattcactattacccgcgacaatgccaagaacactgtgtacctccaaatgaactccctgaagcccgaggacacagccatctattactgctccgcgaactgctatcgccgtctgcgtaactactggggccaggggacccaggtcacagtctcctct

SEQ ID NO: 1397 - DNA, 744 bp, synthetic construct
  source 1..744: mol_type = other DNA; note = Description of Artificial Sequence: Synthetic polynucleotide
caggtacagctccaggagtccggcggtggctctgtgcaggcaggaggctcactgcgcttgagttgcgtggccagcggctacgtgtcctgcgactacttcctgccatcctggtataggcaggctccgggtaaggaaagggagttcgtctccattatcgacggtactggcagcacctcttacgcagcctccgtgaaggggcgtttcaccgccagccaggatcggggcaagaacatcgcctacttgcagatgaactccctgaagccagaggacactgcaatgtattactgcaaagccagctgtgtgagaggacgcaccatctctgagtactgggggcaaggcacacaggtcacggtctctagtggcgggggtagccaggtccagctccaggaaagcggaggtggcctggttcagccgggagggtcactgagactgtcctgtaccgccagcgggctgaccttcgatgacagcgtcatgggttggttccggcaggcccccggtaaaggaagagaggcggtgagctgcatcagctcctctggagctaacgccttctatgctgactccgtgaagggtcgcttcaccatctccagagataacgctaagaatactctctacctccagatgaactctctgaaaccggaggacaccgcaacctattactgcaagcgcgggcacgcctgcgcgggatactatccaatcccatacgatgactactggggtcagggaacccaggtcaccgtgagttct

SEQ ID NO: 1398 - DNA, 762 bp, synthetic construct
  source 1..762: mol_type = other DNA; note = Description of Artificial Sequence: Synthetic polynucleotide
caggtgcagctccaggagagcggcggtggctctgtccaggcaggcggttccctgcgcctctcttgcgtggcgagtggctatgttagttgtgactacttcctgccctcatggtatcggcaagctccgggaaaagagcgcgagtttgtctccatcattgatggaacaggatctacgtcctatgccgcaagtgtcaaggggcggttcaccgcttctcaggacagaggaaagaatatcgcttatctccagatgaactccctgaagccagaagacaccgctatgtactattgcaaggcttcttgtgtgcgcggcagaaccatctctgagtactggggccagggcacccaggtgaccgttagttcaggagggagcggaggcagtggaggctcaggtcaggtgcagctccaggaatctggcggaggtctggtccagccaggtgggtccctgcgcctcagctgtactgcctccggtctcaccttcgatgacagcgtcatgggctggttccgccaagcgccgggtaaggggcgtgaagccgtgagctgcatttcctctagcggagccaacgctttttacgccgacagcgtgaagggtagatttacaatctctcgcgataacgcgaagaacaccctgtatctccaaatgaacagcctgaagccagaggacaccgctacttattactgcaagaggggacatgcgtgtgcggggtattaccccattccctatgatgactactggggccagggcacccaggtgaccgttagttct

SEQ ID NO: 1399 - DNA, 759 bp, synthetic construct
  source 1..759: mol_type = other DNA; note = Description of Artificial Sequence: Synthetic polynucleotide
caggtgcaactccaggaatccggcggtggctccgtgcaagccggtggcagtcttaggctgtcctgtgtggcatcagggtatgtgtcctgcgactacttcctgcctagctggtacagacaagctcccggtaaggagagagagttcgtgtcaatcattgatggcaccggctccacttcctacgccgcttctgtgaagggacgttttactgccagccaagataagggcaagaacattgcctatttgcagatgaactccttgaagccggaggacaccgctatgtattactgcaaggcctcctgtgtacgtggccgggccatttccgaatactggggccaaggaacgcaggtcacagtgtcctctggaggtgggtcccaggtgcagttgcaggaaagcggcggagggtccgtccaggctggtggctctctgcgcctttcctgcaccgcctctggggctatcgcctccggctacattgattctcgctggtgcatggcatggttccgccaagctcctggcaaggaacgcgagggagtggccgcgatttggcccggtgggggtctgactgtctacgcagactctgtaaagggtcgcttcacaatttccagagatcacgcgaagaataccctctacctccagatgaacaatctcaagcccgaggacactgccatgtactattgcgccgctggatctccgcgcatgtgccctagtctggaatttggcttcgattactggggccagggtactcaggtgacagtgtctagc

SEQ ID NO: 1400 - DNA, 777 bp, synthetic construct
  source 1..777: mol_type = other DNA; note = Description of Artificial Sequence: Synthetic polynucleotide
caggtgcagttgcaggagtcaggaggtggcagcgtccaggcaggaggtagcttgcggctctcctgcgttgcgtccggctatgtgagttgtgactattttctcccatcttggtatcgtcaagcgccaggtaaggaacgtgaatttgtgtccatcattgatggaactggctccactagctacgccgcgagcgtgaagggccgcttcacggcctctcaggataaggggaagaacatcgcatacctccagatgaactccttgaagccagaggataccgccatgtattactgcaaggcctcctgcgtccgtggtcgggcgatctccgagtactggggccagggaactcaggtgacagtcagctctggtggcagcggagggtccggcggaagcggacaggtgcagctccaggaaagtggagggggaagcgtgcaggcagggggcagcctgcggctgtcttgtaccgcatccggggccattgcttccggctatattgattccagatggtgcatggcttggtttaggcaagcgcctggcaaagagcgtgaaggtgtcgccgcaatctggccgggcgggggtctgacagtgtacgccgactctgtgaagggtagattcacaatcagccgcgaccatgctaaaaacactttgtacctccagatgaataacctgaagcctgaagacaccgccatgtattactgcgctgccggaagccctcgcatgtgccccagcctggagtttggcttcgattactggggccaggggacccaggtgacggtgagcagc

SEQ ID NO: 1401 - DNA, 741 bp, synthetic construct
  source 1..741: mol_type = other DNA; note = Description of Artificial Sequence: Synthetic polynucleotide
caggtacagttgcaagagagcggaggcggttctgtgcaggctggaggcagccttcgcctgtcctgcgtggcctctggatacgtgtcatgtgactacttcctgccgagttggtatcgccaggctcctgggaaggagcgggagttcgtgagcattatcgacggcacaggcagtacgtcctacgcggccagcgtgaaaggtaggttcactgcttcccaggataaaggcaaaaacatcgcgtacttgcagatgaactcactgaagcctgaggacacagccatgtattactgtaaggccagctgtgtgcgtggccgcgctatctctgagtactgggggcaaggcactcaggtcactgtcagcagtggtggaggtagccaggtgcagctccaggagtcaggaggcgggtccgtgcaggctggtggcagcctgcgcctcagctgcaccgctcccggcttcacttctaacagctgcggcatggactggtataggcaagccccagggaaggagcgcgagttcgtttccagtatctccaccgatggaaccacgggctatgctgattccgtgaaaggacgtttcactattagcaaggacaaggcgaaagacactgtgtatctccagatgaactctctgaagcctgaggataccggcatgtatagctgtaaaacaaaagatgggaccatcgcaactatggaactttgtgacttcggctattggggccagggtactcaggtaaccgtgtcctct

SEQ ID NO: 1402 - DNA, 759 bp, synthetic construct
  source 1..759: mol_type = other DNA; note = Description of Artificial Sequence: Synthetic polynucleotide
caggttcagttgcaagaaagtggtgggggcagcgtgcaggcgggaggcagcttgaggctgagctgcgtggcatccggctacgtttcctgtgattactttctgccctcctggtatcgccaagcgcctggaaaagagagggagttcgtttctattatcgacggcacaggctccacgagttatgcggcctctgtcaagggacgctttactgcttcccaagacaaggggaagaatatcgcctatctccagatgaactctctgaagcctgaagacaccgctatgtattactgcaaggccagctgtgtgagaggtcgcgctatctccgagtactggggacaaggcactcaagtaacggtgtcatccggtggctctggaggctccggcgggtctggccaagtccagttgcaggaatctggtggagggtctgtccaggcaggaggcagtctgcgcctgtcatgtaccgcgcccggatttaccagtaatagctgcggaatggattggtatcgccaggctcctggcaaggaaagagagttcgtctcttccatcagcactgacggcactacaggctacgccgattctgtgaaagggcgcttcacaatctccaaggacaaagctaaggataccgtgtatctgcaaatgaatagtctgaagcctgaggatacaggaatgtactcctgtaagaccaaggacggcaccatcgctacaatggagctgtgcgactttggctactggggccagggcacccaagtgaccgtctcttca

SEQ ID NO: 1403 - DNA, 756 bp, synthetic construct
  source 1..756: mol_type = other DNA; note = Description of Artificial Sequence: Synthetic polynucleotide
caggtgcagctccaggagagtggtggagggagcgtgcaggctggaggctccctgcgtcttagctgcgttgccagcgggtacgtctcctgcgactactttctgccgtcctggtatcgtcaagcccctggtaaagaaagagagttcgtctccatcattgatggaacaggcagcacatcctatgcggcctccgtgaagggccgctttaccgcaagccaagataaaggtaagaatatcgcctacctccagatgaacagtttgaagcccgaggatacagccatgtattactgtaaggccagttgtgtgcgcgggagagccatcagcgagtactggggccagggcacacaggtgactgtatcttccggcggtggctcccaggtgcagctgcaagagagcggaggcgggtccgtgcaggccggaggtagcctgcgcctgtcatgcgcggcctccggttacccttactccaacggctacatggggtggtttagacaggctccaggtaaggagcgggagggggtcgccacaatctacacgggtgatggcaggacttactatgccgactcagtgaaaggcaggtttaccattagtcgcgacaacgccaagaacacagttgaccttcagatgtcctcactgaagcctgaagacaccgccatgtattactgcgctgcacgcgccgctccgctgtactccagcggctccccattgactcgcgcacgctacaatgtgtgggggcaaggaacccaggtgacggtgtcctct

SEQ ID NO: 1404 - DNA, 774 bp, synthetic construct
  source 1..774: mol_type = other DNA; note = Description of Artificial Sequence: Synthetic polynucleotide
caggtgcagctccaagagtcaggcgggggttccgttcaagccggtgggagcctgcgcctgtcatgtgtggcatctggatacgtgtcttgtgactacttcctgccatcctggtatcggcaggcccctgggaaggagcgcgaatttgtgtctatcattgatggaaccggatctacaagctacgccgcatccgttaaggggaggttcacagcctcccaggacaagggaaagaacattgcatacctccagatgaactccctcaagcccgaggatactgctatgtattactgtaaggccagttgtgtgcgtggacgcgccatctccgagtactggggccagggaacccaggtgaccgtgtccagcggtggcagcggcggttccggcggatctggacaggtgcagctccaggagtctggaggcgggtccgttcaggctgggggcagcttgcgtttgagttgcgccgcttccggctacccttactctaacggttacatgggctggtttcgccaagcaccgggcaaggaacgggaaggtgtcgctacgatttacaccggcgacggacgcacatattacgcggatagcgtgaaggggcgcttcacaatctctagggacaacgcgaagaacactgtggacctccagatgtcaagcctgaagcctgaggataccgccatgtactattgcgccgctcgtgctgcgcccctgtattctagcggcagccctcttactcgggcacgctacaacgtgtggggtcaaggcacacaggtgaccgtctcctcc

SEQ ID NO: 1405 - DNA, 729 bp, synthetic construct
  source 1..729: mol_type = other DNA; note = Description of Artificial Sequence: Synthetic polynucleotide
caggtgcagcttcaagaatcaggtgggggatctgtgcaggcaggcgggtcacttcgcctgtcctgcgtggcctccggctatgtctcttgtgattacttcctgcctagctggtatcgccaggctccaggcaaggagagagagttcgtgagcatcattgacgggacgggctccacttcttacgccgcaagcgtcaaggggcgcttcaccgcgtcccaggacaagggaaagaacatcgcgtacttgcagatgaactccctgaagccagaagacacagctatgtattactgtaaggcgtcttgcgtccgtggccgtgcaatctctgagtactggggccagggcactcaggtgactgtcagctctggcggtggcagtcaggttcagcttcaggaatctggcgggggctctgtgcaggcaggcggtagcctgaggttgtcctgtgtggcttccgcttctacctactgcacctacgatatgcactggtatcgtcaggcccccggtaaagggcgcgagtttgtgtctgctattgattctgacggcaccacacgttatgccgactctgtcaaaggcaggttcacaatctctcaaggtactgctaaaaacacggtataccttcaaatgaactctctgcaacctgaagatacagcgatgtattactgtaagactgtgtgcgttgtgggtagcagatggagcgactactggggccagggtacacaggtgacagtctcttct

SEQ ID NO: 1406 - DNA, 747 bp, synthetic construct
  source 1..747: mol_type = other DNA; note = Description of Artificial Sequence: Synthetic polynucleotide
caggtccagcttcaggagtctgggggcggttctgtgcaggctgggggctctctccggctgagctgtgtggcaagcggttatgtgtcatgcgactactttctgcccagctggtatcgccaagctcccggcaaggagagggagttcgtgtctattatcgacgggacaggctccaccagttacgcggcctcagtgaagggacgtttcactgcatctcaagacaagggcaagaacatcgcctacctccagatgaatagcctgaagcctgaggacacagctatgtattactgtaaggcctcctgtgtgcgcgggcgtgctatcagcgaatactggggtcaggggactcaagtcacggtctcctcaggagggtccgggggcagcggagggtcaggccaggtgcagttgcaggaatctggaggcggtagtgttcaggccggtggctctctgcgcctgtcctgcgtcgcgagtgcatctacgtactgtacctacgatatgcactggtatcggcaagcccctgggaagggccgtgagtttgtcagcgccattgattctgacggcactacccgctacgcagatagcgttaaaggccgctttactatcagtcagggcaccgccaagaacaccgtctacctccagatgaactctctccagcccgaggataccgccatgtactattgcaaaacagtgtgcgtcgtgggctcccggtggtccgactactggggccaaggcactcaagtgactgtttcttcc

SEQ ID NO: 1407 - DNA, 723 bp, synthetic construct
  source 1..723: mol_type = other DNA; note = Description of Artificial Sequence: Synthetic polynucleotide
caggtccagctccaggagtctggcgggggctccgtgcaagctggtggcagcctccgtctgagctgcgtagcctctggttacgtgtcatgcgactacttcctgccgtcctggtatcggcaggcccccggcaaagaacgtgagttcgtaagcatcattgatggtactgggagtacgtcctatgcagccagcgtgaagggccgctttaccgcaagccaggacaagggtaaaaatattgcttatcttcagatgaacagcctgaaacctgaagataccgcaatgtattactgtaaggccagctgcgtaaggggccgtgccatttcagaatactggggacagggtacacaggtgactgtgtcatctggcgggggtagccaggtgcagctccaggagtccggcggtgggagcgtgcaggcagggggctccctgaccctgtcctgtgcggccagcgagtacgcctatagcacctgtaatatggggtggtatcgtcaggcccctgggaaagagcgcgagctggtgtctgccttcatcagtgacggctccacttattacgccgactccgtcaagggccggttcaccattacccgtgataacgccaagaataccgtttacctccagatgaatagcctcaaacccgaggacaccgcgatttactattgctccgctaactgttaccgcaggctgcgtaactactggggacagggcactcaggtgactgtctcttcc

SEQ ID NO: 1408 - DNA, 741 bp, synthetic construct
  source 1..741: mol_type = other DNA; note = Description of Artificial Sequence: Synthetic polynucleotide
caggtccagctccaggagagcggcgggggttccgtccaggccggtggcagcctgcgtctctcttgtgtggcgagcgggtacgtcagctgcgattacttcctgccctcctggtatcgccaggcccctggtaaggagagggagttcgtgtctatcattgatgggactggatcaactagctacgctgcgtctgttaaagggcggtttactgcaagccaggacaagggcaagaacattgcctaccttcagatgaacagcctgaagccggaggacaccgccatgtattactgtaaggcctcttgtgtacgcggtcgcgccatctccgaatactggggtcagggtacacaggtgacagtcagctcaggaggttccggtggctccgggggttccggccaggtccagttgcaggaatccggtggcggaagcgtgcaggctggtggctccctgacactgtcttgcgcagccagcgaatatgcttatagtacttgcaacatgggctggtatcgccaggcccccggcaaagaacgcgaactcgtgagtgccttcatctccgacggtagcacttattacgccgattctgtgaagggaaggttcactattacgcgcgacaacgccaagaacaccgtctacttgcagatgaactccctgaagcccgaagacactgccatctactattgctccgccaactgctaccgtcgcctgcggaactattggggacagggcacccaggtcactgtcagctcc

SEQ ID NO: 1409 - DNA, 744 bp, synthetic construct
  source 1..744: mol_type = other DNA; note = Description of Artificial Sequence: Synthetic polynucleotide
caagtgcagctgcaagagagtggaggtggctccgtacaggcaggcgggagcctccgcctcagctgcgtagccagcggctatgtcagttgcgactacttcctcccctcttggtacaggcaggccccaggcaaggaacgcgagtttgtgagcattatcgacggcacagggagcacgagttacgctgccagcgtcaaaggcagattcacagcctctcaagacaaagggaaaaacatcgcctacttgcagatgaactctctgaagcccgaggataccgccatgtattactgcaaggcctcttgtgtgcggggccgcgctatctccgaatactggggacaggggacccaggtgactgtgtccagtggaggtggctcccaagttcagctccaggagtccggtggcgggcttgtgcagccgggcggttccctgcgcctgtcctgcactgcatctggtctgactttcgacgattccgtaatgggctggttccgccaagcacctggcaaaggtcgcgaggctgtatcctgtatctctagctctggtgccaacgcattctacgctgactccgtcaaaggccgttttaccattagtcgcgataacgctaaaaacacactgtacctgcaaatgaactccctcaaaccggaagatactgccacctactattgcaagcgcgggcacgcctgtgcgggctattaccctatcccatacgatgactactggggccagggcacccaggtcactgttagctcc

SEQ ID NO: 1410 - DNA, 762 bp, synthetic construct
  source 1..762: mol_type = other DNA; note = Description of Artificial Sequence: Synthetic polynucleotide
caggtccaactccaggagtccggcgggggcagtgtgcaggctggcgggtctctgcgtctgtcctgcgtcgcgagcggctacgtcagctgcgactattttctgcctagctggtatcgccaggccccaggtaaggaaagagagttcgtgagcattatcgacgggacaggttccacctcctacgccgcgtctgtgaagggccggtttactgcttcccaggataaaggtaagaacattgcatatctgcaaatgaactctctgaagcccgaggacactgctatgtattactgtaaagcaagttgtgtgcgcggcagagcaatttctgaatactggggccagggcacccaggtgactgtgtccagcgggggcagtggtggcagtggaggtagcggccaagtccagttgcaggagagtggcggtggcctggtgcagccaggtggctccctccgtctgagctgcacagccagcgggctgacgttcgatgactctgtgatgggttggtttcgccaggctcccggcaagggccgcgaagctgtttcctgtatctcttcctctggcgcgaatgctttttacgccgactccgtgaaggggaggttcactatttccagagacaatgccaagaacactctgtaccttcagatgaactccctcaagcctgaagacaccgccacctactattgtaagcgcggccatgcctgtgccgggtactatcctattccttatgatgactactggggccagggcactcaggtgaccgtgtcctcc

SEQ ID NO: 1411 - DNA, 759 bp, synthetic construct
  source 1..759: mol_type = other DNA; note = Description of Artificial Sequence: Synthetic polynucleotide
caggtgcagctccaggagagcggcggtggctccgtgcaggccggtggctccctccgcctcagctgcgtggcctcaggttacgtcagctgcgattactttctgccaagctggtatcgccaagcgccggggaaggagcgcgagtttgtgtctattatcgacggaactggctccactagctatgctgccagcgtgaagggacgcttcacagcttcccaggataagggaaaaaacatcgcctacctccagatgaacaccctgaaacccgaggacaccgccatgtattactgcaaggcaagctgcgtgcgcggcagagctatctccgagtactggggccagggaacccaggttaccgtcagctcaggcggagggtcacaggttcagttgcaagaaagcggcggtgggagcgtgcaggctggtggaagcctgcgtctgtcctgcacagcatccggcgcaatcgctagtggatacattgatagccgctggtgcatggcctggttccgccaagctccaggtaaagagcgcgagggggtggcggccatctggcctggcggaggcctgactgtttacgccgactcagtgaaggggcgctttaccatctcacgggaccatgctaagaacaccctgtacttgcagatgaacaatctgaaacctgaggacaccgcgatgtattactgcgcagcgggctcacctcgtatgtgccctagcttggagtttggcttcgactactggggccaaggcacccaggtgactgtgagcagc

SEQ ID NO: 1412 - DNA, 777 bp, synthetic construct
  source 1..777: mol_type = other DNA; note = Description of Artificial Sequence: Synthetic polynucleotide
caagtgcagttgcaggagagtggtgggggctctgtgcaggccgggggttccctgaggctctcttgcgtggccagcggatacgtgtcctgtgactacttcctgccctcttggtatcgccaagcgccagggaaggaacgcgagttcgtgagcattatcgacggcactggttccacctcttacgcagcgtctgtaaagggccgtttcaccgccagccaggacaaggggaagaacatcgcttaccttcagatgaatacgttgaagcctgaggacactgcgatgtattactgtaaagcgtcttgcgttcgtggccgtgccatctccgaatactggggccaaggcactcaggtaactgtgtccagcggcggttccggtggctctggaggtagcggtcaggtgcagctccaggaatctggcggtgggagtgtgcaggctggcggtagtctccggctgtcctgtaccgccagtggagctattgccagcggatacattgattcccggtggtgtatggcatggttccggcaggcccccggcaaggaacgcgagggggtcgccgctatttggcccggaggcgggctgaccgtgtacgcggacagtgtcaagggccgcttcacgatcagtagggatcacgccaagaacaccctctacttgcagatgaataacctcaaaccagaggacactgcaatgtattactgcgccgctggcagcccgaggatgtgcccgtccctggagttcggcttcgactattggggtcagggcactcaggtcaccgtgtcctcc

SEQ ID NO: 1413 - DNA, 741 bp, synthetic construct
  source 1..741: mol_type = other DNA; note = Description of Artificial Sequence: Synthetic polynucleotide
caggtccagctccaggagagcggcggaggctctgttcaggctgggggcagcctccgcctgtcttgcgtggcctccggctacgtaagctgcgactacttcttgccttcctggtatcgccaggctccgggcaaagaaagggaatttgtatccattatcgacggcacgggtagcacttcctacgccgctagtgtaaagggtcggttcaccgcctctcaggacaagggcaaaaacatcgcgtacctccagatgaacacactgaagccagaggataccgccatgtattactgcaaggcttcctgcgtgcgcgggcgggccattagcgagtactggggacaaggaacccaagtgactgtgtccagcggtggaggctctcaggtccagctgcaagagtctggaggcggttcagtgcaggccggtggaagccttaggctgagctgcaccgcccctggatttacctctaactcttgcggcatggactggtatcgtcaggcccccggcaaggaacgcgagttcgtgtctagcatctccaccgatggcaccacaggctatgctgacagtgtgaaaggccgttttaccatctccaaggacaaagccaaggacacggtgtacctccagatgaactccttgaagcctgaagacacgggtatgtattcttgcaagactaaggacggcaccatcgctactatggagctgtgcgactttggttattggggacaggggacccaggtgactgtatcttct

SEQ ID NO: 1414 - DNA, 759 bp, synthetic construct
  source 1..759: mol_type = other DNA; note = Description of Artificial Sequence: Synthetic polynucleotide
caggtgcagctgcaagagtctggaggtgggtcagtccaggctgggggcagcctcaggctgtcctgcgtcgcttctggatacgtgtcctgcgactacttcctcccctcctggtatcgccaggccccaggtaaagaacgcgagttcgtgtccatcattgatggcaccgggtctacttcctatgctgcgtccgtgaagggccgttttaccgcttcacaggataaaggaaagaacattgcttacctccagatgaacacactcaagccggaagacaccgccatgtattactgtaaagcgagctgtgtccgtggcagagccatcagtgagtattggggccagggaactcaggtgaccgtgtcctctggaggcagcggcggtagtggtggctccgggcaagttcaacttcaggagagtgggggtgggtccgtgcaggctgggggttctctccgcctcagctgtaccgcgcccggcttcacctctaacagctgcggtatggactggtatcgccaagcgccgggtaaagagcgtgagttcgttagctccatctccaccgacggcaccacaggatatgccgatagcgttaagggacgctttactattagtaaggacaaggctaaggataccgtctacctccagatgaactctctgaaacctgaagacacaggcatgtactcctgtaaaaccaaggacggcaccattgctacaatggagctttgtgatttcggctattggggccagggtacacaggttaccgtgtcctcc

SEQ ID NO: 1415 - DNA, 756 bp, synthetic construct
  source 1..756: mol_type = other DNA; note = Description of Artificial Sequence: Synthetic polynucleotide
caagtgcagttgcaggagtccggcggaggttcagttcaggctggcgggtccctgagactgagttgtgtggcctccggctatgtgagctgcgactactttctgccttcttggtacagacaagcaccaggcaaagagcgggagttcgtgagtatcattgatgggaccggctccaccagctatgctgccagcgtgaagggtcgctttaccgcttctcaggacaaaggcaaaaacatcgcttacctccagatgaatacattgaagcctgaagacaccgccatgtattactgtaaggcatcatgtgtgcgtggccgcgccatttctgagtactggggccagggaactcaggtgacagtgtctagtggcggaggctcccaggtccagttgcaggagagcggcggtggatctgtccaggcgggtggcagcctccgtctgtcctgtgcggccagcgggtatccttattccaacgggtacatggggtggttccgccaggcccccggtaaggaacgcgagggcgtggccactatttacacaggtgacgggcgtacctattacgcagactctgtaaagggtcgcttcacaatttcccgcgacaacgccaagaacaccgtcgatctccagatgtctagtctcaaacctgaggacaccgccatgtattactgtgccgctcgcgccgcgccactttacagctctggttctcccctcacacgcgctcgctacaatgtttggggccaaggcacacaggtgaccgtgagcagt

SEQ ID NO: 1416 - DNA, 774 bp, synthetic construct
  source 1..774: mol_type = other DNA; note = Description of Artificial Sequence: Synthetic polynucleotide
caggtgcagttgcaggaatctggtggaggctccgtgcaggctgggggctccctgaggctttcatgtgtggcaagcggctacgtgagttgtgattactttctgccttcctggtatcgccaggcccctggcaaggagcgggaatttgtctcaatcattgatggtactggttccacttcttatgcggccagtgtgaaagggcgttttactgccagccaggataagggcaagaatattgcttacttgcagatgaacaccctgaagcccgaagataccgctatgtactattgcaaggccagttgtgtaaggggtcgggcgattagtgagtattggggccagggcacgcaggtcaccgtgtcatccgggggcagcggcgggtccgggggttctggccaggtgcagctccaggagagcggtggaggcagcgtgcaggccggtggaagccttcgtctgtcctgcgccgcttcaggctatccttactctaatggctacatgggttggtttcgccaagccccagggaaagagcgcgagggcgttgccacaatttacacaggtgatggaaggacctactatgcggacagcgtcaagggccgctttacaatcagccgtgataatgctaagaacaccgtcgatctccagatgtccagcctgaagcctgaggatactgctatgtactattgcgctgcccgcgcagccccactctacagctccggcagtcccctgacgagggctcgctataacgtgtggggtcagggcacacaggtcaccgtgtccagc

SEQ ID NO: 1417 - DNA, 729 bp, synthetic construct
  source 1..729: mol_type = other DNA; note = Description of Artificial Sequence: Synthetic polynucleotide
caggtgcaactccaggaatccgggggaggcagcgtgcaagccggtggctccctgcgcctgtcctgcgtcgccagcggctacgtcagctgcgactactttctgccctcctggtatcgccaggctcctgggaaagagcgcgagtttgtttccatcattgatggaaccggcagcacatcctatgccgcgagcgttaagggcagatttaccgcctctcaagacaagggtaagaacatcgcctacctccaaatgaacaccctgaagcctgaggacacggcaatgtattactgtaaagcaagctgtgtgcggggtcgggccatcagcgagtactggggtcagggcacccaggtcactgtaagctccgggggagggtcccaggtgcagctccaggagtcaggcggaggctccgtgcaggccggaggctccttgcgtttgagctgcgtggcgtctgcgtctacctactgcacttacgacatgcactggtatcgccaggctccggggaagggccgcgagttcgtgagcgctatcgactccgatggcacaactcgctacgccgacagcgtgaaggggcgttttaccatttcccagggcaccgccaagaacaccgtgtatctccagatgaactctctgcaaccggaggatacagctatgtattactgcaagacagtctgtgtggttggtagccgctggtctgactactggggccagggcacccaggtcacggtgtcctct

SEQ ID NO: 1418 - DNA, 747 bp, synthetic construct
  source 1..747: mol_type = other DNA; note = Description of Artificial Sequence: Synthetic polynucleotide
caggtgcagcttcaagagtctggtggcgggtccgtccaggcgggtggcagtttgagactcagttgtgtggccagtggctacgtcagctgtgactattttctgcctagctggtatcgccaggcacccggtaaagagagggagttcgtgagcatcattgatgggacagggtctacatcttatgctgcctccgtgaaagggcggttcacagcttcccaggataagggcaagaacattgcgtatctccagatgaacaccctcaagccggaggataccgcgatgtattactgtaaggcgtcttgtgtgcgcgggcgtgctattagcgagtattggggacaggggacgcaagtgacggtctcctcaggcgggtctggtggctctggcgggtccgggcaggtccagctccaggagtctggcggtggctccgtccaagccggaggcagcctccgtctctcctgtgttgcatcagcctccacgtactgcacctatgatatgcactggtatcggcaagcgcccggcaagggccgcgagtttgtgtctgccatcgacagtgatggtacaacgcggtacgctgatagcgtgaaaggccgcttcaccatcagtcagggcacggccaaaaacacagtgtatctccagatgaactctctccagcctgaagatacagccatgtactattgtaagacggtctgcgtcgtgggcagccggtggtccgactactggggccagggaacccaagtgactgtctcaagt

SEQ ID NO: 1419 - DNA, 723 bp, synthetic construct
  source 1..723: mol_type = other DNA; note = Description of Artificial Sequence: Synthetic polynucleotide
caggtgcagttgcaggagagcggcggaggctctgtgcaggcaggaggctcactgagactgtcctgcgtggcaagcggctatgtgagctgcgactactttctgccaagttggtatcgtcaggctcctggcaaagaaagggagtttgtgagcatcattgatggaaccggaagcacaagttatgcggcctccgtgaagggtcgcttcaccgcctcacaggataagggcaagaacattgcttacctccagatgaacacactcaagcctgaagacaccgcgatgtactattgtaaagcaagttgtgtgagaggccgcgccattagcgagtattggggccagggcactcaggtgaccgtcagctctggcgggggaagccaggtacaactccaggagagtggtggaggctcagtgcaggccgggggaagcctgaccctgtcctgtgccgcttccgagtacgcatacagcacttgcaacatgggctggtatcgccaagcccctggcaaagaacgggaactcgtgtccgccttcatctccgatggttctacctattacgctgatagcgtgaaaggacgcttcaccattacccgtgataacgctaagaacacagtttacttgcagatgaactctctgaagcccgaagacaccgccatttattactgtagcgccaactgttatcgcaggcttcggaattactggggacaggggacccaggtgacagtgagtagc

SEQ ID NO: 1420 - DNA, 741 bp, synthetic construct
  source 1..741: mol_type = other DNA; note = Description of Artificial Sequence: Synthetic polynucleotide
caggtgcagttgcaggagtctgggggcggtagcgtccaggctggcggatcactgcgcctgagttgtgtcgcgtccggctacgtcagctgcgactatttcttgccctcctggtatcgccaggcccctggcaaggaacgtgagttcgtaagcatcattgacggcactggtagcacttcctacgccgctagtgtgaaggggcggttcaccgcaagccaggacaaggggaagaacatcgcctacctccagatgaacacactgaagcccgaggacacggccatgtactattgcaaagcctcttgcgtgcgggggcgtgcgatctctgaatattggggccagggaactcaggtgaccgtgtctagtggtggcagtggtgggtccggcgggagcggtcaggttcagttgcaggagagcggcggtggctccgttcaggccgggggctctctgacgctgtcttgcgcggccagcgaatacgcttactcaacttgtaatatgggttggtatcgtcaggcacccggcaaggagcgggagctggtctccgctttcatcagcgacggctccacctattacgcagacagcgttaagggtcgctttactatcacgcgcgacaacgccaagaacaccgtgtacctccagatgaactctctgaaacccgaggataccgccatttactattgctctgctaactgctaccgcaggttgagaaattactggggccaaggaactcaggtgacggtctcaagc

SEQ ID NO: 1421 - DNA, 744 bp, synthetic construct
  source 1..744: mol_type = other DNA; note = Description of Artificial Sequence: Synthetic polynucleotide
caggtgcagctccaggaatctggcggtggctccgtacaggctggcggttccctgaggctctcttgtgtcgccagcggctacgtcagctgtgactatttcctcccttcttggtatcgtcaggccccagggaaggagcgcgagttcgtgtccattatcgacgggaccggaagcacctcctatgctgcatcagtgaaaggccggtttaccgcgtctcaggacaaaggaaagaacattgcatatctgcaaatgaacacactcaagccagaggacaccgctatgtactattgtaaggcctcctgtgtgagaggtcgcgcaatttctgaatattggggccagggaacccaggtgaccgtgtcctctgggggcggttctcaggtccaacttcaggaaagcggtggcgggctcgtgcaacccggtggcagccttcggctgtcttgtactgcctccggtttgacattcgatgactctgtgatgggatggtttaggcaggctcctggcaaaggccgcgaggcagtatcttgtatcagttcttccggcgctaacgcattttatgccgacagtgtgaagggccgtttcacaatctcccgcgataacgccaagaacaccctctacctccagatgaactccctgaagcctgaggacaccgccacttattactgcaagcggggtcatgcctgtgctggctattaccctattccatacgatgactactggggacagggcacccaagttaccgtgtctagc

SEQ ID NO: 1422 - DNA, 762 bp, synthetic construct
  source 1..762: mol_type = other DNA; note = Description of Artificial Sequence: Synthetic polynucleotide
caggtgcagcttcaggagtcaggaggtggctcagtgcaggctggtggcagtctgcgcctgtcctgtgtcgccagtggatatgtcagttgtgactattttctccccagttggtatcgccaagcgcccggtaaagagcgggagtttgtctcaatcattgacggcaccggcagcacctcctacgccgcttccgtgaagggtcgcttcaccgcgtcccaggacaaaggcaagaacatcgcgtatcttcagatgaacaccctcaagcccgaagatacagctatgtattactgcaaggcctcctgcgtgcggggacgcgcgatctctgaatactggggccagggcacacaggtcaccgtctcttcagggggttccggtggctccggtggctccggccaggtgcagttgcaggaaagcggtggcgggctggtgcagccgggcgggagtctccgcctgtcctgcacagcgtcagggctgacttttgatgactctgttatgggctggtttaggcaggctccgggtaagggcagagaggccgttagctgcatctcttccagcggggctaacgccttctatgccgacagcgtgaagggtcgcttcacaattagccgggacaacgctaagaacactctgtaccttcagatgaactccctgaagcccgaagatactgctacttactattgcaagagaggtcatgcttgcgccggatactatccaatcccttacgatgactactggggccaaggcacccaagttaccgtgtcttct

SEQ ID NO: 1423 - DNA, 786 bp, synthetic construct
  source 1..786: mol_type = other DNA; note = Description of Artificial Sequence: Synthetic polynucleotide
caggtgcagttgcaggaaagtggcggtggatctgtgcaggcaggcggaagtctgagactgagctgccgggccagcggttcaacttatagcaattactgtctgggttggttcaggcagattactggtaaggaacgcgaaggcgttgctgttatcaactgggttgggggaatgctgtactttgctgactccgttaagggcagattcactgtcagccaggaccaggccaagaataccgtgtacttgcagatgaacagcctgaagcccgaggatacagccatgtattactgtgctgccgagtcagcctcctctttctcatgtgggggatggcttacaaggcccgaccgcgttccatattggggccagggcacccaggtgactgtaagctccggtggaggcagtcaggtccagctccaggagagcggcggaggctctgttcaggctggaggtagcctgcgccttagctgcacagcctcaggtgccatcgccagcggttatattgattcacgctggtgtatggcctggtttcgccaggcccctgggaaggagagggaaggtgtggctgccatttggcccggaggcggtctgacagtctacgcagactccgtgaagggccgctttaccatcagccgggaccacgcgaagaacactctgtatttgcaaatgaataacctcaaacccgaggacaccgcaatgtactattgtgccgctggctctcctcgtatgtgtccatctctggagttcggctttgactactggggccaggggacccaggtgactgtgagtagc

SEQ ID NO: 1424 - DNA, 804 bp, synthetic construct
  source 1..804: mol_type = other DNA; note = Description of Artificial Sequence: Synthetic polynucleotide
caagtgcagttgcaggagtctggtggcggttccgtgcaggctggtggaagcctgaggctgtcttgtcgtgcatctggaagcacctattccaactattgtcttgggtggttcagacagatcactggcaaagagagagaaggggttgcggttatcaactgggtgggcggtatgctgtacttcgctgattccgtgaagggccgcttcacggtatcccaggaccaagcaaagaataccgtctatttgcagatgaacagcctgaaaccggaggataccgccatgtactattgtgcagccgagagcgccagctccttctcttgtggcggttggctgactcgtccagatcgcgtgccctactggggccaagggacccaggtgacagtcagctccggcggtagcggtggctctgggggctccgggcaggtgcagctccaggaaagtgggggcggttcagtgcaggcaggtggcagtctgcgtctgtcctgcaccgcaagcggcgcaatcgcttccggttatattgattctcgctggtgcatggcttggtttcgccaggcccccggcaaggaacgcgagggggtggcagccatctggccgggagggggactgaccgtttacgctgacagcgtgaagggccgcttcacgatcagtagggatcacgcgaagaacaccctttacctccagatgaataacctgaagccagaggacacagcgatgtattactgcgccgctggttctccccggatgtgtccatccctggagttcgggttcgattactggggccaggggacgcaagtgacagttagctcc

SEQ ID NO: 1425 - DNA, 768 bp, synthetic construct
  source 1..768: mol_type = other DNA; note = Description of Artificial Sequence: Synthetic polynucleotide
caggtacagctgcaagaaagcggcggagggtccgtgcaggctggcggttctcttcgtctgtcttgccgcgcctccggtagtacctactccaactactgcttgggctggttccgccagatcacaggcaaggagcgtgagggggtggccgtaataaattgggtgggcggtatgctgtatttcgcagattccgtgaaaggccgctttaccgtctcccaggaccaggccaaaaacaccgtgtacctccagatgaactctctgaagccggaggacacagcgatgtactattgtgctgccgaaagcgcttctagttttagctgtggcggttggctgacccgtcctgatcgcgttccatactggggacagggtactcaggtcaccgtgtcttccggcggtggctcccaggttcagctccaggaatctggcggtgggagtgtccaggctggaggtagtctgcgcctgtcatgtaccgcccccggttttacctctaactcttgcggtatggactggtatcgccaggctcccggtaaggagagggagttcgtcagctctatcagtactgacggcactacaggatacgccgactctgtgaagggccgtttcaccatctctaaggacaaggctaaagacaccgtctacctccagatgaacagtctcaagcccgaggacacgggtatgtattcctgcaaaacaaaggatgggactattgccacaatggagctttgtgactttggctactggggacagggaacacaggtgactgtctcaagc

SEQ ID NO: 1426 - DNA, 786 bp, synthetic construct
  source 1..786: mol_type = other DNA; note = Description of Artificial Sequence: Synthetic polynucleotide
caggtgcagttgcaggagtcaggaggtgggtccgtgcaggccggtggcagcctgcggctctcttgtcgggccagtggcagcacttatagtaactactgtctggggtggttccgccagatcactggtaaagagcgggagggggtggctgtcattaactgggtcggcggtatgctgtacttcgccgattccgtgaagggccgtttcacagtgtcccaagaccaggccaagaacacagtttaccttcagatgaacagcctgaagccagaggacaccgccatgtactattgcgccgcagaatctgcttctagcttcagctgcggcggttggctgacacgcccggaccgcgtgccgtactgggggcagggcacacaggtaaccgtgtcctctggcgggagtggcgggtccggcggtagcggccaagtccagctccaggagtcaggcggaggctccgtccaggctggtggcagcttgaggttgtcctgcactgctcctggttttacatctaactcctgcggcatggattggtatcgccaggctcccggaaaggagcgcgagttcgtgtcctctattagtaccgatggcactaccgggtatgccgactctgttaagggtcgtttcacaatcagtaaagataaggccaaggacacagtgtacttgcagatgaactcactgaaaccagaggatacaggcatgtatagctgtaagaccaaagacgggaccatcgcaactatggagctgtgcgatttcggctactggggccagggcacccaggtaaccgtcagctca

SEQ ID NO: 1427 - DNA, 783 bp, synthetic construct
  source 1..783: mol_type = other DNA; note = Description of Artificial Sequence: Synthetic polynucleotide
caggtacagttgcaggagtccggcgggggaagcgtgcaggctggaggtagcctgcgtctgagctgtcgcgccagcggctccacctactcaaactactgtcttggatggttccgtcagattactggcaaggagagggaaggggtcgccgttatcaactgggtgggcggtatgctgtacttcgccgactctgttaaaggccgtttcacagtgagccaggatcaggccaagaacaccgtctaccttcagatgaactctttgaagcctgaagatacggccatgtattactgtgcagccgagtctgcctccagcttctcctgcgggggctggctcacacgccccgaccgtgtgccttattggggacaggggacacaagtcactgtctcctctggagggggatctcaagtgcagctgcaagagtctggaggcggtagcgtgcaggctggcgggtccctcagactgagctgtgctgcctccggttacccctactccaacggatatatgggctggttccgccaggcaccaggcaaggagcgcgagggcgtggctactatctatacaggtgatggccgcacctattacgctgattccgtgaagggtcgcttcaccatcagccgcgacaatgctaagaacaccgtggaccttcagatgtctagcctcaagcctgaggacactgcaatgtattactgtgctgcacgggcagcgcccctttattcctctggctcccctctcacccgcgcacgttacaacgtatggggtcaaggcacccaggtgactgtctccagc

SEQ ID NO: 1428 - DNA, 801 bp, synthetic construct
  source 1..801: mol_type = other DNA; note = Description of Artificial Sequence: Synthetic polynucleotide
caggtccagctccaggagagtggtggcgggtcagtgcaggcgggaggctcactgcgtctgtcctgtcgggcctccggctccacttactctaactattgcttgggctggttcaggcagattacaggtaaggagcgcgaaggggtggctgttatcaactgggtagggggtatgctgtatttcgccgattcagttaagggccgtttcacggtgagtcaggatcaggccaaaaacactgtttatcttcaaatgaactccctgaagcccgaggacaccgcgatgtactattgcgcagccgagagcgcctctagcttcagctgtgggggttggctgacacggcctgaccgcgtcccttattggggccagggaacccaagtgaccgtgtctagcggaggctccggcggatctggaggttccggtcaggtgcagttgcaagagtccggcggaggctctgtgcaggcgggtggcagcctgcgcctgtcctgcgcggcctctggatatccgtacagcaacggctacatgggctggttcagacaagcaccggggaaagagagagagggcgtggccaccatctacaccggggacgggcgtacttactatgccgacagtgtaaaggggcgcttcactatctcacgcgacaatgcgaaaaacacagtggacctccagatgtcaagtttgaagccggaggacactgcaatgtattactgtgctgccagagccgcacctctgtactccagcggctctcctctgactcgtgcccgctacaacgtgtggggtcagggcactcaggtcacagtcagcagt

SEQ ID NO: 1429 - DNA, 756 bp, synthetic construct
  source 1..756: mol_type = other DNA; note = Description of Artificial Sequence: Synthetic polynucleotide
caagtgcagctccaggaatctggaggcggaagcgtccaggcgggcggttctctgcgtctgtcttgtcgggccagcggctctacttactctaattactgtctgggttggttccgccagatcactggtaaggagagagagggggtggccgttatcaactgggtcggcgggatgctgtactttgctgattcagtgaaaggccggttcacagtaagccaggatcaggccaagaacacagtttacctccagatgaactctttgaagcctgaggacaccgccatgtactattgtgcggcagaatccgcctctagcttcagctgtggcggttggctgacccgtcctgacagagtgccatactggggccagggcacccaggtgacagtgtcctctggcggaggctcccaggtgcagctccaggaatcagggggaggcagtgtgcaggcgggtggctccctgagattgtcctgtgtcgccagcgcgtccacctattgcacctacgatatgcactggtacagacaggcacccggaaagggccgtgagtttgtgagtgctattgattccgacggtacaactcgctacgcggattcagtgaaagggagattcacgatttctcaaggcacggccaagaatactgtgtacctccagatgaacagcctccagccagaagacacggctatgtactattgcaagaccgtgtgtgtggtcggcagcaggtggtccgactattggggccagggtacacaggtgaccgtgagcagc

SEQ ID NO: 1430 - DNA, 774 bp, synthetic construct
  source 1..774: mol_type = other DNA; note = Description of Artificial Sequence: Synthetic polynucleotide
caagtgcaactccaggagagcggcggtggctccgtgcaggcgggcggaagcctccgccttagttgcagagcgagcggcagcacctactccaactactgcttgggctggtttagacagattacgggcaaggaacgtgagggtgtcgccgtaatcaactgggttggcggtatgctctactttgctgactccgttaagggacgctttactgtttctcaggatcaggcgaagaacaccgtctaccttcagatgaactccctcaaacccgaggacaccgctatgtactattgcgcagccgaatctgcaagctctttctcatgcggtgggtggctgacccgcccggaccgtgtgccttactggggccaggggacacaggtgaccgttagctccgggggctccgggggttcaggtggatctgggcaggttcagctgcaagagtcaggtgggggctctgtccaagccgggggatctctgagactgtcatgcgtggcctccgcatcaacctactgcacctatgatatgcactggtatcgccaagctccgggtaaaggcagggagtttgtgagcgccatcgacagcgatggaacgacccgctacgccgatagcgtgaaggggagatttactatttcccaaggaacagccaaaaacacagtctaccttcagatgaactccctgcaacccgaagacacagccatgtattactgcaagacagtttgcgtggttggttcccgttggagcgactactggggccagggcacccaggtgactgtctcctct

SEQ ID NO: 1431 - DNA, 750 bp, synthetic construct
  source 1..750: mol_type = other DNA; note = Description of Artificial Sequence: Synthetic polynucleotide
caggtccagctgcaagaatcaggcggtgggtccgtgcaagctggtggatctctccgtctgtcttgccgcgcttctggaagcacttattcaaattattgcctgggctggtttaggcagattactgggaaggagcgcgagggcgtcgccgtgataaattgggtcggtgggatgctgtatttcgcggacagcgtgaagggccggttcacagtctcccaagatcaggctaagaacacagtgtacttgcagatgaactccctgaagccagaggacactgccatgtactattgcgcggctgaaagcgcctcttccttctcctgtgggggctggctcacacgcccagatcgcgtaccatactggggtcagggcacacaggtgaccgtgtcatctggtggcgggagccaggtgcagctccaggagtcaggaggcgggtccgtacaggctggtggctccctgaccctgtcttgcgctgcatcagagtacgcctactccacctgcaacatgggttggtatcgtcaggctcccggcaaagaaagggaactcgtgagtgccttcattagcgatggatcaacctattacgcggactccgtgaagggccgcttcaccatcacccgcgacaacgcgaaaaatacggtctacttgcagatgaatagtctgaaaccagaggacacagccatctattactgctctgccaactgttaccgtcgcctgcggaattattggggccagggcacccaggtgactgtctcctct

SEQ ID NO: 1432 - DNA, 768 bp, synthetic construct
  source 1..768: mol_type = other DNA; note = Description of Artificial Sequence: Synthetic polynucleotide
caggtccagttgcaggagtccgggggtggctctgtccaagcaggtggcagcctgcggctgtcttgccgcgcgagcgggtccacttatagtaactattgcctgggctggtttcgtcagatcacaggcaaggagcgcgaaggcgtcgccgttatcaactgggtgggcgggatgctgtatttcgccgacagcgtgaagggacgttttacagtgtcacaggaccaggccaagaacaccgtctacctccagatgaactccctgaagcctgaagacactgccatgtactattgtgccgcagagtcagccagctccttcagctgcggcggatggttgacccgcccggacagggttccctactggggtcagggcactcaggttacggtgagcagtggtggctctggtggctctggaggctccggccaggtgcagcttcaggagagtggcggtggaagtgtgcaagcgggaggtagtctgaccctctcttgcgctgcctctgaatacgcatacagtacatgcaatatgggatggtatcgccaggcccctggcaaagagcgtgaactcgtgagcgccttcatctcagatgggagcacctattacgctgactctgtcaagggcaggttcacgattacccgcgataacgcaaagaacaccgtgtatttgcagatgaactccctgaagcctgaagacacagccatttattactgctccgccaactgttatcgcagactgcggaactattggggccagggcacccaggtcaccgtgtcttcc

SEQ ID NO: 1433 - DNA, 771 bp, synthetic construct
  source 1..771: mol_type = other DNA; note = Description of Artificial Sequence: Synthetic polynucleotide
caggtgcagttgcaggagtctggaggtggctccgtccaggctggtggctctctgcggctgagctgccgcgcgagtggcagcacctactccaactactgcctgggctggtttcgccagattacaggaaaggagagagagggagtggccgtcatcaactgggtgggcgggatgttgtatttcgctgacagtgtgaagggaagatttaccgttagtcaggaccaggctaagaacaccgtatacctccagatgaactctctgaagccagaggatacagccatgtactattgtgccgcagagtctgcctcctctttttcatgcggcgggtggttgactcgcccagacagagtaccatactggggccaggggacccaagtgaccgtctccagcggcgggggcagccaggtccagctccaggagtcaggtggcgggctggtccagcctggcggttctctgcgcctgtcctgcaccgccagtgggctcaccttcgatgactccgtgatgggttggttccggcaggctccgggtaagggacgtgaggctgtgtcctgtatttcttccagcggagccaacgcattttatgcggacagtgtaaagggtcgctttaccatcagtcgtgacaacgccaagaacaccctctatcttcagatgaactccctgaagccagaggatactgccacgtattactgcaagcgtggtcatgcgtgcgcaggctattaccccatcccctacgacgattattggggccaaggcacgcaggtgaccgtttcctcc

SEQ ID NO: 1434 - DNA, 789 bp, synthetic construct
  source 1..789: mol_type = other DNA; note = Description of Artificial Sequence: Synthetic polynucleotide
caggtgcagcttcaggagtccggtgggggcagcgtgcaagctggaggcagtctgaggctgagctgtcgtgcgtcagggtctacctactccaactattgtctgggctggtttcgccagatcactggtaaggagcgcgagggcgttgccgttatcaactgggtcggaggtatgctgtacttcgctgactccgtgaagggacgtttcactgtgagccaggatcaggccaagaacaccgtgtacctccagatgaacagcctgaagcctgaagataccgccatgtattactgtgcagccgaatccgcctcttcctttagctgtgggggctggctgactaggcctgaccgcgtgccttactggggccaggggacccaagtaaccgtcagctctggtggcagcggaggtagcggtgggagtggccaggttcagcttcaggagagcggtggaggtctggtgcagccagggggtagtctgcgccttagctgcactgcctccggtctgaccttcgatgacagtgtgatgggttggtttcgtcaggctccaggcaaggggcgcgaagcagtgtcttgtatcagctccagcggcgctaatgccttttacgccgattccgtgaaaggccgctttacgattagccgcgataacgccaagaacacactgtatttgcagatgaacagcctcaaacccgaagacacggccacctactattgtaagcggggtcatgcctgcgctgggtattacccaattccctacgatgactattgggggcagggcacccaggttactgtctcctcc

SEQ ID NO: 1435 - DNA, 768 bp, synthetic construct
  source 1..768: mol_type = other DNA; note = Description of Artificial Sequence: Synthetic polynucleotide
caggttcagttgcaggaaagcggaggtggcttggtgcagcccggtggctctctccgtctgtcttgcgcggccagtgggttcacattctccctgagcggaatgtcttgggtgcgtcaggccccaggcaaaggtctggaatgggttagcgcgatcagctctggtggcgcttccacctactatacggacagcgttaagggcagatttactatttctcgcgacaacgccaagaacatgctttacctccagttgaacagcctgaagaccgaagataccgctatgtattactgtgccaagggtgggtccggctacggcgatgcctcccgtatgacatcccctggcagccagggcactcaagtgaccgtgtccagcggcggtggcagtcaagtccagctccaggagtctgggggtggatctgtccaggccgggggctccctccgcctgagttgcactgcgagcggtgctatcgccagcggctacatcgactccaggtggtgcatggcctggttccgccaggctccgggaaaagagcgtgagggtgttgccgctatctggcccggaggcgggctgaccgtctatgccgactccgtaaagggccggttcaccatcagccgcgaccatgccaagaacaccctgtaccttcagatgaataacttgaaacctgaggacactgctatgtattactgcgcggctggtagccctcgcatgtgcccgagcctggaatttgggttcgattactggggacagggcacccaggtcacggtgtccagc

SEQ ID NO: 1436 - DNA, 786 bp, synthetic construct
  source 1..786: mol_type = other DNA; note = Description of Artificial Sequence: Synthetic polynucleotide
caggtgcagttgcaagaaagtggcgggggtctggtacagcctggaggctctctgcgcctctcctgtgctgccagcggctttacttttagcctgtcaggtatgtcctgggtccgccaggcccccggtaaaggtcttgagtgggtctccgctatttccagcggaggtgccagtacctattacaccgactcagtgaaaggacgtttcaccatttcccgcgataatgctaagaatatgttgtatttgcagctcaacagcctgaagacagaggataccgctatgtactattgcgctaaaggcggatctggttatggagacgcctcccgtatgacatcccctgggtctcagggaacgcaggtgaccgtgtctagcggcgggtctggaggctccggtggctccggccaggtccagctccaggaaagcggtggcgggtctgtgcaggcaggcggttccctgaggctgagctgcacagcctccggggcaatcgccagcggttatatcgacagcagatggtgcatggcctggttccgtcaggcccccggcaaagagagggagggagtggcggccatctggccaggaggcggactgaccgtgtatgccgactctgtgaagggtcgctttaccatcagcagagaccacgccaagaacaccctgtacttgcagatgaataacctcaagcccgaggacaccgcaatgtattactgcgccgcaggcagccctcgcatgtgtccgtctctggagttcggattcgattactggggccaggggacccaggtgaccgtttcctcc

SEQ ID NO: 1437 - DNA, 750 bp, synthetic construct
  source 1..750: mol_type = other DNA; note = Description of Artificial Sequence: Synthetic polynucleotide
caagtgcagctccaggagtcaggtggaggcctggttcagcctgggggaagtctgcgcctttcatgtgcagcttctggttttaccttctctctgagcggcatgtcctgggtccggcaggcaccgggcaagggcctggagtgggtgagtgccatctcatctggcggtgcgagcacctactataccgactctgttaaaggaaggtttaccatctcccgcgataacgctaaaaatatgttgtacttgcagctcaactcactgaagaccgaagacaccgctatgtattactgcgccaagggtggctccgggtacggcgatgcctcccgcatgaccagccccggtagtcagggcactcaggtcactgttagctccggcggtggctctcaggtccagctccaggagtctggtggaggctccgtgcaggctggcggttccctgagattgtcttgtactgcccccggcttcacaagtaactcctgtggtatggactggtatcgtcaagcgcctggaaaggagcgcgagttcgttagctccatttctaccgatgggaccactgggtatgcagacagcgtgaaaggtcgctttaccatctccaaggacaaggctaaggacaccgtgtacctccaaatgaactccctgaagcccgaggacaccgggatgtattcctgcaagaccaaggacgggaccatcgccactatggagttgtgtgacttcggatattgggggcagggcacccaagtgactgtgtctagc

SEQ ID NO: 1438 - DNA, 768 bp, synthetic construct
  source 1..768: mol_type = other DNA; note = Description of Artificial Sequence: Synthetic polynucleotide
caggtccagcttcaggagtctggcgggggtctggtccagcctgggggttctctccgcctgtcctgcgcagctagtggattcaccttctctctctccggtatgtcttgggtgcgccaggcccctggcaaggggctggagtgggtgagtgcaattagctccgggggagcaagcacctactatacagactcagtcaagggaagattcacaatttcccgcgataacgctaaaaacatgctgtatctccagctcaacagcctgaagacggaagacacggctatgtactattgtgccaaagggggcagcggctatggcgacgccagccgcatgacctctccgggcagccagggtacgcaggtgaccgtgtccagcggaggctccgggggctctggaggttcagggcaggtacagctccaagaatccgggggcggttctgtgcaggctggaggctccctgcgcctgagctgcacagctccgggctttacctccaacagttgcggaatggattggtacaggcaagcgcccggcaaggagagggagttcgtgtccagtatttcaaccgacggcacaaccggctacgcggattccgtgaaaggacgcttcaccatttccaaagacaaggccaaggacaccgtgtatttgcagatgaactcactgaagcccgaggataccggaatgtattcttgtaaaacgaaggatgggaccatcgctacaatggagctgtgtgactttggttactggggccagggcactcaggtcactgtctcttct

SEQ ID NO: 1439 - DNA, 765 bp, synthetic construct
  source 1..765: mol_type = other DNA; note = Description of Artificial Sequence: Synthetic polynucleotide
caggtgcagctccaggaaagcggtggcggtttggtgcagcctgggggctccctgcgcctgtcttgtgcggctagtggcttcaccttctctctgtccggcatgagctgggtgcggcaagcgccgggcaagggcctcgaatgggtgagcgcaatcagctctggaggcgcatcaacctactataccgattcagtcaagggaaggtttaccatctccagagataacgccaagaatatgctgtacctccagctcaattcactgaagaccgaggataccgccatgtattactgcgctaagggtggcagcggatacggagatgcgtcccgcatgacaagccccggctcacagggcacacaggtgactgtgtcctcaggaggtggctcccaagtgcagcttcaggagagcggtggaggctccgtccaagctggagggtccctccgtctctcttgtgcagcttccggctatccttactccaatgggtacatgggatggttccgccaagctcctggcaaggagagggagggggtggctaccatctacactggcgatggccgcacctattacgccgacagcgtgaaaggacgtttcaccatttcccgtgacaatgcaaagaacactgtggacctccagatgtcaagcctcaagccagaagacaccgcgatgtactattgtgctgccagagcagcgcccctgtattcttcaggctctcccctgacacgcgcacgttacaacgtctggggccagggtactcaggtcaccgtgtctagc

SEQ ID NO: 1440 - DNA, 783 bp, synthetic construct
  source 1..783: mol_type = other DNA; note = Description of Artificial Sequence: Synthetic polynucleotide
caggtgcagctccaggaatccggcggaggcctggtccagcccggcgggtctctgcgcctgtcttgtgctgccagcggcttcaccttcagtctgagtggaatgagctgggtgcgtcaggctccaggaaagggcctggagtgggtgtccgccattagctctggaggcgcgtccacatattacaccgatagcgtaaaaggccgtttcactatctcacgcgacaacgctaagaatatgctgtatctccagctgaactccctgaaaaccgaggatacggccatgtattactgtgcgaaagggggttcagggtacggcgacgcatccaggatgaccagcccaggttcccaagggacccaggtgacagtgtcttccggcggaagcggaggctccggtggcagcggccaggtgcagttgcaggaatctggcggtgggagcgtgcaggctggcgggagcctgcgcctgagctgtgctgcgagcggctacccctattctaacgggtacatgggttggttccggcaggctcccggtaaagagcgcgagggagtggccacgatttacacgggtgatgggcgcacttattacgcagactccgttaagggccggtttaccattagtcgtgataacgcgaagaacaccgtggaccttcagatgtccagcttgaagccagaggacaccgctatgtattactgtgctgcacgcgctgcgcctctctacagtagcggctcccctctgacccgcgctcgctataacgtgtggggccagggcactcaggtgacagtaagctcc

SEQ ID NO: 1441 - DNA, 738 bp, synthetic construct
  source 1..738: mol_type = other DNA; note = Description of Artificial Sequence: Synthetic polynucleotide
caagttcagctccaggagtctggaggcggtctcgtgcagcccggtggctccctccgcctgtcttgcgccgcgagcggcttcaccttctctttgagcggaatgagctgggtcaggcaggctcccggcaaaggcctggagtgggtgtccgccattagtagcggcggagcctctacctattacaccgattctgtgaagggtcgtttcaccatttctcgcgataacgcaaagaacatgctgtacctccagctgaactctctgaagaccgaggatactgcaatgtattactgcgccaaaggcggtagtggttacggtgacgccagcaggatgacctccccaggatcacagggaacccaggtcaccgtcagctctggtggaggcagccaggtgcagttgcaggaaagcggcggaggcagtgtgcaggccggagggtctctgaggctctcttgcgtcgccagcgcctccacttactgcacttatgacatgcactggtatcggcaagctcctgggaagggccgtgaatttgtgagcgctatcgacagcgacggcaccactaggtatgctgattctgtgaaagggaggtttaccatttcccagggcaccgccaagaacacggtgtatctccagatgaactctctccagccggaagacactgccatgtattactgtaagaccgtgtgcgtggtcggatctcgctggtctgattattggggccagggaacccaggtgacggtttcttcc

SEQ ID NO: 1442 - DNA, 756 bp, synthetic construct
  source 1..756: mol_type = other DNA; note = Description of Artificial Sequence: Synthetic polynucleotide
caggtccagttgcaggagtccggcggagggctggtacagcccggcggaagcctgcgcctgagttgcgccgcgtctggatttactttctctctctctggtatgagctgggtgcgccaggctcccggcaagggacttgagtgggtaagcgcaatctcctctggcggggcgagcacctattacaccgacagcgttaagggcaggttcacaattagccgtgacaacgctaagaatatgctttatcttcagctgaacagcctgaagactgaagacacggccatgtattactgtgccaagggcggttccggctacggagacgctagtcgcatgacctccccaggctcccagggcacccaggtcaccgtgtctagcggaggctctggcggtagtggtggctccggtcaggtgcaacttcaggagagtggcggtggctccgttcaagctgggggttccctgcgtctgtcttgtgtcgctagtgcgtccacttattgcacctacgacatgcactggtatcgtcaagcgccgggcaagggaagggagttcgtcagcgccattgattccgacggcaccactcgctacgccgactctgtcaagggacgcttcaccatctcccagggcactgccaaaaataccgtgtatttgcagatgaactcacttcagccagaggacactgccatgtattactgcaagaccgtctgcgtcgtgggcagcaggtggtctgattactggggccaaggcacccaggtgaccgtcagcagc

SEQ ID NO: 1443 - DNA, 732 bp, synthetic construct
  source 1..732: mol_type = other DNA; note = Description of Artificial Sequence: Synthetic polynucleotide
caggtgcaacttcaggaatcaggcgggggactggtgcagccaggtggctctctgcgcctcagctgtgcggcctctggctttaccttctctttgagcggtatgagttgggtgcgccaggctccgggaaaaggtctggagtgggtctctgccatctcttccggcggtgcctccacgtactataccgactccgtgaagggccggtttaccatttccagggacaacgccaagaacatgctttatctccagctgaactctctgaagacagaagataccgccatgtactattgcgccaaaggtggctccggttacggcgacgcgagccgcatgactagccctggctcccagggaacccaggtcacagtgtcctctggcggtggctctcaggtccagctccaggagtctggtggcgggtccgtgcaggccggtggctccctgaccctgtcttgtgctgccagtgagtatgcgtacagtacctgtaatatgggttggtacaggcaagcgcccggcaaggaacgcgagctggtctccgcttttatctccgacggaagcacctattacgcagactcagtgaagggtcgtttcaccatcacccgtgataatgctaaaaacactgtgtacctccagatgaatagtctgaagcccgaggataccgctatttattactgctccgccaactgttaccgtcgcctgagaaactactggggacaaggcacccaggtaaccgtcagctct

SEQ ID NO: 1444 - DNA, 750 bp, synthetic construct
  source 1..750: mol_type = other DNA; note = Description of Artificial Sequence: Synthetic polynucleotide
caggtgcagttgcaggagtctggcggaggtctggtacagcctggtggcagcctccgcttgagctgcgcggccagtggcttcactttttccctgtcaggcatgagctgggtgcgtcaggctcctggcaaaggactggagtgggtgtccgctatctcctctggaggcgcatccacttattacaccgattctgtcaaaggtcgtttcaccatttcccgcgataatgctaagaacatgctgtatttgcagttgaactccctgaagacagaggacaccgctatgtattactgcgctaagggtggcagcgggtatggggatgccagccgcatgacaagccccggctcccagggtacacaggtcaccgtctcctcaggaggcagtggaggtagcgggggctccggccaagtccagctccaggagtccgggggtggatctgtccaggccgggggcagtctcactctgtcctgtgccgcttcagagtacgcctatagtacctgtaacatgggctggtataggcaggctcccggcaaggagagagaactggtcagcgcgtttatctccgacggcagtacctactatgctgactctgtgaagggacgttttaccatcacccgcgacaacgccaagaataccgtctacctccagatgaactctctcaaaccggaggacaccgccatctattactgctctgcaaactgttatagaaggctgcgtaactactggggacaaggcacgcaagtgacagtgtcctca

SEQ ID NO: 1445 - DNA, 753 bp, synthetic construct
  source 1..753: mol_type = other DNA; note = Description of Artificial Sequence: Synthetic polynucleotide
caggtgcagttgcaggagagcggtggcggtctcgtgcagccaggtggctctctgcggctgagttgcgctgcctctggcttcacattctctctgtccggcatgtcttgggtgcgccaggctccgggtaaagggctggagtgggtgagcgcaatctcctctggaggtgcatccacctattacaccgactctgtgaagggtcgctttacgatctcccgcgacaacgcaaagaatatgctttacctgcaactgaactccctgaaaacagaggacacggccatgtactattgtgccaagggcgggtctggctacggcgacgcttccaggatgaccagtccgggctctcagggcacccaggtgacagtctctagcggtgggggctcccaggtccagcttcaggaaagcggaggtggccttgttcaaccgggcggttcacttcgcttgagctgcacagcttcaggtctgaccttcgacgattctgtcatgggctggtttaggcaggcccctgggaagggcagagaagcggtgtcttgtatcagttcctcaggggccaacgctttctatgcagactccgtgaagggacgttttacaatttcacgcgataatgccaagaacacattgtacctccagatgaactccctgaaacccgaggacactgctacatactattgtaaacgcggccacgcttgtgcaggctactatcccatcccttacgatgactactggggtcagggaacccaggttaccgttagctcc

SEQ ID NO: 1446 - DNA, 771 bp, synthetic construct
  source 1..771: mol_type = other DNA; note = Description of Artificial Sequence: Synthetic polynucleotide
caggttcagctccaggagagcggaggtggcctggttcagcctggtggcagcctgcgcctgtcttgcgctgccagcggttttacctttagtttgtccggtatgtcatgggttcgtcaagctcctggcaagggtctcgaatgggtgtccgcgatttcctcaggaggtgcctctacttattacaccgatagtgtgaagggtcgctttactatctctcgcgacaacgcgaagaacatgctgtacctccaactgaacagcctgaagactgaagataccgcgatgtactattgcgcgaagggaggctctgggtatggagatgcctcccgtatgacatctcctggctctcaaggcacccaggtgaccgtctccagcggcggttccgggggctcagggggatctggccaggttcagttgcaggagtccggcggtggcctggtccaaccgggcgggagcctgaggctgtcctgcactgcgagcgggttgacattcgacgatagcgtgatgggttggtttcgccaggctcccggaaagggtcgggaggccgtcagctgtatctccagcagtggggctaatgccttctacgccgattccgttaaagggagatttaccatctcacgggataacgctaagaacacgctgtacttgcagatgaacagtctcaagccagaggacacagcgacttactattgtaaacgcggacatgcctgtgccgggtactatcctattccctacgatgactattggggtcagggcacccaggtgaccgtatcttct

SEQ ID NO: 1447 - DNA, 759 bp, synthetic construct
  source 1..759: mol_type = other DNA; note = Description of Artificial Sequence: Synthetic polynucleotide
caggttcagttgcaagagtccggcggtggaagcgtccaggccgggggtagtcttcggctgtcatgcgtggcgagtggctatgtgtcttgcgactattttctgccgagctggtatcgccaggctccaggtaaggaacgcgagttcgtgagcatcattgatggcacaggttcaacatcctacgctgcgtccgtgaagggacggttcaccgcgagccaggacaagggtaagaacatcgcttacctccagatgaactccctgaagccggaggacaccgccatgtactattgtaaggcttcctgtgtgcgcggcaggggaatcagtgaatactggggccaaggaacacaggtgactgtcagttccggtggcggaagccaggtgcagttgcaagagtccgggggcggttccgtgcaggctggtggctccctgagactctcttgtaccgcttcaggtgctattgccagtggatacattgattcccgctggtgcatggcctggttccgccaggcccccggcaaggagagggaaggagtcgccgctatctggcctgggggtggcctgaccgtgtatgctgatagcgtgaagggcagattcaccatcagccgcgatcatgctaagaacacactctaccttcagatgaataacctgaagcctgaggacaccgctatgtattactgcgcagccggttcccctcgcatgtgcccctctttggagtttggcttcgactactggggccagggcactcaggttaccgtaagctcc

SEQ ID NO: 1448 - DNA, 777 bp, synthetic construct
  source 1..777: mol_type = other DNA; note = Description of Artificial Sequence: Synthetic polynucleotide
caagtccagctccaggaatccggcggtggctccgtccaggcgggcggttccctcaggctctcctgcgtggccagcggctacgtaagctgcgattatttcctgccatcttggtatcgccaagcccctggtaaggagagagaatttgtctcaatcattgatggtacaggtagcacctcctacgcagcctcagtgaagggacgttttaccgcgagccaagacaaaggcaagaacatcgcgtatttgcagatgaactctctgaagccggaggataccgcgatgtactattgcaaagcctcctgtgtacgcggcaggggaatctcagagtattggggccagggcactcaagtgacagtcagctctggcgggagcggcgggtctggaggtagcggtcaggtgcaactccaggaatctggcggaggctctgtgcaggccggtggcagcctgcgtctcagctgcacagccagcggggccattgccagcggctacatcgactcccgctggtgcatggcttggttccggcaagcgccgggaaaggaaagagagggagtcgccgcgatctggccgggcggtggcctgactgtgtacgctgacagcgtgaagggtcgcttcaccatcagtcgggaccatgcgaaaaacacgctgtacttgcagatgaacaatctgaagcctgaggacactgccatgtattactgcgctgccggtagtccacgcatgtgcccgtctctggagttcggctttgactactggggccagggcactcaggtcacggttagctct

SEQ ID NO: 1449 - DNA, 741 bp, synthetic construct
  source 1..741: mol_type = other DNA; note = Description of Artificial Sequence: Synthetic polynucleotide
caggtgcaactgcaagaaagtggtggaggttccgtgcaagctggcggatctttgcgcctcagctgcgtggcctctggctatgtgagttgtgattacttcctgccttcttggtatcgtcaggcccctggtaaggaacgggagttcgtgtccattatcgacggcaccggatctacgagctacgctgcatccgtcaagggtcgttttaccgcttcccaagacaaaggcaaaaatattgcctacttgcaaatgaactctctgaaacccgaagatacagcaatgtattactgtaaagccagttgtgtgcgcggacgcggcatttccgagtattggggacagggcactcaggtgactgtctcatctggcgggggctcccaggtgcaacttcaggaatctggcgggggttctgttcaagcaggcggttctctgcgtctgagttgcaccgctcccggatttacctccaacagttgcggaatggattggtatcgccaggctcctggcaaggagcgtgagttcgtaagtagcatttcaactgatggtactaccggatacgctgactcagttaagggtcggttcactatcagcaaggataaagctaaggacacagtgtaccttcagatgaactccctgaagcctgaggacaccggaatgtactcctgtaaaaccaaagacgggaccatcgccacgatggaactgtgtgatttcggatattggggtcagggcacccaggtgaccgtgagtagc

SEQ ID NO: 1450 - DNA, 759 bp, synthetic construct
  source 1..759: mol_type = other DNA; note = Description of Artificial Sequence: Synthetic polynucleotide
caggtgcagcttcaagagagcggcgggggctccgtccaggccggtgggtccttgcgcttgtcttgtgtggccagcggatacgtgtcttgcgattatttcctgccctcttggtacagacaggccccaggcaaggagcgcgagttcgtatccatcattgacggcactggttctacaagttacgctgcatctgtgaagggccgctttaccgcctctcaggataagggtaaaaacatcgcttatttgcagatgaactcactcaagcctgaggacaccgccatgtactattgtaaggcctcttgtgtcagagggagaggcattagtgaatattggggtcaggggacccaggtgactgtgtccagcggcgggagcgggggcagcggtggcagcggccaggttcaacttcaggagagcgggggtggaagcgtccaagcaggcgggtccctgcgcttgagttgtaccgctccgggattcactagcaacagctgcgggatggactggtatcggcaggccccagggaaggagcgtgagttcgtcagctccatctctacagacggcacaaccggctacgccgacagcgttaagggcaggttcacaatcagcaaggacaaggccaaggataccgtgtatttgcagatgaacagcctgaagccagaggatacaggaatgtatagctgcaagactaaggacggcactattgcaactatggaactgtgtgattttggctactggggtcaaggcacgcaggtgaccgtgagttcc

SEQ ID NO: 1451 - DNA, 756 bp, synthetic construct
  source 1..756: mol_type = other DNA; note = Description of Artificial Sequence: Synthetic polynucleotide
caggtgcagctccaggagtccggtgggggctccgtacaggcgggcggttccctgcgcctttcttgtgtggccagcggttacgtgagctgcgactacttcctcccttcctggtatcgtcaagcccctggtaaagagagggagttcgtgtcaatcattgatggcaccggctctacctcttatgctgcctctgtgaaaggacgctttactgcttctcaggataagggcaagaatattgcttacttgcagatgaacagtctgaaacctgaggatactgccatgtactattgcaaggcctcctgtgtgcgtggccggggcattagcgaatactggggccagggaacccaggtcaccgtcagctctgggggtggctctcaggtgcagctgcaagaatccggcggtggctccgttcaggctggcggttccctgcggctgtcctgtgcagcctccggctacccgtactccaacggctatatgggctggtttcgccaggcccctggcaaagagcgcgagggagttgccaccatctacaccggggatggccgcacttattacgctgactctgtgaaagggcgcttcactatcagccgggataacgccaagaataccgtggacctccaaatgagttccctcaagccggaagacactgcaatgtactattgcgcggctcgtgcagctccactgtactcctctggctctcccctgacccgcgcacgttataatgtctggggccagggcacccaggtgaccgtctcaagt

SEQ ID NO: 1452 - DNA, 774 bp, synthetic construct
  source 1..774: mol_type = other DNA; note = Description of Artificial Sequence: Synthetic polynucleotide
caggtgcagctgcaagaatctggcgggggctccgtgcaggcagggggtagcctgaggctgagctgcgtggctagtggctacgtctcctgcgactactttctgcccagctggtatcgtcaggcacctgggaaggaacgcgagttcgtatccatcattgatggcactggctctaccagctacgcagcctccgtgaaaggacgcttcactgcgagccaggacaagggcaagaacatcgcctacttgcagatgaactccctgaagccggaagacaccgccatgtattactgtaaggcttcttgtgtacgcgggcgcggtatctctgaatattggggccagggcactcaggtgacggtgtccagcggaggtagcgggggctccggcgggagcgggcaggttcagctccaggagtctgggggtggctccgtgcaggccggaggctccctgcgcctgtcctgcgccgcttcaggttacccttattctaacggttatatgggttggttccgtcaagcgcccggcaaagaaagggagggtgtggctaccatttacactggtgatggtcgcacctactatgctgattccgtgaagggccgtttcaccatctctcgcgataacgctaagaataccgtggacttgcagatgagttctctgaaacctgaagataccgccatgtactattgtgccgcacgcgccgctccgctctactctagcgggtctcccctgacgagggctaggtacaacgtgtggggacagggcacccaggtgaccgtgtccagc

SEQ ID NO: 1453 - DNA, 729 bp, synthetic construct
  source 1..729: mol_type = other DNA; note = Description of Artificial Sequence: Synthetic polynucleotide
caggtgcagttgcaggaaagcggcgggggcagcgtccaggctgggggaagtctccgcctgtcctgcgtggccagtggctacgtcagctgtgactattttctgccgagctggtacaggcaggcccctgggaaggagcgggagttcgtgtctatcattgatgggaccggctccaccagctacgcggcctccgtgaaaggacgtttcacggccagccaggataagggaaagaatatcgcttacctccagatgaactctctgaaacctgaggatactgccatgtattactgcaaggcctcatgtgtgcgcggacgcggcatctcagaatattggggtcagggaacccaggtgactgtcagttctggaggtggctcccaggtacagctccaggagtccggtgggggctccgtgcaagcagggggttctttgcggctttcctgtgtagccagcgcctctacctactgcacctacgacatgcactggtatcgccaagcgccgggcaaaggccgcgagtttgtctctgccattgattccgatggtacaacccgttatgcagattccgtgaagggcagattcaccatcagccagggcacggcgaagaatacggtctacttgcagatgaactctttgcagcccgaggacacagccatgtattactgtaagacagtttgtgtggtaggttctcgctggtcagattactggggtcagggcacacaggtgacggtttctagt

SEQ ID NO: 1454 - DNA, 747 bp, synthetic construct
  source 1..747: mol_type = other DNA; note = Description of Artificial Sequence: Synthetic polynucleotide
caggtccagcttcaggagtctggcgggggttccgttcaggcaggcgggtccctcaggctctcttgtgtcgcctccggctacgtgtcttgcgactatttcctgccctcttggtatcggcaggctccgggcaaggagcgcgagttcgtgagcatcattgatggcacaggcagtacttcctatgcggcatccgtgaaagggcgcttcactgccagtcaagacaagggcaaaaacattgcatacctccagatgaactccctgaagcctgaagacacagctatgtattactgtaaggcgagttgtgtacgtggacgtggtatcagtgaatactggggccagggcacccaggtgaccgtgtcaagcggcggttctggcgggtcaggcggttccggccaggtgcagctccaggagtccgggggagggagcgtccaggctggcgggtctctgcgcctgtcatgcgtcgccagcgcatctacttactgtacctacgatatgcactggtatcgccaagcgcccggcaagggccgcgagtttgtctccgccattgattcagacgggacaacccggtatgccgatagtgtgaagggccgttttaccatcagtcagggcactgctaagaacactgtgtatctccagatgaacagtcttcagcctgaagatactgctatgtattactgcaaaactgtgtgtgtggttggatctcgttggagcgactattggggtcagggtactcaggtcacagtgtcttct

SEQ ID NO: 1455 - DNA, 723 bp, synthetic construct
  source 1..723: mol_type = other DNA; note = Description of Artificial Sequence: Synthetic polynucleotide
caagttcagttgcaggagtctggaggtgggtctgtgcaggctgggggctccctgcgtttgtcttgtgttgcgagcggctacgtctcttgtgactatttcctgcctagctggtatcggcaggcccccggcaaagaacgcgagtttgtgagcattatcgacggtactggctccaccagctatgcggcctccgtgaagggacgctttaccgcctcccaggataagggcaagaacatcgcgtacctccagatgaactcactgaagccagaggacaccgctatgtactattgcaaagcaagctgtgttcgcggtaggggaatttcagagtattggggccaaggaacccaggtcaccgtcagcagtggaggtggcagccaggtgcagctccaggagagtggcgggggttctgtgcaggccggaggctccctgaccctgtcttgcgccgcaagtgagtatgcgtactccacatgcaacatgggatggtatcgccaggctcccggtaaggagcgcgagctggtgagcgcttttatctcagacggctctacctactatgccgactccgtcaagggccgtttcacaatcacccgtgataacgccaagaataccgtctacttgcagatgaactctttgaagcctgaggacacagccatttactattgctctgcgaactgttaccgccgtctgcggaactattggggccagggcacccaggtgactgtgtcctcc

SEQ ID NO: 1456 - DNA, 741 bp, synthetic construct
  source 1..741: mol_type = other DNA; note = Description of Artificial Sequence: Synthetic polynucleotide
caggtgcagctgcaagagtccggcggtggcagtgtccaagctggcgggtccctgaggttgtcctgcgtggcatccggctatgttagttgtgactactttctgccctcctggtatcgccaggctcctggcaaggagcgcgaatttgtgtctatcattgatggcaccggcagcacttcttatgctgcatctgtgaaaggacggttcaccgcgagccaggacaagggtaagaatatcgcctacctccagatgaacagcctgaaacccgaggatactgccatgtactattgtaaggccagttgcgtgcgcggtcgtggcatcagcgagtattggggccaggggacacaggtgaccgtgtccagtggaggtagcggtggaagcggcggttccggccaggtccagctccaggagagcgggggaggctcagtgcaggccggaggcagcctgacactgtcctgcgccgcaagcgaatatgcgtacagcacctgcaacatgggctggtatcgccaggccccaggcaaggagcgtgaacttgtgtcagccttcatcagcgacggtagcacatattacgctgactcagtgaagggacgcttcacaatcaccagggataacgccaagaacacagtttacctccagatgaactccctgaagccagaggataccgctatttattactgttccgcaaattgttaccgtagactgcgcaattattggggacaaggcacacaggtgacagtgagttct

SEQ ID NO: 1457 - DNA, 744 bp, synthetic construct
  source 1..744: mol_type = other DNA; note = Description of Artificial Sequence: Synthetic polynucleotide
caggtccagttgcaggagtctgggggaggcagcgtccaggccgggggcagtctccgcctgtcctgtgtcgcgagcgggtacgtgtcttgcgattacttcctcccctcctggtatcgccaagcgccaggcaaggaacgcgagttcgtttccatcattgacggcaccggaagcacttcctacgctgcctccgtgaaggggcgtttcacagcgtcccaggataagggaaagaatatcgcttatttgcagatgaactctctgaagcctgaggataccgccatgtactattgtaaagcctcctgtgtgaggggtcgcgggatctctgagtactggggccaaggaactcaggtgacggtgtctagcggcggaggctcccaggtgcagctgcaagaatctggcggaggcttggtgcagccgggaggctcactgcgtctctcctgcaccgccagcggcctcacttttgacgatagcgtgatgggatggttccgtcaggcccctggcaagggccgtgaggcggtcagctgcatctcttccagtggtgccaacgctttctacgcagacagcgtgaagggtaggttcaccatcagcagagataacgccaagaacacgctgtatctccagatgaactccctgaagcctgaggacactgccacctactattgcaagcggggccatgcgtgtgctggctattacccaattccctacgatgactactggggccagggcacacaagtcacggtaagcagc

SEQ ID NO: 1458 - DNA, 762 bp, synthetic construct
  source 1..762: mol_type = other DNA; note = Description of Artificial Sequence: Synthetic polynucleotide
caggtccagctccaggaatcaggtggcggaagcgtgcaggctgggggctctctgcgcctgtcttgtgtggccagtggctacgttagctgcgattatttcctgccatcttggtacaggcaggcccctggcaaggagcgtgagttcgtctctatcattgatggaacaggttccaccagttacgccgcttctgttaagggccgcttcaccgcctcacaggataagggcaagaacatcgcttacctccaaatgaactccctgaagcccgaggacactgccatgtattactgtaaggcttcttgtgtgcgcggtcgcggcatttccgaatactggggacaaggaacccaggtaacagtgtcctctggaggcagtggaggctcagggggctctggtcaggtccaactccaggagagcggcggtggactggtgcagcccggtggctctctcaggctgtcctgtacggcgagcggcctcacctttgatgactctgttatgggctggttccgccaagcccctgggaaggggcgggaggctgtgagctgtatttcctctagcggggcgaacgctttctacgccgattcagtgaaaggccgtttcaccatcagtcgcgacaacgccaaaaacacgctgtacttgcagatgaactctttgaaaccagaggacaccgcaacttactattgtaaacgcggccacgcatgtgctggctattaccctatcccctacgatgactactggggccagggcacccaggttacagtgtcatct

SEQ ID NO: 1459 - DNA, 786 bp, synthetic construct
  source 1..786: mol_type = other DNA; note = Description of Artificial Sequence: Synthetic polynucleotide
caagtccagttgcaggaatccggcggtggatcagtgcaggcaggcggtagcttgaggctgtcttgtagagcgtccggttcaacttactccaactactgcctgggctggtttcggcagattacaggcaaggagcgcgagggagtggccgtgataaattgggtgggtggaatgctgtattttgccgactccgtgaagggccggttcaccgtgtctcaggaccaggccaagaacaccgtctaccttcagatgaactccctgaagcctgaggataccgccatgtattactgcgccgctgagagtgtcagctcttttagttgcggtggctggctgacccgccccgaccgtgtgccgtactggggccagggaacacaggtgacagtgagttccggtgggggctcccaagtgcaacttcaggagtctggcggtggcagcgtgcaggcagggggctctctgcgtctgtcatgcaccgccagcggagccatcgcctccggttacatcgactcccgctggtgtatggcttggtttcgccaggctcccggcaaggagcgtgaaggcgtggccgcgatctggcctggcgggggcttgactgtttatgctgactcagtgaagggtcgctttaccatctcccgcgaccacgcaaagaacaccctttatttgcagatgaataacctgaagccggaagacactgccatgtactattgcgcagctggctctccccgcatgtgtccgtctctggagttcggtttcgattactggggtcagggcactcaggttaccgtgtccagc

SEQ ID NO: 1460 - DNA, 804 bp, synthetic construct
  source 1..804: mol_type = other DNA; note = Description of Artificial Sequence: Synthetic polynucleotide
caggtgcagttgcaggaaagtggaggcgggtcagttcaggctggcggttccctgaggctgtcctgtcgtgcaagtggctcaacgtattcaaactattgccttggttggtttaggcagatcaccggcaaggagcgcgagggcgttgctgtcatcaactgggtcggcgggatgctgtactttgccgacagcgtcaagggcagatttaccgtctcccaggatcaggccaagaacacagtgtatctccagatgaactctttgaagcccgaagacacagcaatgtactattgtgcggctgaatctgttagctccttttcctgcggcggttggttgacgagaccggatcgggtcccgtactggggtcaggggacccaggtcacggtcagctccgggggcagcggcggtagtggaggctccggtcaggtgcagctccaggagagcgggggcggtagcgtgcaagcagggggcagtctgcggctgagctgtactgcgagcggagccatcgccagcggatatatcgacagccgctggtgtatggcctggttccgccaggctcccggaaaagagcgcgagggagtcgctgcgatttggccagggggcggattgacagtatacgccgactctgtgaaaggcagatttactatcagccgcgatcacgccaagaacactctgtacctccagatgaataacctcaaaccggaggacaccgccatgtattactgcgctgccgggtcccccaggatgtgtcctagtctggagttcggtttcgactactggggccaaggaacccaggtgaccgtctctagc

SEQ ID NO: 1461 - DNA, 768 bp, synthetic construct
  source 1..768: mol_type = other DNA; note = Description of Artificial Sequence: Synthetic polynucleotide
caggtgcagttgcaggagtcaggaggtgggagtgttcaggccggaggcagcctgcgcttgagctgccgggcgtctggcagcacctacagcaactattgcctgggttggttccgtcagatcaccggcaaggagcgggagggcgtggctgtcatcaactgggtgggtggaatgctgtattttgcggatagtgtgaagggacggttcacagtctctcaggatcaggcaaagaataccgtgtaccttcagatgaactccctgaagcctgaagacactgccatgtactattgcgccgctgagagcgtgtccagcttctcttgcggtggctggctcaccaggcctgaccgtgtgccttactggggccagggtacgcaggtgaccgtatctagcggcgggggttctcaggtccagttgcaggagtccggtggcgggtccgtccaggcgggcggtagcctgcggctgagttgcaccgctcctggatttaccagcaacagttgtggcatggactggtatcgtcaggcccccggaaaggaacgcgagttcgtgagcagtatctccacagacggcacgaccggctacgctgactccgtcaagggccgttttaccatctccaaagacaaagcaaaggatacagtgtatctccagatgaactcactgaagcccgaggacacgggtatgtatagctgcaagactaaggacggaaccattgccacaatggagctttgtgacttcgggtactggggacagggaacacaagtaacggtcagctcc

SEQ ID NO: 1462 - DNA, 786 bp, synthetic construct
  source 1..786: mol_type = other DNA; note = Description of Artificial Sequence: Synthetic polynucleotide
caggtccagttgcaggaatccggcgggggatcagtgcaggctggcgggtctctgcgcctctcatgcagagcctccggctccacctattctaactactgcttgggctggttcagacagatcaccggcaaagagcgcgagggcgttgcagtgataaattgggtgggtggaatgctgtattttgcagactccgtcaagggaaggttcaccgtgagtcaggatcaagccaagaacaccgtgtatctgcaaatgaactctctgaagcccgaggacaccgctatgtattactgtgcagctgaaagcgtgtcctctttctcttgcggaggctggcttactagacctgatcgtgtgccatattggggtcagggcacccaggtcacagtttcttccggtggctcaggcggatctggcgggtccgggcaggtacagctccaggagtctggtggcggttccgttcaggctgggggctccctgcgtctctcctgcaccgcgcccggcttcacaagcaactcctgcggtatggactggtatcgccaagcgcctggaaaagagcgcgagttcgtctctagcatttccactgacggtactaccggctacgccgactccgtgaaggggcgcttcactatttctaaggataaggcgaaggatactgtgtacctccagatgaactcactgaagcccgaggacactgggatgtatagttgcaagaccaaggatggcacaatcgccactatggaattgtgtgacttcggctactgggggcagggcacccaggtgacagtgtccagc

SEQ ID NO: 1463 - DNA, 783 bp, synthetic construct
  source 1..783: mol_type = other DNA; note = Description of Artificial Sequence: Synthetic polynucleotide
caggtccagttgcaggagtccggtggcggttccgtccaagccggaggctcactcagactctcttgtcgcgcctcaggaagcacttactccaactactgcctggggtggtttcgccagatcactggcaaggagcgggagggtgtcgcggtaataaattgggtcggcggtatgctgtatttcgcggactccgtgaagggccgtttcaccgtatcacaggaccaggccaagaacactgtgtatctccagatgaactcactgaagcccgaagatactgcaatgtattactgcgcggctgagagcgtgtcttccttctcttgcggcggatggctcacacggccagaccgtgtgccatactggggtcagggcacccaagttacagtctccagcgggggtggctcccaagtccagctgcaagagagcggcgggggctccgtgcaggctggaggttctctgcgtttgtcctgtgctgcctcaggatacccttatagtaacggttacatgggctggtttcggcaggctccagggaaggaaagggagggggtggctacaatttacaccggcgacggaaggacctattacgccgactctgtgaaaggtcgcttcaccatttcccgtgacaacgcgaagaatacagttgatcttcagatgtcttccctgaagcccgaggacacagcgatgtattactgcgctgcccgtgctgcccctctctacagctctggctctcccctgacccgcgcccgttacaacgtgtggggccaggggactcaggtcacagtctcatcc

SEQ ID NO: 1464 - DNA, 801 bp, synthetic construct
  source 1..801: mol_type = other DNA; note = Description of Artificial Sequence: Synthetic polynucleotide
caagtgcagctgcaagagagcggaggtggatctgtgcaggctggtgggtctctgcgcctctcttgccgtgcgtcaggctccacctactctaattattgcctcggttggttccggcagattacgggcaaggagcgcgagggtgtggcagttatcaactgggttgggggtatgttgtactttgctgactccgtcaagggacgtttcactgtgagtcaagaccaggctaagaacactgtgtacctccagatgaatagtctgaagcctgaggataccgccatgtattactgcgcagctgagagcgtgagcagtttttcctgtggcggatggcttaccagacctgatcgcgtgccgtactggggccaggggacccaggtgactgttagttctggaggcagcggaggctccggtggcagcggtcaggtacagctccaggaatctggtggcggtagcgtgcaggcagggggctctcttcgcctgagctgtgcagcttctggatacccatatagcaacggttacatgggctggtttcgccaagcccccggcaaggagagagaaggtgtggctaccatttataccggcgacgggcgcacttactatgcagactccgtcaaagggcggtttacaatctctagggacaacgccaagaataccgtcgatcttcagatgtcttccctgaagccggaggataccgccatgtattactgtgcggccagggctgcccctctctactcctctggatcacctctgactagggctcgctataacgtatggggtcagggaacacaggtcacggtgtcatct

SEQ ID NO: 1465 - DNA, 756 bp, synthetic construct
  source 1..756: mol_type = other DNA; note = Description of Artificial Sequence: Synthetic polynucleotide
caggttcagctccaagagagcggcggtggctcagtgcaggcaggtggctcacttaggctgagttgcagagcttccggctcaacatactccaactattgtctcggctggttcaggcagatcactggtaaggagcgcgagggggtggccgtcatcaactgggtgggtggaatgctgtactttgccgactctgtaaagggtcgttttactgtgtctcaggaccaggccaagaacacagtgtaccttcagatgaactctctgaagccggaggatacggcaatgtactattgcgctgccgagagtgttagttcattctcctgtggaggctggctgactcgcccggatcgtgtgccgtactggggccagggcacccaggtgaccgttagctccggcggtggctcccaggtgcagctgcaagagagtggtggaggctccgtgcaggcaggtggctcccttcgtctttcttgtgtcgcctctgcttcaacctactgcacatacgacatgcactggtatcgccaggcccctggcaaggggcgcgagttcgttagtgccatcgacagtgacggcactaccagatacgccgacagcgtcaagggccgcttcaccatcagccagggaacagctaaaaacaccgtctacctccagatgaactccttgcagccagaggacacagccatgtattactgcaaaactgtctgcgtcgtggggtccagatggagcgactactggggccaaggcacgcaggttaccgtgagcagc

SEQ ID NO: 1466 - DNA, 774 bp, synthetic construct
  source 1..774: mol_type = other DNA; note = Description of Artificial Sequence: Synthetic polynucleotide
caggtccagttgcaggagtccggcgggggttctgtgcaggctggaggcagcctcagactctcttgcagggcttctggatcaacttattctaattattgcctcggttggttccgccaaatcacaggcaaggagagggagggagtggcggtgattaactgggtgggcggtatgctgtacttcgccgactccgtgaaaggtcgtttcactgtctctcaggatcaggccaagaacactgtttacctccagatgaactctctgaagcccgaagatacggccatgtactattgcgctgccgaatccgtctcctctttttcctgcggaggctggctgacacgccccgaccgcgtcccctattggggtcaggggactcaggtcaccgtcagctctggcgggagcggaggcagcgggggcagcggccaggtccagcttcaggaaagcggaggtggctccgtgcaggctggcggaagcctgagactgtcctgcgtggcttcagcttccacctactgcacctatgacatgcactggtataggcaagcgccaggaaagggcagggagttcgtttctgctattgattctgacggaacaactagatacgcagactccgtcaagggaaggttcaccatctcccagggcaccgccaagaacactgtctacctccagatgaacagtctgcaaccagaagacaccgctatgtattactgcaagaccgtgtgcgtggtcgggtccagatggtccgattactggggccagggaacacaggtgactgtctcatct

SEQ ID NO: 1467 - DNA, 750 bp, synthetic construct
  source 1..750: mol_type = other DNA; note = Description of Artificial Sequence: Synthetic polynucleotide
caggtgcagctccaggaatctgggggaggttcagtgcaggcaggtggctccctgcgcctgagttgcagggcgtccggtagtacctactcaaactactgcctggggtggtttagacaaatcaccggaaaggaaagggagggcgtcgcagtgataaattgggtgggcggtatgctgtacttcgccgactctgtgaagggacgctttaccgtctcccaggatcaggctaagaacactgtgtatttgcagatgaactccctgaaaccagaggacacagccatgtattactgtgctgccgaaagcgtctctagtttttcctgcggagggtggcttacccgtcccgacagagttccttattggggccagggaacccaggtgacagtttcctctggtggcgggtctcaggttcagcttcaggagtctggcgggggctctgtgcaggctggcggatctctgactctgagctgcgccgcgagcgagtacgcctactcaacctgcaacatgggctggtatcgccaggcaccgggcaaggaacgggagctggtgtctgcattcatctcagacggttctacgtattacgccgactccgtgaagggtcgctttactattacccgcgacaacgctaagaacacggtgtacttgcagatgaacagcctgaagcctgaggatactgccatctattactgttccgctaactgctatagacgcctgcgcaattactggggacaggggacgcaagtgacagtgtctagc

SEQ ID NO: 1468 - DNA, 768 bp, synthetic construct
  source 1..768: mol_type = other DNA; note = Description of Artificial Sequence: Synthetic polynucleotide
caagtgcagttgcaggaatccggcggaggctccgtacaggccggtggatcactgcgcctgtcttgtcgggcctccgggtcaacctatagcaactactgtctgggctggtttcgtcagatcacaggtaaagagcgcgagggggtcgccgtcatcaactgggtgggcggtatgctgtacttcgctgacagtgtgaagggtcggttcaccgtttcccaggatcaagccaaaaacaccgtctacctccagatgaactccttgaagcccgaagacaccgccatgtattactgcgccgcagagagtgtgtcctctttctcctgcggtgggtggttgactaggccggaccgtgttccctactggggccagggaacccaagtgaccgttagctcagggggctccggtggctctggtggctctggtcaggtgcagctccaggagtctggaggcgggtcagttcaggctgggggcagtctgactctgtcctgtgctgcaagcgagtacgcttactctacctgtaacatgggttggtatcgccaggccccagggaaggaacgcgagcttgtgtcagcctttatctccgatggcagcacttattacgcagattccgtaaagggacgcttcaccatcacccgtgacaacgccaagaataccgtctacctccagatgaacagcctgaagccggaggacaccgccatctattactgctccgccaactgctaccggcgtctgcgcaactactggggccagggcacccaggtgaccgtttcatca

SEQ ID NO: 1469 - DNA, 771 bp, synthetic construct
  source 1..771: mol_type = other DNA; note = Description of Artificial Sequence: Synthetic polynucleotide
caggttcaactccaggagtccggcggagggtccgtgcaggctggaggttccctccggttgtcctgtcgtgcgtccggttccacctactcaaattattgtctgggctggttccgccagattactggcaaggaaagagagggcgtagccgtcatcaactgggttgggggaatgttgtacttcgccgacagcgtgaaaggccgctttacggtttcccaggaccaggctaagaacactgtataccttcagatgaactccctgaagccggaggacaccgctatgtactattgcgccgctgagtctgtctccagcttctcttgcgggggatggttgacccgccctgatcgcgtgccatactgggggcagggtactcaagtgacagtgtcctctggcggaggctcccaggttcagttgcaggagagcggcggtggactggttcagcctggtgggagtctccgcctgagctgcacagccagcggactgactttcgatgactcagtgatgggatggttcagacaggctccgggaaagggccgtgaggcggtcagctgtatctcctcttccggcgctaacgccttctacgctgattccgtaaagggacggtttaccatttctcgggataacgccaagaataccctgtatctccagatgaactctctcaagcccgaggataccgccacctattactgtaaaaggggccacgcatgtgctggatattacccgattccctatgatgactattgggggcaaggaacgcaggttaccgttagttct

SEQ ID NO: 1470 - DNA, 789 bp, synthetic construct
  source 1..789: mol_type = other DNA; note = Description of Artificial Sequence: Synthetic polynucleotide
caggtgcagctccaggagtccggtggcggttccgtccaggcaggtggctccctgcggctgtcttgtagggcttctggctctacctactccaactactgtctgggatggttccgccagatcacaggcaaggagagggagggcgtagcagtgattaactgggttgggggtatgctgtatttcgccgattccgtgaagggtcgcttcaccgtgtcccaggatcaggccaaaaacactgtttatttgcagatgaactccctgaagcctgaggacaccgctatgtattactgtgcagcggagtccgtgtcatccttctcctgtggtggctggctgactcgtccagaccgtgtgccttattggggacagggcacccaggtgaccgtgtcctcaggcggttccggtggctccggtggcagcggtcaggtgcagcttcaggagagcggtgggggcctggtgcagcccggaggttcactgagactgagctgcacggccagcggtctgaccttcgatgacagcgtgatgggttggttccgtcaagcgccgggcaagggacgcgaagcagtgtcctgtatcagttcctctggtgctaacgccttctatgctgacagtgtgaagggacgctttactatctcccgcgacaacgccaagaataccctgtacctccagatgaactctctgaagcccgaggataccgccacgtattactgtaagcgcggtcacgcctgtgcagggtactatcccatcccctacgatgactactggggccagggaactcaggtcacggtctcctca

SEQ ID NO: 1471 - DNA, 768 bp, synthetic construct
  source 1..768: mol_type = other DNA; note = Description of Artificial Sequence: Synthetic polynucleotide
caggttcagctccaggagagtgggggcgggctggtgcagcccggcggatcactccggctgtcctgtgccgcgagtgggtttacgttttcctcataccctatgtcctgggtccgccaggctccgggcaaaggactggaatgggtaagcacaattagctctgggggcgatacaactctgtatgcggactctgtaaaaggacgcttcaccagctctcgcgacaacgcaaagaatacactctacctccagcttaactctctgaaaacagaggacacagcaatgtattactgtgcaaagcgcattgattgcaattccggctactgctacaagcgctcttattgggggcaaggtacgcaggtgacggttagctccggcggaggctcccaggtgcagttgcaggaatccggcggaggctcagtgcaagcgggagggtccctgagactgagctgtactgcatccggggctatcgccagcggatacattgattcacggtggtgtatggcttggttccggcaagcccctggcaaggagcgcgagggcgtggcggctatctggcccggcggtggactgaccgtgtacgctgactccgtcaagggccgctttactatcagccgcgaccacgctaagaacacgctgtacctccagatgaacaatctgaagcccgaggacaccgctatgtactattgcgcagctggctcacctcggatgtgcccttcccttgagtttgggttcgattactggggccaaggcacccaggtgaccgttagcagt

SEQ ID NO: 1472 - DNA, 786 bp, synthetic construct
  source 1..786: mol_type = other DNA; note = Description of Artificial Sequence: Synthetic polynucleotide
caggtgcagctgcaagaatccggcggtggcctggtgcagccaggaggctccctgcggctgtcctgtgctgcgtctggcttcacctttagctcttatcccatgtcttgggtgcgtcaggctccgggaaagggcttggaatgggtgtccaccatttctagcggaggcgacaccactctctacgctgactccgtgaaagggcgcttcacctccagcagagacaacgctaagaacaccctgtacttgcagcttaattctctgaagaccgaggatacagcaatgtactattgcgccaagcggattgattgcaactccggctattgttacaagaggtcctattggggccagggaactcaggtaactgttagttcaggaggctccggtggatctggcggaagcggacaggtgcagcttcaggaatctggcggtggaagcgtccaggctggaggttccctgaggctcagctgcaccgcctctggtgccattgcgtccgggtacattgatagccgctggtgcatggcctggtttagacaagcgccaggcaaggaaagagagggtgtggcagccatctggccgggcggaggtctgactgtgtacgccgacagcgtgaagggccgtttcactatctctcgcgaccacgccaagaacactttgtatcttcagatgaacaatctgaagcccgaagatacagccatgtattactgtgcagccggtagccctagaatgtgccccagtctggagttcggcttcgattattggggtcagggtactcaggtcaccgtcagctct

SEQ ID NO: 1473 - DNA, 750 bp, synthetic construct
  source 1..750: mol_type = other DNA; note = Description of Artificial Sequence: Synthetic polynucleotide
caggtgcagcttcaagaatctggagggggcctggttcagccagggggttctctgcgtctgagctgtgccgcgtctggattcacattctcatcctatccaatgagctgggtgcgtcaggctcccggtaaagggctggaatgggtgtctactatctccagcggaggcgacactaccctgtatgcggacagcgtcaagggacgcttcacgtccagcagagacaacgccaaaaataccttgtacttgcagctgaacagcctgaagacggaggatacagctatgtactattgcgctaaaagaatcgactgcaactccggctactgttacaagagaagctattggggccagggtactcaggtcaccgtgtctagcggaggtggctcccaagtgcagttgcaggagtctggcgggggttccgtccaggctggtggctccttgcgtctttcctgtactgcgccggggtttaccagcaactcatgcggcatggattggtatcgtcaagcgcctggtaaggagagggaatttgtctcatccatctccaccgacggcacgaccggctatgctgacagcgttaaaggtcgttttaccatttctaaggataaggccaaggataccgtctacctccagatgaactctctgaagcctgaggatactggcatgtactcctgcaagactaaggatggcaccattgccacgatggaactgtgtgatttcgggtactggggtcaaggcacccaggttaccgtctccagc

SEQ ID NO: 1474 - DNA, 768 bp, synthetic construct
  source 1..768: mol_type = other DNA; note = Description of Artificial Sequence: Synthetic polynucleotide
caggtccagcttcaggaaagtggcggaggccttgtccaacctgggggttcactcagactgtcttgcgctgccagtggtttcaccttttcttcctaccccatgtcatgggtgcgccaggccccagggaagggattggaatgggtctccacaatctcctctggcggtgataccacactgtacgctgactctgtcaagggacgcttcacttccagccgtgataacgccaagaacaccctgtacttgcaactgaacagtttgaaaaccgaggataccgctatgtattactgcgccaagcgcattgattgcaactccggctattgttacaagcgcagctattggggccagggcacccaggtgactgtctcctctggtggctcaggcggaagcggaggctcagggcaagtacagctccaggagtcaggtggcggttccgtacaagccgggggcagcctgcgtcttagttgcaccgcaccagggttcacctctaacagctgcggaatggattggtacaggcaagcgcccggcaaggaacgcgagtttgtaagctccatctccaccgatggcacaaccgggtacgcagactctgtgaaggggcgcttcacgatcagcaaggacaaagcgaaggatactgtgtacctgcaaatgaactccctcaagcccgaagacaccggcatgtattcctgtaagaccaaggacggcaccatcgccactatggagctgtgcgattttggatactggggacagggcacccaggtgactgtctcctcc

SEQ ID NO: 1475 - DNA, 765 bp, synthetic construct
  source 1..765: mol_type = other DNA; note = Description of Artificial Sequence: Synthetic polynucleotide
caagtacagttgcaggagagcggtggcggactggtacagccaggcggttccctgcgcttgagctgtgctgcctccggcttcaccttctccagctaccctatgtcatgggtgcgccaggcccctggcaaaggtctggaatgggtctctaccatctcatctggaggggacacaaccctttatgcagacagcgtcaaaggacgtttcacttcttcacgggacaacgcgaagaacaccctgtaccttcagctgaactccctgaagactgaggataccgcaatgtactattgcgccaagcggattgattgtaattccggctattgttataagcgctcctattgggggcaggggacccaggtaactgtttcctcaggaggcggttcccaggttcagctccaggagtctggtggaggctccgtccaagccgggggctcactgcgcctgtcatgcgcagccagcggttacccctatagcaacggttatatgggttggttcaggcaggcccccggtaaagaacgcgagggcgtcgctaccatctacacgggcgacggcaggacttattacgccgactctgtcaaggggcgttttactatctctcgcgacaatgccaagaacacggtggaccttcaaatgtccagtctgaagccggaagacactgccatgtattactgcgcagcgcgtgcggcccctctgtattcctcaggcagccctctgacccgcgctcgctacaacgtgtggggccaaggcacgcaagtaactgtgtcctct

SEQ ID NO: 1476 - DNA, 783 bp, synthetic construct
  source 1..783: mol_type = other DNA; note = Description of Artificial Sequence: Synthetic polynucleotide
caggtgcagctccaggagtctggcggtggcctggtacagccgggaggctccctgcgcctgagctgtgcagcttctggcttcaccttctcttcctacccaatgtcctgggtgcgtcaggctcccggtaagggccttgagtgggtgtctaccatttcttccgggggtgataccacgttgtacgcagactccgtgaagggcaggttcaccagctctcgggacaatgccaagaacactctgtacttgcagctgaactctttgaagaccgaggataccgcaatgtactattgtgcaaagaggatcgactgtaactctggctattgttataagagaagctactgggggcagggtactcaggtgaccgtctcaagcggcggaagcggtgggtctggagggagtgggcaggtgcagctccaggagtctggaggcgggagcgtgcaggcaggcggtagcctccggctgtcatgcgccgcttccggttatccctatagcaacggatacatgggatggttccgtcaggctcccggcaaggaaagggagggtgtggccacgatctacacaggggatgggagaacttattacgccgactccgttaagggacgcttcactatcagccgcgacaacgctaaaaacactgtggaccttcagatgtccagcttgaagcctgaggataccgccatgtattactgtgcagctcgcgccgctcccctgtactcaagcggttcacccctcacccgcgctcgctacaacgtctgggggcagggcacacaggtgactgtgtcctct

SEQ ID NO: 1477 - DNA, 738 bp, synthetic construct
  source 1..738: mol_type = other DNA; note = Description of Artificial Sequence: Synthetic polynucleotide
caggtgcagttgcaagagagcggcgggggcctggtccagcctgggggctcactgcgtctctcctgcgccgcatctggatttaccttctcctcttatcctatgagttgggtacgccaggctcctggcaagggtttggagtgggtttccacaatctctagcggaggtgacactacactttacgctgatagcgtcaagggacgctttacctcatccagggacaacgctaagaacaccctctatctccagctgaactccctcaagactgaggatacagccatgtactattgcgctaaacgcatcgactgtaacagcggatactgctacaagcgtagctactggggccagggcacccaggttaccgtcagctctggaggtgggtcccaggtccagttgcaggaaagtggcggtggctcagtgcaagctggcggatctctgcgcctgtcctgtgtggccagcgcgtctacctactgtacctacgatatgcactggtacagacaagcgcctggtaaaggtagggagtttgtgagcgctatcgactccgatggaaccacgaggtatgcagactccgtcaagggaaggttcactatttcccagggcacagccaaaaacaccgtctacttgcagatgaacagcttgcagcccgaggacaccgcgatgtactattgcaaaacggtgtgcgtagtggggtcccgctggagcgactactggggccagggaactcaggtaacagtctcctcc

SEQ ID NO: 1478 - DNA, 756 bp, synthetic construct
  source 1..756: mol_type = other DNA; note = Description of Artificial Sequence: Synthetic polynucleotide
caggtccagctgcaagagtctgggggcggactcgttcagcctgggggcagcctgcggctcagctgtgcagcctccggcttcactttttccagctaccctatgtcttgggtgcgccaggctcccggtaagggcctggagtgggtgtccacgatttctagtgggggtgatacgaccctgtatgccgacagtgtaaagggtcgcttcacaagcagtcgtgacaacgctaaaaacaccctgtaccttcagctcaattccctgaaaacagaggacactgctatgtattactgcgcgaagcgtatcgactgtaacagcgggtattgctataagcgcagttattggggccagggcacgcaggtcaccgtgagttccgggggttctggtggcagcggcggttctgggcaggttcagcttcaggagagtggtggcgggtccgttcaggccgggggctctttgcggctgtcatgcgtggcgtccgcttctacctactgcacctatgatatgcactggtatcgccaagcgcccggcaagggtcgcgagtttgtcagcgccatcgactccgacggcacgactcggtacgccgactctgtcaaggggcggttcacgatctcccagggcaccgccaagaacacagtgtatcttcagatgaactctctgcaacctgaagatactgcaatgtactattgtaagaccgtgtgcgtggtcggctccagatggagcgactactggggtcagggcacccaggtgactgtgagtagt

SEQ ID NO: 1479 - DNA, 732 bp, synthetic construct
  source 1..732: mol_type = other DNA; note = Description of Artificial Sequence: Synthetic polynucleotide
caggtgcaactgcaagagtctggaggcggtctggtgcagccaggaggtagtcttcgtctgtcttgcgcggcctccggctttacattctccagctacccaatgtcctgggtgcgtcaggcccccggcaagggcctggagtgggtttctaccatctctagtggcggtgacacaaccctgtacgctgactctgttaaaggaagatttacctccagtcgcgacaacgccaagaacacactttacttgcaactgaactctctgaaaaccgaggacaccgccatgtattactgcgctaagcgtattgactgcaattcaggctactgttataagcgctcttactggggccagggcactcaggtcaccgtgtcttcaggcggtggctctcaggtgcagctccaggaaagcggtgggggctccgtccaagccggtggcagcctgacactttcctgtgctgcctccgaatacgcttactcaacctgtaacatgggctggtacagacaggctcctggcaaggaaagagagttggtgtccgctttcatctctgacggctccacttattacgccgactctgtaaagggcaggttcacgatcacccgcgacaatgccaaaaacaccgtctacttgcagatgaacagcctgaagccggaagacacagcaatctactattgtagcgcgaactgctatcggcgtctgcgcaactattggggccagggcacccaggtcaccgtctcctcc

SEQ ID NO: 1480 - DNA, 750 bp, synthetic construct
  source 1..750: mol_type = other DNA; note = Description of Artificial Sequence: Synthetic polynucleotide
caggtgcagctccaggaatctgggggcggtctggttcagccgggcggtagtctgcggctctcctgtgccgcaagcggttttactttctctagctatcccatgagttgggttcggcaggccccaggtaaagggttggagtgggtatctaccatcagctctggaggtgacactaccctgtacgccgactctgtgaagggccgtttcacctcttcacgcgacaacgcaaaaaatacgctgtacctccagctcaattcactgaaaactgaggacaccgctatgtattactgtgcgaagcgcattgattgtaacagcggatattgctacaagcgctcctactggggacaaggtacgcaggtgactgtctccagcggcggtagcgggggttctggaggttccggccaggtgcaactgcaagagtccgggggtggctccgtgcaggccggtgggtccctgactctgtcctgtgctgcatcagaatatgcgtattccacttgcaacatgggttggtacaggcaggctcccggaaaagagcgcgagctggtctccgccttcatcagtgacgggtctacctattacgcggacagtgtgaagggccgcttcaccatcacacgtgataacgccaagaataccgtgtatttgcaaatgaactctctgaaacccgaggacaccgcaatctattactgtagcgctaactgctaccgccgtctcaggaactattggggacagggcacgcaggtcacagtttcctcc

SEQ ID NO: 1481 - DNA, 753 bp, synthetic construct
  source 1..753: mol_type = other DNA; note = Description of Artificial Sequence: Synthetic polynucleotide
caggtacagcttcaagagtctgggggaggtttggtgcagcctggtgggtccttgcggctgtcctgtgccgcgagcgggtttacgttctcttcctatcctatgtcttgggtgaggcaagcgccgggcaagggccttgaatgggtgtccaccatctctagcggaggcgacacgaccctttacgctgactctgtgaagggacgctttacatcaagtagagacaacgccaagaatacactgtatttgcagctgaactccctgaagactgaggacactgccatgtattactgcgctaagagaattgactgcaactcaggctactgctacaagcgcagctactggggccagggaactcaggtgaccgttagctccggtggcggatctcaggtacagttgcaagagtcaggaggtggcctggtgcagcccggcggtagcctgcgtcttagctgtactgccagcggcttgacattcgatgactccgtgatgggttggtttagacaggcccctggcaaaggacgggaggctgtgagctgtatcagctcttcaggagctaatgctttctacgccgactccgtcaagggacgttttacaatctctcgtgataacgctaagaatactctgtatttgcaaatgaactctctgaagccagaggataccgctacctattactgcaagagaggccacgcctgcgcgggctattaccccattccttacgacgattactggggtcagggtacacaggtgaccgtcagttct

SEQ ID NO: 1482 - DNA, 771 bp, synthetic construct
  source 1..771: mol_type = other DNA; note = Description of Artificial Sequence: Synthetic polynucleotide
caggtacagttgcaggagtctggaggcggactggtgcaacccggaggcagcctgaggctgagctgcgcagccagcggatttaccttctcctcttatcccatgagctgggttcgccaagcgccaggtaaaggtctggaatgggtcagcacaatcagctcaggcggtgacactaccctgtacgcagactctgtgaaaggccggttcacctcttccagggataacgccaagaatacgctctacctccagctgaactccctcaagactgaagacaccgcgatgtactattgcgcaaagagaattgattgtaacagcggttattgttacaaacgtagctactggggtcagggcacccaggtcaccgtgtcttccgggggaagtggaggttctggtggctctggacaggtacagttgcaggagagcggcggtggcctggtgcagcctgggggaagcctgcggctgagctgcactgcgagcggtttgactttcgatgactctgttatgggttggttccgtcaggcccctggtaagggccgtgaggcggtttcctgcatctcttcatccggtgctaacgctttttatgcagactccgtgaagggtcgctttacaatcagcagggataacgcgaaaaacaccctctacctgcaaatgaactccctgaaacccgaagacactgctacctattactgcaagagggggcacgcctgcgctggctattaccctatcccttacgatgactactggggtcagggaacccaggtcaccgtgtcctcc

SEQ ID NO: 1483 - DNA, 768 bp, synthetic construct
  source 1..768: mol_type = other DNA; note = Description of Artificial Sequence: Synthetic polynucleotide
caagtgcagttgcaggaaagcggaggcggacttgttcagccagggggatctttgcgcctcagctgtgccgcttcagggtttacattctccctgtctagcatgagctgggtccgtcaggctcctggaaagggtctggaatgggtttccgccattagctccggcggtgcctccacttattacaccgacagtgtgaaaggccgctttacaatcagccgcgacaacgccaagaacatgctgtacttgcaactgaacagcctgaaaaccgaggacaccgccatgtactattgtgccaagggtgggtccggctacggcgacgcgagccggatgacctccccaggctcccagggcacccaggtcaccgtgagcagtggcggaggctcccaggttcagttgcaggagtctggagggggctccgtgcaggctggcggaagcctgcgcctgagctgcactgcctccggcgctatcgcttcaggatatattgattcccgttggtgtatggcctggtttaggcaggctcctggaaaggagcgcgaaggcgtggcagctatctggcctggcggtggcctgaccgtatacgcagatagtgtcaagggccgcttcactatctcccgcgaccacgcaaagaacacgctgtacctccagatgaataacctgaagcctgaggacaccgccatgtattactgtgccgctggctcacctcgtatgtgcccctccctggagttcggctttgactactggggccagggaacccaggtcaccgtctcttct

SEQ ID NO: 1484 - DNA, 786 bp, synthetic construct
  source 1..786: mol_type = other DNA; note = Description of Artificial Sequence: Synthetic polynucleotide
caggtgcagcttcaggagagcggaggtggcctggttcagcctggtgggtcactccgcctgagttgtgcggcctcaggatttacattctccctctccagcatgtcttgggttagacaagctcctggcaaaggtctggagtgggtatccgccattagctccggtggcgcttctacttactataccgacagcgtgaagggtcgcttcactatctcccgcgacaatgccaagaacatgctgtaccttcagctcaattctctgaagaccgaggacactgcgatgtactattgcgccaagggaggctctggttatggcgacgcatctcgcatgacctcccccggttcccaaggcacccaggtcacggtctccagcggaggcagtggcggttcaggcgggagcggacaggtgcagctccaggagtccggcgggggctctgtgcaggctggaggctcccttcgtctgagctgcactgcttccggggcaatcgcgagcggctacattgattctcgttggtgtatggcctggtttcgtcaggcacccggcaaggagcgcgaaggcgttgctgcaatttggccgggaggcgggttgacggtctatgcggactccgtgaagggccgcttcactatctcccgcgaccatgccaagaacacactgtatcttcagatgaataacctgaagcctgaggacactgcaatgtactattgtgccgcaggctctccccgtatgtgcccgtcactggaatttgggtttgactattggggccaaggcacacaagtaaccgtgtccagc

SEQ ID NO: 1485 - DNA, 750 bp, synthetic construct
  source 1..750: mol_type = other DNA; note = Description of Artificial Sequence: Synthetic polynucleotide
caggtccagctgcaagagtctggcggtggcctcgtgcagcccggaggcagcctgaggctcagctgtgccgcaagtggatttaccttttcactcagctctatgtcctgggtgcgtcaggctccaggaaagggactggagtgggtgtctgctatctcatctggaggggcgtctacatattacactgatagtgtgaaggggcggttcaccatcagtcgtgataacgcgaaaaacatgctgtacctgcaactgaacagtctgaagactgaggacaccgccatgtactattgtgcgaagggtggaagtggctacggtgatgcgtcaagaatgacctctcccggtagtcagggaactcaggtcactgtgtccagtggcggaggcagccaggtgcagctccaggaaagtggagggggttctgtccaggcagggggctccctgcgcctgagctgtaccgcccccggcttcacctccaactcctgtggaatggattggtacagacaggctcccggcaaggagagggagttcgttagctccatctctacagacggaaccactgggtacgccgatagcgtgaaggggcgttttaccatctccaaagataaagccaaggatactgtgtatttgcagatgaactccctcaagcccgaggataccggaatgtatagctgcaaaaccaaggacggtactatcgctacgatggagctgtgcgactttggctactggggccaaggcacccaggtgaccgtttctagc

SEQ ID NO: 1486 - DNA, 768 bp, synthetic construct
  source 1..768: mol_type = other DNA; note = Description of Artificial Sequence: Synthetic polynucleotide
caggtccagttgcaggagtccggcgggggcctggttcagccgggtggctctctgcgcctgagctgcgccgcttctggcttcactttctctctcagctctatgtcctgggtcagacaagcgccgggcaaaggtttggagtgggtgtctgctatttcatccggtggcgcgagtacctactataccgattccgtgaagggccgcttcactattagccgggacaatgctaagaacatgctgtaccttcagctcaattctctgaaaaccgaggacactgccatgtattactgcgctaagggaggttcaggatacggcgatgcctccaggatgactagcccaggcagccaagggacacaggtcaccgtttccagtgggggctccggcggttctggcggtagcggccaagtgcagctgcaagagtccggcgggggcagcgttcaagctgggggtagcctcaggctttcctgcacagctccaggtttcaccagcaacagttgcggaatggactggtatcgccaagcgccaggtaaggagagggagtttgtttccagcatctctaccgacggcaccacgggatatgctgattctgtgaagggacgctttaccatctctaaggataaagcgaaggacaccgtgtacttgcagatgaacagcctgaagcccgaggataccggcatgtatagctgcaaaactaaggacggaaccattgcgacaatggaactctgcgatttcggatactggggtcagggaacccaggtgactgtgtctagc

SEQ ID NO: 1487 - DNA, 765 bp, synthetic construct
  source 1..765: mol_type = other DNA; note = Description of Artificial Sequence: Synthetic polynucleotide
caggtccagctccaggaatctggcggagggctggtgcagccgggcggtagcctccggttgtcctgcgctgccagcggctttaccttttccctcagctccatgtcttgggtgcgccaggcacccggaaaaggattggagtgggtgtccgctatctcatccgggggagccagcacgtattacactgattccgtgaagggccgcttcaccatttctcgcgataacgctaaaaacatgctgtatttgcagcttaactccctgaaaacagaagataccgcgatgtattactgtgctaagggtgggtccggctacggcgacgcatctcgtatgaccagccctggcagccagggcacgcaggtcaccgtgtcaagcggaggcggttcccaggttcagttgcaggagagcggtggcggtagcgtgcaggctgggggttcccttcgcctctcttgcgcggcttccggttatccatacagcaacggctatatggggtggttcagacaggcacccggcaaggaacgcgaaggcgtggcaaccatctacactggcgacggacgcacgtactatgctgacagcgttaaaggccgttttactatcagccgcgacaatgcgaagaacaccgtcgatttgcagatgtcaagtctgaagccagaagacacagccatgtactattgcgctgcgagagccgctcccctctactctagcggcagccccctgacccgcgcacgttacaatgtgtggggccagggcacccaggtgaccgtctcctcc

SEQ ID NO: 1488 - DNA, 783 bp, synthetic construct
  source 1..783: mol_type = other DNA; note = Description of Artificial Sequence: Synthetic polynucleotide
caggtgcagcttcaagaatctggcgggggcttggtgcagcccggcggtagcctccggttgagctgcgccgcttcagggtttaccttcagcttgtcatccatgtcatgggtgcgccaggcccccggcaagggactggagtgggtcagcgccatcagtagcgggggagcgtcaacttattacactgactccgtcaagggtcgcttcacaattagccgggacaacgccaagaacatgctgtacctccagttgaactccctgaaaactgaggacacagccatgtactattgcgccaaagggggtagcggttatggcgacgcttcccgcatgacctctcccggctcccaaggcacccaggtcactgtaagctcaggagggagcggcggttccggtggcagcggacaggtccagctccaggagagtggaggcggatcagtgcaagccggtggctccctcaggctctcctgcgctgcgtctggctacccatatagcaacggctacatgggatggttccgccaggccccaggcaaagagcgggagggcgttgccaccatctacaccggggatggccgtacctattacgcagactccgtgaaggggaggtttaccatctctcgggacaatgccaaaaacacggtggacctccagatgagttccctgaagcccgaagacaccgccatgtattactgcgcagccagagccgctcctttgtactcctcaggtagccccctcacccgtgctcgctataatgtatggggacagggcactcaagtgaccgtgtcctcc

SEQ ID NO: 1489 - DNA, 738 bp, synthetic construct
  source 1..738: mol_type = other DNA; note = Description of Artificial Sequence: Synthetic polynucleotide
caggttcagcttcaggagtctggtgggggcctggtgcagccaggtggcagcttgcgcctgtcctgcgcggccagcggatttactttctctctcagctccatgtcttgggtgaggcaggctccaggtaagggcctggagtgggtttctgctattagctccgggggagcttccacatattacacagattctgtgaaaggtcgtttcacgatctctcgcgacaacgccaaaaacatgctgtaccttcagctgaacagcctgaaaaccgaagacacagctatgtactattgcgccaagggaggtagcgggtacggcgacgcctccaggatgacaagtcccggttcccagggcacccaggtgacggtcagctccggtggaggtagtcaagtccaacttcaggagtccggcggtggctccgttcaggctggcggttctctgcgtctgtcttgtgtggcgtccgcttccacctactgcacttatgatatgcactggtacaggcaagcgcccggtaaggggcgcgagtttgtttccgccattgattccgatgggaccactcggtatgcggacagcgtcaagggccgcttcactatctcacagggtacagccaagaacacagtgtacctccagatgaactcattgcaacccgaggacacggccatgtactattgtaagacagtctgcgtggtcggttccagatggtcagactactggggccaagggacccaagtcacagtctcctca

SEQ ID NO: 1490 - DNA, 756 bp, synthetic construct
  source 1..756: mol_type = other DNA; note = Description of Artificial Sequence: Synthetic polynucleotide
caggtgcaactccaggaaagtggcggtggccttgttcagcctggaggctccctgcggcttagctgcgctgcctccgggtttactttctcactgtcatctatgagctgggtccggcaagctccagggaagggcctggaatgggtcagcgctatctcttccggcggagcctcaacttactatactgactccgtgaagggccggtttaccatcagtcgcgacaacgctaagaacatgctgtaccttcagctgaacagcctgaagactgaagatactgctatgtactattgcgccaaaggcggttccgggtacggcgacgcctctcggatgacctctccgggttcccaaggcacccaggttaccgtgtccagtgggggctccgggggtagcggtggctctggccaggtgcagctccaggaatccggtggcgggtccgtgcaggctggagggtcactgcgcctgtcctgcgtggccagcgcctctacctactgcacatacgacatgcactggtacaggcaagctccaggtaagggtcgggagtttgtcagcgctatcgacagcgacggcacaactcgctatgcggatagcgtcaaggggcgttttaccatcagccaagggactgccaaaaacacagtgtatctccagatgaactctctccagccagaggatactgccatgtattactgcaagaccgtgtgcgttgtgggttcacgttggtccgactattggggccaaggcacacaggtgaccgtgtcctca

SEQ ID NO: 1491 - DNA, 732 bp, synthetic construct
  source 1..732: mol_type = other DNA; note = Description of Artificial Sequence: Synthetic polynucleotide
caggtgcagctccaggaatctggcgggggtctggtgcagcccggcgggtctttgcgcctctcatgtgcagcctctgggtttaccttctctctgtccagcatgtcttgggttaggcaggccccaggtaaggggctggagtgggtttccgccatctcatccggcggtgccagcacatattacaccgactccgtcaaggggagattcaccatcagccgggacaacgccaagaacatgctgtatctccagctcaactccctgaaaaccgaggacaccgccatgtattactgcgccaagggcggttccggctatggtgatgcttcaaggatgactagccccggttcccagggcacccaagtcactgtatccagcgggggaggctcccaggtgcagcttcaggagtctggcggtggcagcgtgcaggccgggggctccctgacactgtcctgtgccgcttccgagtacgcctattccacgtgtaacatgggatggtatcgccaggctcctggcaaggagcgcgagctggtcagcgcctttatctccgacggcagcacttattacgccgactccgtgaagggacgcttcacaatcactcgcgacaacgccaagaatactgtgtacctccagatgaacagcctcaagcctgaggataccgccatctattactgctctgctaattgctatcgtcggctgcgcaactactggggacaaggaacacaggtgaccgtgtcatct

SEQ ID NO: 1492 - DNA, 750 bp, synthetic construct
  source 1..750: mol_type = other DNA; note = Description of Artificial Sequence: Synthetic polynucleotide
caggttcaactccaggaaagcggaggtggacttgtgcagcctggcggttcccttcggctgtcctgcgctgcctctggcttcactttctcactctcatccatgagctgggtccgccaggcccccggcaaaggcctggagtgggtgagtgctatctcctctggcggagcttccacctactatactgactctgtgaagggccgcttcaccattagtcgggacaacgccaagaacatgctgtacttgcagctgaactcactgaagaccgaggacactgccatgtactattgcgctaagggaggctccgggtacggcgacgcctccagaatgacatctcccggctctcaggggacccaggtcacggtgtccagcggcgggtccgggggctccggcggatctggtcaggtacaacttcaggagtcaggcggaggcagcgttcaagccggaggctccttgacactgtcctgcgcggcctctgagtacgcatacagtacctgcaacatgggctggtatcggcaggcccccggaaaggagcgcgaattggtttctgctttcatcagcgatggatctacttattacgccgactctgtaaaaggtagattcactattactcgtgacaacgctaaaaacacggtgtatctgcaaatgaacagcctgaagcccgaggacactgccatttattactgttccgctaattgttaccgtaggctgcgcaattactggggtcagggtactcaggtcactgtatccagc

SEQ ID NO: 1493 - DNA, 753 bp, synthetic construct
  source 1..753: mol_type = other DNA; note = Description of Artificial Sequence: Synthetic polynucleotide
caagtccaactgcaagagtctggtggaggcttggtacagcccggagggagcctgcgcctctcctgcgcagcctctggcttcaccttctctctcagctcaatgtcctgggtgaggcaggcccccggaaagggccttgagtgggtgtctgctatctcctctggaggggccagcacctactatacagacagcgtcaagggcagatttaccattagtcgtgataatgctaaaaatatgctctacttgcagctgaactccctgaaaacagaggacaccgccatgtactattgcgccaagggcggttcaggatatggagatgccagtcgcatgaccagccccggtagtcagggtacacaagtgaccgtatctagcggcggaggctctcaggtgcagctccaggagtctggagggggcttggtgcagccgggaggctctctccgccttagttgtactgcctctggactgactttcgatgactcagtgatgggctggttccgccaggccccaggcaagggcagagaggccgtgtcttgtatcagcagtagcggggccaacgctttctatgccgactctgtcaagggccgtttcaccatctctcgcgacaacgctaagaataccctgtacctccaaatgaactccctgaaacccgaggacacagcaacgtattactgtaagagaggtcatgcttgtgcggggtattacccaattccctatgacgattactggggccaggggacccaggtaacagtaagctcc

SEQ ID NO: 1494 - DNA, 771 bp, synthetic construct
  source 1..771: mol_type = other DNA; note = Description of Artificial Sequence: Synthetic polynucleotide
caggtgcagttgcaggagtccggcggtgggctggtccagcctgggggcagcctgcgccttagttgcgccgcttccggcttcacctttagccttagcagtatgagctgggtgagacaggccccaggcaaggggctggagtgggtgtccgcaatttcttccgggggtgcgagcacctattacactgatagcgttaagggacgtttcaccatttctcgcgacaacgctaagaacatgctgtacctccagctcaacagcctgaagacagaagatactgctatgtattactgtgcaaagggaggcagcggctacggcgatgcgagccggatgaccagtccggggtcccagggcactcaggtcaccgttagctccggcgggtctggcggttccggcggttccggtcaagttcagctgcaagagagcggtgggggactggtgcagccgggaggctccctgcgcctgagttgcaccgcttccggtctgacctttgacgattccgttatgggctggtttcgccaagcccctggcaaggggagggaagctgtgtcctgcatttctagctctggcgctaacgccttctatgccgattccgtgaagggccgcttcacgatcagccgcgacaacgccaagaacaccctgtacctgcaaatgaactcattgaagcccgaggataccgccacctattactgcaaacgcggccatgcttgcgcgggctattacccgattccttacgacgattactggggtcaaggcacccaggtgacagtctcctcc

SEQ ID NO: 1495 - DNA, 786 bp, synthetic construct
  source 1..786: mol_type = other DNA; note = Description of Artificial Sequence: Synthetic polynucleotide
caggtgcagctccaggaatccggcggaggctctgtgcaggctggtggcagcctgaggctgagttgccgcgcttccggctccacttatagcaactactgtctgggctggtttcgccagacaaccggaaaagaaagagaaggcgtggccgtgattaactgggtcggcgggatgctctactttgccgatagtgtgaaaggtcgtttcacggtctcccaggaccaggccaaaaacaccgtctacctccagatgaactccctcaagcctgaggatactgcgatgtattactgcgccgctgagtccgtctcttccttctcctgcgggggctggctgacacgccccgacagagtcccttattggggccaaggaactcaggtaacagtgtcttccggtggcggttcccaggtacagcttcaggagtctggtggcggttctgttcaggccgggggctccctgcgcctgtcctgcactgcttctggcgctatcgcaagcggatatattgatagtcgctggtgtatggcatggttcagacaagcccctgggaaggagcgcgaaggcgtggcggccatctggccaggcggtgggctgactgtctacgctgacagcgttaaaggtcgcttcaccatctcaagagatcatgctaagaacactctctacctccagatgaacaatctgaagcctgaggacaccgccatgtattactgtgctgcgggaagcccccgcatgtgtcctagcctggagttcgggttcgactactggggtcaggggacccaggtcacagtgtccagc

SEQ ID NO: 1496 - DNA, 804 bp, synthetic construct
  source 1..804: mol_type = other DNA; note = Description of Artificial Sequence: Synthetic polynucleotide
caagtgcaactccaagaatctggaggtggctctgtgcaggcgggcggttccctgagactgtcttgcagagcaagcggcagtacttactctaactactgtttgggatggttccggcagacaaccggcaaagagagggaaggcgtggccgtaatcaactgggtgggtggcatgttgtacttcgcggatagcgttaagggccgcttcacagtttcccaggatcaggccaagaacaccgtgtacttgcaaatgaactctctgaagccggaggacaccgccatgtattactgcgctgccgagtcagtatcttcatttagctgtggcggatggttgactaggccggacagggtcccttactggggccagggcacacaggtgactgtgtcctctggcggaagcgggggttcaggaggctctgggcaggtgcagttgcaggagagcggcgggggctctgtccaggctggagggagcctcaggctctcatgcacagcctctggggctatcgcatcaggatatattgattctcggtggtgcatggcttggttcagacaggcaccgggaaaggagcgcgaaggtgtggcggccatctggcctggcgggggcctgaccgtgtatgccgattccgtgaagggtcgtttcaccatctcccgtgaccacgcgaagaataccctgtatttgcagatgaataacctgaagcccgaagataccgccatgtattactgcgctgccgggagcccacgtatgtgcccttctttggagttcggtttcgattactggggtcaggggacccaggtgaccgtctcctcc

SEQ ID NO: 1497 - DNA, 768 bp, synthetic construct
  source 1..768: mol_type = other DNA; note = Description of Artificial Sequence: Synthetic polynucleotide
caggtgcaactccaggagagcggcgggggcagtgtgcaggccggaggttccttgcgcctgtcttgtcgtgcgtcaggaagcacatacagcaactactgcctcgggtggttcaggcagactaccggcaaggaacgtgaaggtgtagccgtgattaactgggtgggcggaatgctgtacttcgcggactccgtgaagggccgcttcaccgtgtctcaggaccaggccaagaacaccgtttatctccagatgaactccctgaagccggaggacacggccatgtattactgcgctgccgagtccgtgtcttcattctcctgcggtggctggttgactcgccctgatcgcgtgccctattggggtcagggcacacaggtgacagtcagctctggtggaggttcacaggtccagctccaggagagtggcgggggtagcgttcaggccggaggctccctgcgcctgagctgtaccgccccaggctttacctctaatagctgtggaatggactggtatcgtcaggctcctggtaaggaacgcgagttcgtctctagcatctcaaccgacgggactaccggctatgcggactctgtgaagggtcgtttcaccattagcaaggacaaggccaaggacacagtgtaccttcagatgaactcactgaagcccgaggacactggcatgtatagctgcaaaactaaagatggaaccatcgccactatggaactgtgcgatttcggctactggggccagggcacgcaggtgaccgtgtcttcc

SEQ ID NO: 1498 - DNA, 786 bp, synthetic construct
  source 1..786: mol_type = other DNA; note = Description of Artificial Sequence: Synthetic polynucleotide
caggtgcagttgcaggagagtggtggaggcagtgtgcaggccggtggctctcttagactgagctgccgcgccagtggctccacctactccaactattgtctgggatggtttcgtcagaccactggtaaagagcgggagggggtggccgtcatcaactgggttgggggtatgctgtactttgctgactctgtcaaggggcggttcacagtctcacaggaccaagccaagaataccgtgtacctccagatgaacagtctgaagccggaggataccgctatgtattactgcgcagccgaatccgtcagctctttctcctgcggaggctggctcacgcgccctgacagggttccctactggggccaaggaacgcaggtgacagtttctagtggtgggtccggcggtagcggaggctccggccaggtgcagctccaggaatccggcggaggttccgtgcaggccggaggctccctccgcctgagctgcacagcccccggtttcacctccaattcttgcggcatggactggtatcgccaggctccgggcaaggagcgtgagttcgtgtccagtatttctacggacggcactaccgggtacgctgactccgttaagggccgctttaccattagcaaagacaaggcgaaggacacagtctatctccagatgaatagtctgaagccggaggataccggcatgtactcatgcaaaacaaaggatggcacgattgcgacaatggagctgtgcgacttcgggtattggggccagggcacgcaggtgacggtgtcctcc

SEQ ID NO: 1499 - DNA, 783 bp, synthetic construct
  source 1..783: mol_type = other DNA; note = Description of Artificial Sequence: Synthetic polynucleotide
caggtacagctccaggaatccggtgggggttcagttcaggccgggggtagccttcggctgtcctgccgcgcgagtggctccacctatagcaactactgcctgggatggttccgccagaccacaggcaaggagcgtgagggcgtcgctgtaataaattgggttgggggaatgttgtactttgcggacagtgtgaagggacgtttcaccgtcagtcaggaccaggccaagaacaccgtttacctccagatgaacagcctcaagcccgaggataccgccatgtattactgcgcggctgagtctgtttcttccttctcttgtgggggctggctgaccaggcccgacagagtcccatactggggccaggggacccaggtgacagttagctccggcggtggctcacaggtgcagctgcaagagagcggcggtggctccgtccaagcgggcgggtcactcagactgtcttgcgcagctagtggttacccgtattcaaacggttacatgggatggtttagacaggcaccaggcaaagagcgcgaaggcgtcgctaccatctacacaggagatggccgcacctattacgccgacagcgtgaaaggcaggtttacaattagtcgcgacaacgccaagaacactgtcgatcttcagatgtcttccttgaagccagaagacaccgccatgtattactgtgcagcgcgggcagccccactttattccagcggctctcccctcacccgcgcccggtataacgtctggggccaaggtactcaggtgaccgtgagttct

SEQ ID NO: 1500 - DNA, 801 bp, synthetic construct
  source 1..801: mol_type = other DNA; note = Description of Artificial Sequence: Synthetic polynucleotide
caggtgcagttgcaggaatcaggtggaggctctgtgcaggccggtggatctctgcggctcagctgccgggcgtccgggagcacttacagcaattactgtttggggtggtttcggcagaccactggtaaggagagagagggagtggccgttatcaactgggtcggaggtatgctctacttcgctgacagcgtcaagggacgcttcaccgtgtcccaggaccaggctaagaataccgtttatctccagatgaatagcctgaagcctgaggacaccgctatgtattactgtgcggctgagagcgtcagctctttctcctgcggtggatggctcacacgccccgaccgtgtcccatattggggacaaggcactcaggtgaccgtcagctcaggaggcagcgggggtagcgggggttccggccaagtgcagctccaggagtctgggggcggaagcgtgcaggccggtgggagcttgcgcctgtcctgtgctgcgtctggctacccttacagtaacggctatatgggctggttccggcaggcccctggcaaggaaagggagggtgtggccactatctacactggtgatggtaggacatattacgccgatagcgtgaagggccggttcacgatctctcgtgataacgccaaaaataccgtggatcttcagatgtcatccctcaagcccgaggataccgctatgtactattgcgcagcccgcgctgccccgctctacagcagtggaagcccgttgacccgcgcccgttacaacgtgtggggtcagggcacacaagtcactgtctcctca

SEQ ID NO: 1501 - DNA, 756 bp, synthetic construct
  source 1..756: mol_type = other DNA; note = Description of Artificial Sequence: Synthetic polynucleotide
caagtccaacttcaggagtcagggggaggttctgttcaagccgggggttcactgaggctctcttgccgcgcctccggctcaacatactccaactattgtctgggctggttcaggcagacaaccgggaaggagcgcgagggtgtggccgtcatcaactgggtcggcgggatgctgtactttgcagattccgtgaagggccggtttacagtgagccaggaccaggctaagaacaccgtgtacctgcaaatgaactctctgaaacccgaggatacagcgatgtattactgcgctgcggagtccgtgtctagcttctcttgcgggggctggctgacccgtcctgatagagtcccatactggggacaggggacacaggtgaccgtgagcagtgggggtggcagccaggtgcagcttcaggaaagcggaggtggctcagtacaggcgggaggcagtctgcgcctgtcttgcgtggcctccgcatccacctattgcacctacgacatgcactggtacaggcaggcacctggcaagggtcgcgagtttgtcagtgctatcgactccgacggcaccactcggtacgcagattccgtcaagggccggtttaccatctcccagggcacagctaaaaacactgtttacctccaaatgaactccctccagcctgaggataccgctatgtattactgcaagacagtctgtgtagtgggctcccgttggtccgattactggggccaggggacccaagttacggtttctagc

SEQ ID NO: 1502 - DNA, 774 bp, synthetic construct
  source 1..774: mol_type = other DNA; note = Description of Artificial Sequence: Synthetic polynucleotide
caagtccaactccaggaaagcgggggtggctcagtccaagcagggggctctctcagactgagttgcagggcaagcggttccacctactcaaactactgcctcggttggtttcggcagactaccggcaaggaaagggagggcgtggcggtcattaactgggtagggggtatgctctactttgcagactccgtgaagggcagatttacagtatcccaggaccaggctaagaacacggtgtacctgcaaatgaactctctgaagccagaggacaccgccatgtactattgcgcggcagagtcagtgagcagtttttcttgtgggggctggctcacccgcccggaccgcgtgccttactggggacaaggaacgcaggttacagtctcttccggcggaagcgggggcagtggtggcagcggtcaggttcagcttcaggagagtggcggaggcagcgtgcaggcagggggttccctgaggctgtcctgtgtggcctctgcgagtacgtattgcacctacgacatgcactggtatcgccaggctcctggtaagggccgtgagttcgtgtccgccatcgacagcgacggaaccacacggtacgctgattccgtgaaaggcaggttcactatttcccaaggaactgccaaaaacactgtctacctccagatgaacagcctccagcctgaggatacagccatgtactattgcaagactgtgtgcgtggtcggctctcgttggtccgactactggggccagggcacccaggtcaccgtgtccagt

SEQ ID NO: 1503 - DNA, 750 bp, synthetic construct
  source 1..750: mol_type = other DNA; note = Description of Artificial Sequence: Synthetic polynucleotide
caggtgcagctccaggagagcggtggcgggagtgttcaggcgggcggtagcctgagactgtcatgcagagcatctggctctacgtactctaactactgtcttggctggttccgccagacgaccggaaaggagcgtgagggcgtcgctgtgattaactgggtgggcgggatgttgtacttcgccgattccgtgaagggcagattcactgtgagccaggatcaggctaagaacactgtgtaccttcagatgaacagcttgaagcccgaagacactgccatgtactattgtgcagctgaatctgtgagcagtttctcatgcggtgggtggcttaccagaccggatagagtgccttactggggccaggggacccaggttaccgtgtctagcgggggtggatctcaggtgcagctccaggagtccggcgggggctccgttcaggctgggggtagtctcactctgtcctgtgccgcttctgagtacgcctacagtacatgcaacatgggctggtatcgccaggctccggggaaggaacgcgaacttgtgagcgccttcatctccgatggctctacctattacgccgactccgtgaagggcaggtttaccatcactcgcgacaacgctaagaacactgtctacttgcagatgaactcactgaaacccgaggatactgccatctattactgttccgctaactgctataggcggctgagaaactattggggacaggggacccaggtgactgtctctagc

SEQ ID NO: 1504 - DNA, 768 bp, synthetic construct
  source 1..768: mol_type = other DNA; note = Description of Artificial Sequence: Synthetic polynucleotide
caagtgcaactccaggaaagtggaggtggctccgtgcaagccggaggcagtctccgcctgagctgtcgtgcgagcggttccacctatagcaactactgcctgggatggtttagacagacaaccgggaaggagcgggagggagtcgcggtgataaattgggtgggcggtatgctgtacttcgcggattctgtcaaggggagattcaccgtgagccaggatcaggcgaagaacactgtgtaccttcagatgaactctctcaagccggaggacacagccatgtactattgtgctgccgagtctgtttcatccttctcctgtggcggttggctgacccgcccagatcgcgtgccttactggggccagggtactcaggtcaccgtctcttccgggggttcaggcggtagcggtggctccggccaggttcaactccaggaaagcggaggcggttctgtgcaagccgggggctccctgaccctgtcctgtgctgccagcgagtacgcctatagcacttgtaacatgggatggtatcgccaggccccaggaaaagaacgcgagcttgtgagtgcttttatctctgacgggtccacctattacgcggactctgtgaaaggtcgcttcacaatcacccgcgataacgcaaagaacactgtctaccttcagatgaactccctgaagcccgaggacactgcgatttattactgtagcgccaactgttaccgccgtctccgcaactactggggacaggggacccaggtgaccgtctcatcc

SEQ ID NO: 1505 - DNA, 771 bp, synthetic construct
  source 1..771: mol_type = other DNA; note = Description of Artificial Sequence: Synthetic polynucleotide
caggtccaacttcaggagtctggcggaggcagcgtgcaagcgggtgggagcctgcgcctttcctgccgcgcgtctggcagcacctactccaactactgcctgggatggtttcgccagaccacaggtaaggagcgtgaaggtgtggccgtcatcaactgggtcggcggtatgctgtatttcgctgattccgttaagggcagatttactgtgagtcaggaccaggcaaagaacacagtgtaccttcagatgaatagcctgaagcccgaagacactgccatgtactattgcgcagccgaatctgtgtctagcttttcctgcggtgggtggctgacccgccctgatcgcgtgccatactgggggcagggcacccaggtgactgtatcttccgggggaggctcccaggtccagttgcaggagtccggcggaggcctggtacagcctggtggatctctccgcctctcttgcaccgcgtccgggcttaccttcgatgactctgtcatgggctggtttcggcaggctcctggtaagggccgtgaagccgtgtcctgcatctcctcttcaggagcgaacgctttctatgctgatagcgttaaaggccgtttcaccatctcccgtgataacgctaagaacaccctctaccttcaaatgaactccctcaagccagaggacaccgccacatattactgtaaacgcggccatgcttgcgcgggatattaccccatcccttatgacgattactggggtcaagggacacaggtcactgtcagctcc

SEQ ID NO: 1506 - DNA, 789 bp, synthetic construct
  source 1..789: mol_type = other DNA; note = Description of Artificial Sequence: Synthetic polynucleotide
caggtgcaacttcaggagtccggtggcggttccgtgcaggctggtggcagcctgaggctgagctgtcgcgccagcgggtccacctactctaactattgtctgggatggttccggcagaccacaggcaaggagcgcgagggagtcgctgtaatcaactgggtaggtgggatgctgtacttcgccgatagtgtaaaaggccgcttcaccgtgtcacaggaccaagccaagaacacagtctacctccagatgaactccctgaagccagaggacaccgccatgtattactgcgccgctgaatccgtcagctctttctcttgcggcggttggctgacccgccccgaccgtgtcccctactggggccagggcactcaggtgactgtgagcagtggtggcagcgggggctccggtggaagcggccaggttcagctccaggaatccgggggcggactcgtccagccagggggcagcctgcggctgtcctgcaccgcaagcggcctgaccttcgacgatagcgtcatgggatggttccgtcaagcccctggcaaggggagggaggccgtcagctgtattagctctagcggcgctaacgccttctatgccgattctgttaagggtaggttcacaatctcccgcgacaacgccaaaaatacgctgtatctccagatgaacagcctgaagcccgaggacaccgcaacctattactgtaagaggggacacgcatgtgccggttattaccctatcccctacgatgactactgggggcaaggtactcaggtcaccgtttcctca

SEQ ID NO: 1507 - DNA, 786 bp, synthetic construct
  source 1..786: mol_type = other DNA; note = Description of Artificial Sequence: Synthetic polynucleotide
caggtgcaacttcaggagagtggaggcggtagcgtccaagctgggggttccctgagactttcatgtagagcttcccgttctccttacggaaattactgtctgggctggttccgccagtccactggtaaggaacgcgagggtgtggctgtgataaattgggtgggtggaatgctgtactttgccgactctgttaagggtagattcactgtgtcccaagatcatgccaagaacaccgtcacccttcagatgaactccctgaagccggaagacaccgctatgtactattgtgctgccgagtccgtgtcctctttctcttgcggcggttggctgaccagaccggacagggttccgtattggggccaaggcacccaggtcactgtgagttctggagggggttcccaggtccaactccaagaaagcggaggcggttccgtccaggctggcggttctctgcgcctgagctgcaccgccagcggggccattgcgtctggttacatcgacagtagatggtgtatggcgtggtttcggcaggctcctggaaaggaacgcgagggcgttgctgccatctggccagggggtggcctgacagtctatgcggactccgtgaaggggcgcttcaccattagcagagaccacgcaaaaaacactctgtatttgcagatgaataacctgaagcccgaagacactgccatgtactattgtgctgccggttctccgcgcatgtgcccatccctggagttcggattcgactactggggacagggcacccaggtgacggtgtccagt

SEQ ID NO: 1508 - DNA, 804 bp, synthetic construct
  source 1..804: mol_type = other DNA; note = Description of Artificial Sequence: Synthetic polynucleotide
caggtccagttgcaggagtcagggggcggtagcgtccaggcagggggcagcctgcgcctgtcctgccgggccagcagaagcccctacggaaattactgtctgggctggttccggcagagcactgggaaggagcgcgagggcgtcgccgtaatcaactgggtcggcgggatgctgtatttcgccgacagtgtgaagggacgctttactgtgagtcaggaccacgcaaagaatacagtcacgttgcagatgaactccctgaagcctgaggacaccgctatgtactattgcgcggctgagtcagtgtctagcttcagctgtggtggctggctcactcgtcctgatcgcgtaccatattggggtcaggggactcaggtcaccgtgagtagcggcggaagtggaggcagcggtgggagcggccaagttcagttgcaggagagcggcgggggctctgtgcaggctggtggctccctgcgtctgtcctgcaccgcgtccggggccatcgccagcggatacatcgacagtaggtggtgtatggcatggttccgtcaggcccctggtaaggagcgcgagggcgtggccgctatttggccgggtgggggactcaccgtgtatgctgactccgtaaagggtcgcttcactatctctcgcgatcacgccaagaacaccctgtacttgcagatgaacaatctgaagcccgaggacaccgctatgtattactgcgcagctggaagccccaggatgtgtccgagcctggagttcggcttcgactactgggggcaggggactcaggtgaccgtgtcctct

SEQ ID NO: 1509 - DNA, 768 bp, synthetic construct
  source 1..768: mol_type = other DNA; note = Description of Artificial Sequence: Synthetic polynucleotide
caagtccagcttcaggaaagcggcggtggaagcgtgcaggctggaggcagcctgagactcagctgccgcgcttcaaggtccccctacggtaactactgcctgggctggtttcgccagagtacaggcaaggaaagggaaggtgtggccgttatcaactgggtgggcggtatgctgtactttgccgactccgtcaagggccgttttacagtgtcccaggaccacgccaagaacacggtcacgcttcagatgaacagcctgaagcccgaggacaccgctatgtattactgtgctgccgagtccgttagcagtttctcctgcggcggatggctgacccgccctgaccgcgttccctactgggggcagggcactcaggtgacggtcagctctgggggcgggtcccaggttcagctgcaagagagtggtggaggctccgtacaggccgggggatctcttcgcctgtcctgtactgctccgggcttcacgagtaactcctgtgggatggactggtatcgccaagcgcccggcaaggagcgcgagttcgtaagtagcatctcaacagacggcacgaccggctacgccgattccgtgaagggccgctttaccattagcaaggacaaggccaaggacactgtgtatctgcaaatgaactccctgaaacccgaggatacgggcatgtactcttgcaagactaaggatggcacgattgccacaatggagctgtgcgatttcggatattggggccagggcacccaggtgactgtctcctct

SEQ ID NO: 1510 - DNA, 786 bp, synthetic construct
  source 1..786: mol_type = other DNA; note = Description of Artificial Sequence: Synthetic polynucleotide
caggtgcaacttcaggaaagtgggggcggttccgtgcaggcagggggctctctgcgtctgtcttgcagagccagcaggtctccttatggtaactactgcctcgggtggtttcgtcagtctaccggaaaggagcgcgaaggagtcgcagtgataaattgggtcggcggtatgctctatttcgccgacagcgtcaaggggcgtttcaccgtcagccaagatcacgctaagaacaccgtaacactgcaaatgaactccctcaaacctgaagacacggctatgtattactgcgcagcggaaagtgtgagcagtttcagttgtggtggatggctgacccgcccagatcgcgtcccttactgggggcagggcacccaggtgactgtctccagtggagggtccggtggcagcgggggaagcggccaggtgcagttgcaggagtctgggggcggttctgtccaggctggaggtagcctccgcctgtcttgcacagcccccggctttacgtccaactcttgtggcatggactggtatcggcaggctccaggcaaagaacgcgagttcgtcagctctatctctactgatggaactacaggatacgcagacagcgttaaggggcgtttcaccatctccaaagataaagctaaggacaccgtttacctgcaaatgaactcactgaagccagaggatacaggtatgtactcttgcaagactaaggatgggaccatcgccactatggaactgtgtgatttcggctactggggccagggcacccaggtcaccgtgagcagc

SEQ ID NO: 1511 - DNA, 783 bp, synthetic construct
  source 1..783: mol_type = other DNA; note = Description of Artificial Sequence: Synthetic polynucleotide
caggtgcaactgcaagaaagtggcggtggaagcgtgcaggcaggtggaagcctgcgcctctcttgtcgtgcttccagaagtccgtatggcaattattgtctgggctggtttagacagtccactggtaaggaaagggaaggagtggctgtcatcaactgggtgggcggtatgctgtacttcgccgattccgtcaagggccgtttcacagtctcccaagaccatgcaaagaacacagtgacactccagatgaactccctcaagcccgaggacactgctatgtattactgcgccgctgagtctgtctccagcttctcttgcggcggatggctgactcgcccggatcgcgttccctattggggccaggggacgcaggtgaccgtgtcctcaggcgggggctcccaggttcagctccaggagtctggcgggggctcagtacaggccggtggctccctccgcctctcatgcgcagcctccggctacccgtatagcaacggttacatgggctggttcaggcaggcccctgggaaggaacgcgagggcgtggcgactatctacactggcgacggtaggacttattacgctgattcagtgaagggcaggttcacaatttctcgcgacaacgctaaaaataccgtggatctccagatgtccagcctgaaacctgaggatactgccatgtattactgtgccgctcgcgcagctcctctgtatagtagcggcagccccttgacccgcgctagatacaatgtctggggtcagggcacccaggtaaccgttagttcc

SEQ ID NO: 1512 - DNA, 801 bp, synthetic construct
  source 1..801: mol_type = other DNA; note = Description of Artificial Sequence: Synthetic polynucleotide
caggtacaacttcaggaaagcggaggtgggtccgtgcaggccggtggctcactgcgcttgagttgtcgcgccagccgctccccttatgggaactactgccttgggtggttccgccagagcactggaaaggagcgcgagggcgtcgcagtcatcaactgggttggcgggatgctctatttcgccgacagcgtgaaagggcggtttaccgttagccaagaccacgccaagaacacagtgacccttcaaatgaactccctgaagcccgaagacaccgctatgtactattgcgccgcagagtcagtctccagttttagctgcggaggctggttgactcgccctgaccgcgtgccttattggggccagggcacccaggtgacagtaagcagtggaggcagcggcggttccggtggaagcggccaggtgcagcttcaggagagcggcggtggcagtgttcaggctggcgggtccctgaggctgtcctgtgctgcctccggctacccctactccaacggttacatgggttggttccgccaagcgccaggaaaggaacgcgagggtgtggctaccatctacaccggcgatggtcgcacttattacgctgacagcgtgaaaggccggttcacaatcagccgggacaacgccaagaacacagtggacctgcaaatgtccagtttgaagcctgaagacacagccatgtattactgtgcggctcgggccgcgcccctctacagctccggctcaccactgacacgcgcgagatacaacgtgtggggacagggcacccaggtgacagttagcagc

SEQ ID NO: 1513 - DNA, 756 bp, synthetic construct
  source 1..756: mol_type = other DNA; note = Description of Artificial Sequence: Synthetic polynucleotide
caggttcagttgcaggagtctggtggcggttccgtccaggctggcggaagtctgcgcctcagttgtcgtgccagccgctctccttacggcaactattgcctcggctggttccggcagtccactggcaaggagagggaaggagtcgccgttatcaactgggtgggtggaatgctctactttgctgatagcgtgaagggccgcttcacagtttctcaggaccatgcgaagaacactgttactttgcagatgaactccctgaagccagaggatacggctatgtattactgtgcagccgagtccgtgagttccttttcctgcgggggttggctcacccgtcctgaccgtgtgccttattggggccagggtacgcaagtcaccgtaagtagcggagggggcagccaggtccagttgcaggagtccggcggaggctccgtgcaggccgggggttctctgcgtctctcatgtgtggcatctgcttctacttactgcacttacgacatgcactggtatcggcaggctcctgggaaaggacgggagttcgttagtgccatcgacagcgacggcactacacgctatgctgattccgttaagggccgctttacgatttcacaggggacggccaagaacactgtgtacctccagatgaactctttgcagcctgaggacacggctatgtattactgcaaaaccgtttgtgtagtgggcagccgctggtcagactattggggccagggcacacaggtcaccgtgagttct

SEQ ID NO: 1514 - DNA, 774 bp, synthetic construct
  source 1..774: mol_type = other DNA; note = Description of Artificial Sequence: Synthetic polynucleotide
caggtgcaactgcaagagtccggcggaggctccgtgcaggctggtggctcactccggctctcctgtcgcgcctctcgcagcccttatgggaattactgcctgggttggttccgtcagagtaccggcaaggagcgtgagggagtcgcagtaatcaactgggtcggaggtatgctgtacttcgccgactccgtgaagggaaggttcactgtgtcccaggaccacgccaagaacacggtaacgctccagatgaactccctgaagcccgaagacaccgctatgtattactgtgctgccgagtccgtgtcctcattctcctgcggcggttggctgacacgcccagaccgcgtgccctattggggacagggtacacaggttaccgtcagctctggcgggtctggtggcagtgggggctccggtcaggtgcagttgcaggagtccggcggaggctctgtgcaggctggtgggagtctgcgcctgtcttgcgtcgccagcgccagtacttattgtacttacgacatgcactggtatagacaggcccccggtaagggaagggagttcgtgtcagctatcgacagcgatgggaccactagatatgcggatagcgtcaaggggcgcttcaccatctcccagggaaccgcaaaaaacactgtctaccttcagatgaacagcctccagcctgaggacacggctatgtattactgcaagaccgtgtgtgtcgttggatctcgctggtctgactattgggggcagggcacccaggtgacggtgtccagc

SEQ ID NO: 1515 - DNA, 750 bp, synthetic construct
  source 1..750: mol_type = other DNA; note = Description of Artificial Sequence: Synthetic polynucleotide
caggttcagctccaggagtctggagggggcagcgtgcaggcgggagggtctcttcgtcttagctgccgtgccagtcgctccccctacggtaactactgcctggggtggtttcgccagagtaccggcaaggagcgcgaaggtgtggctgtaatcaactgggttgggggtatgctgtatttcgccgactccgtgaaaggtaggtttacagtgagccaggaccacgctaagaacaccgtcaccctccagatgaactctctcaaaccggaggataccgctatgtattactgcgctgccgagagtgtgagtagcttctcttgtggcggttggctgaccaggcctgaccgcgtaccctactggggccagggcacccaggtcacagtcagctctggtggaggctcacaggtgcagcttcaggagtccggcgggggcagcgtgcaggccgggggctcactgaccctgagctgtgctgccagcgaatacgcatactctacctgcaatatgggctggtatcggcaggcccctgggaaagaaagggaactggtttctgcctttatcagcgatggatcaacatattacgccgactccgtgaaagggaggttcacgatcacccgcgacaacgccaagaacactgtgtacctccaaatgaacagcctgaagcctgaggacaccgcgatctattactgctctgctaactgctaccgcaggctgcgcaattattggggtcaaggcacccaggttaccgtgtcttcc

SEQ ID NO: 1516 - DNA, 768 bp, synthetic construct
  source 1..768: mol_type = other DNA; note = Description of Artificial Sequence: Synthetic polynucleotide
caggtccagctccaggagtctggcggaggctccgtgcaggctggaggcagcctcagactttcttgcagagcttcccggtctccctatggaaactactgcttgggttggttccgccaatccactggcaaggagagggagggtgttgctgtcatcaactgggtgggcgggatgctttatttcgccgacagtgtcaagggacggttcaccgtctctcaggatcacgccaagaacactgtgaccttgcagatgaactcactcaaacccgaagataccgctatgtactattgtgccgcagaaagcgtgtctagcttcagctgtggtggctggctcacacgccctgaccgggtgccatactggggccagggcacgcaggtgaccgtaagctcaggcgggagtggtggctctggaggctctggacaggtgcagctccaggagagcgggggcgggagcgtgcaggctggcggtagtctgaccctgtcatgcgctgcaagcgaatacgcctacagcacctgcaatatggggtggtatcgtcaggctcctggcaaggagcgtgagctggtttccgccttcatctccgatggctctacctattacgccgactcagtgaagggccgcttcactatcactagggacaatgccaagaacacagtatacctccagatgaactctctgaagccagaggatactgccatctattactgtagcgccaactgttatcgtcgcctgcgcaactattggggtcaaggcacacaggtgacagtctctagc

SEQ ID NO: 1517 - DNA, 771 bp, synthetic construct
  source 1..771: mol_type = other DNA; note = Description of Artificial Sequence: Synthetic polynucleotide
caggtgcaactccaggaatccgggggtggatcagtacaggcaggcggaagcctgaggctgtcttgtcgcgcttcccgttctccctacggaaattactgtctgggctggttccggcagtccactggaaaagagagggagggagtggccgttatcaactgggtaggaggtatgctgtactttgccgacagcgtgaaaggaaggttcaccgtgagccaggaccacgccaagaataccgtgaccttgcagatgaacagcctgaagcccgaagacactgccatgtactattgtgccgctgagagtgtatcatctttctcctgcggtggctggttgactcgcccagacagagtgccttattgggggcagggcactcaggtgaccgtgtcttccggtggaggctcccaggttcaacttcaggagtccggtggaggcctggtacagcctggcggatctctcaggctcagctgcactgcctctggactgaccttcgatgactctgttatgggctggtttaggcaggcccctggaaaaggccgggaggcggtcagctgcatcagctctagcggggccaatgcgttttacgctgattccgtgaagggccgcttcactatctctagggacaacgcgaagaacaccctctacttgcagatgaactccctcaagcccgaggacacggcgacttattactgcaaaagaggacacgcttgtgccggatattacccgattccctatgatgactattggggccagggcacccaggtgacagtgagcagc

SEQ ID NO: 1518 - DNA, 789 bp, synthetic construct
  source 1..789: mol_type = other DNA; note = Description of Artificial Sequence: Synthetic polynucleotide
caggtgcaactccaggaaagcggcggtggaagcgtgcaggctggagggtccctcagactgagttgccgggcctcacggtccccctatgggaactattgcctgggttggttccgtcagtccactggcaaggagcgcgagggcgtggccgttatcaactgggtgggagggatgctgtactttgcagacagcgttaagggtcggtttaccgtgagccaggaccacgccaagaataccgtgaccttgcagatgaactccctgaagcctgaggacaccgccatgtattactgcgctgccgaatccgtgtctagctttagctgtgggggctggctcaccagacctgatcgcgtgccgtactggggccagggcactcaagtgacggtcagctccggtggaagcggtggctccggcggttccgggcaggtgcagttgcaggagtcagggggagggttggttcagcccggtggctccttgcgtctgtcctgtactgcaagcgggctgaccttcgacgattctgtgatgggctggtttcgtcaggctcctggcaagggcagagaggcggtgagctgtatctccagctccggcgctaatgccttctacgcagacagtgttaagggtaggtttactatctccagggacaatgctaaaaacactctgtatcttcagatgaacagcctgaagccggaggatactgctacctattactgtaagcggggccatgcttgcgccgggtactatccaatcccctacgatgactattggggtcaaggcacacaggtgacagtgtcctcc

SEQ ID NO: 1519 - DNA, 768 bp, synthetic construct
  source 1..768: mol_type = other DNA; note = Description of Artificial Sequence: Synthetic polynucleotide
caggtccagttgcaggagagcggtgggggcctggtgcagcctggcggttccctgcgcctgtcttgtgctgcgagcgggttcactttcagccattctggtatgagttgggtacgccaggctccaggcaagggcctggaatgggtgagcaccatcaactctggaggtgcctctacttattacaccgacagtgtcaagggacgctttacaatctccagagacaacgcgaagaatatgctttacttgcagctcaactcactgaagaccgaggatactgccatgtattactgcgctaagggaggctcaggatatggtgatgcctctcgcatgacctctcctggctcacagggaacccaggtgaccgtcagttccggtggaggttctcaggtccagctccaggagtccggcggtggcagcgtgcaggccggaggcagcctgcgcctgtcatgcacagcctctggcgctatcgccagtggttacatcgacagcaggtggtgcatggcctggttcagacaggcccctggtaaggaacgcgagggagttgctgccatttggccaggcggtggcctgacagtgtacgccgatagcgtcaaggggcgcttcactatctcacgggatcacgctaaaaacactttgtacctccagatgaataacctcaaaccagaggacaccgcgatgtattactgcgctgcgggctctccccgcatgtgtccctctctggagttcgggttcgattattggggtcagggaacgcaggtgactgtgtcctcc

SEQ ID NO: 1520 - DNA, 786 bp, synthetic construct
  source 1..786: mol_type = other DNA; note = Description of Artificial Sequence: Synthetic polynucleotide
caggtgcagcttcaggagtccgggggaggcctggttcagcccggcggttctctccgcctcagctgtgccgcttccgggtttacattcagccacagtggaatgtcttgggtacgtcaagcgccaggtaagggcctggagtgggtctctacaatcaacagcggtggcgcaagtacatactataccgactccgtgaaagggcggtttaccatctcccgtgacaacgctaagaatatgctctatcttcagctgaactcactcaagactgaggatactgctatgtattactgtgcgaaagggggatctgggtacggcgatgcgagccgcatgacctcccccggcagtcagggcactcaagtgaccgtatcatccgggggttccggtggctcaggaggtagcggccaggttcaactgcaagagagtggcgggggctccgtgcaggcgggcggttccctcaggctctcttgcactgcaagcggcgctattgcgagtgggtacatcgactccagatggtgtatggcctggttccgccaggcacctggcaaggagcgcgaaggcgtggcagccatctggcctgggggcggtcttaccgtctacgctgactccgtgaaaggccgcttcactatttctcgcgaccatgccaagaacaccctgtacttgcaaatgaataacctgaagcctgaagacaccgcgatgtattactgcgccgctggatctcccaggatgtgcccgagcctggagttcggtttcgactactggggccaaggcacacaggttacagtctcctcc

SEQ ID NO: 1521 - DNA, 750 bp, synthetic construct
  source 1..750: mol_type = other DNA; note = Description of Artificial Sequence: Synthetic polynucleotide
caagtgcagctccaggagagcggtggcggtctcgtgcaaccaggaggttccttgcggctgagctgtgccgcgtcaggttttacatttagccacagtgggatgtcttgggtgagacaggctccgggtaagggtctcgaatgggtcagtactatcaattccggcggagcaagcacatactataccgactctgtcaaggggagatttaccatctccagagacaatgccaaaaacatgctgtatttgcaactcaacagtctgaagaccgaagacaccgcgatgtattactgcgccaagggcggttccgggtacggagacgcgagccgcatgacttcccctggatctcagggcacccaggtgactgtctccagcggtggcggttcccaagtccaactccaggaaagcggaggcggttctgtgcaggcaggcgggtcccttcggttgagctgtaccgcacccggctttaccagcaactcttgtggtatggactggtatcggcaggctcctggcaaagagcgcgagttcgtgtcttccatttccaccgacggcactaccgggtacgcggattccgtgaagggcaggttcacgatcagcaaggataaggcaaaagatactgtttatctccagatgaactcactcaagcccgaagacactggcatgtactcctgcaagaccaaagacggcaccattgccactatggagctgtgcgattttggctactggggtcagggcacccaggtcaccgtgtcatcc

SEQ ID NO: 1522 - DNA, 768 bp, synthetic construct
  source 1..768: mol_type = other DNA; note = Description of Artificial Sequence: Synthetic polynucleotide
caggtgcagcttcaggagagtggtgggggtctggttcagcctgggggtagcctgaggctgagttgtgccgcgagcggatttactttctctcatagcggcatgagttgggtgcgccaggcccctggcaagggtctggaatgggtgagtacaatcaactctggcggtgcctctacctattacaccgacagcgtgaaggggagattcactattagccgcgacaatgctaagaatatgctctatcttcagctgaactccctgaaaaccgaagacaccgcaatgtattactgtgcaaagggtggaagcggctacggcgacgccagccgcatgacttcccccggctctcagggaactcaggttaccgtctcttccggcggtagcgggggctctggaggctctggccaggttcagttgcaggaaagtggaggcggttcagttcaggctggaggcagcttgcgcttgtcctgtaccgcgccaggcttcacaagtaatagctgtggcatggattggtatcgtcaggcaccgggaaaggagcgcgagtttgtgtctagcatcagcacagacgggacaaccggctatgcggattccgtaaaaggacggtttactatctccaaggataaggctaaggacacagtgtacctgcaaatgaacagcctgaagcccgaagatactggtatgtatagctgcaagaccaaggatggcacaatcgccactatggagctgtgtgacttcggctattggggtcagggcacccaggtgacagtgtcttct

SEQ ID NO: 1523 - DNA, 765 bp, synthetic construct
  source 1..765: mol_type = other DNA; note = Description of Artificial Sequence: Synthetic polynucleotide
caggtgcagctccaggaaagcggaggtggcctggtacagcccggcggtagtctgaggctgagttgtgctgcctcaggttttactttctcacactccgggatgtcctgggtgagacaagcgccgggcaagggcctggagtgggtatcaactattaacagtggcggggcgtctacctattacactgacagcgtgaagggccggttcactatcagcagagataacgctaaaaatatgttgtatcttcagctcaattccctgaaaaccgaagataccgcgatgtattactgtgctaaagggggttctggatacggcgatgcgtctcgcatgacctctcctggaagccagggcacccaggtcaccgtgtctagtggcggaggtagtcaggttcagctccaagagtccggcggaggtagcgtccaggccgggggctcactccgcctgtcctgcgcagccagcggatacccctattcaaacggctacatgggctggttccgccaggcccccggaaaagagcgtgaaggagtggctacaatctataccggcgacgggaggacctattacgcagattccgtgaaaggccgtttcaccatctcccgtgacaacgccaaaaataccgtggaccttcagatgagttctctgaagccagaggacaccgctatgtactattgtgctgccagagctgcaccactgtattcctctggcagccccctgaccagagcccgctacaacgtctggggacagggcacccaggtcacagtcagctct

SEQ ID NO: 1524 - DNA, 783 bp, synthetic construct
  source 1..783: mol_type = other DNA; note = Description of Artificial Sequence: Synthetic polynucleotide
caggttcagctccaggaatctggcggtggcctcgttcagccgggtggcagtcttcgtctgagctgtgcagcctctggcttcaccttctctcactccggcatgagctgggtcagacaggccccaggcaagggtctggagtgggtgtctacgatcaatagcggaggcgcttctacctattacaccgacagcgtgaagggcagatttaccatttcccgtgacaacgccaaaaacatgctgtatctgcaactgaactctctgaagaccgaggacaccgccatgtactattgcgctaagggcggtagcggatatggcgacgcgagcagaatgacttctccggggagccagggtacacaggtgaccgtgtccagcggcggtagtgggggcagcggtggcagcggacaggtccagttgcaggaatccggcggaggcagcgtgcaggctggcggttcactgagactctcttgcgcggccagcggctatccctattctaacggttatatgggctggtttaggcaggctcccggcaaggaaagggagggcgtggctactatctatactggcgatggccgcacttactatgccgatagtgtcaagggccgtttcactatctctcgcgacaacgctaagaacacagtggatcttcagatgtcttccctgaagccagaggataccgcgatgtattactgtgccgcgagggctgcaccactgtactctagcggatctcccctgacccgcgccagatacaacgtgtggggccaggggacgcaggttaccgtttcttct

SEQ ID NO: 1525 - DNA, 738 bp, synthetic construct
  source 1..738: mol_type = other DNA; note = Description of Artificial Sequence: Synthetic polynucleotide
caggtgcagttgcaggagagtggaggcggactggtgcagccaggaggttcactgcgtctttcttgcgcagccagcggttttacattcagccactctggaatgtcttgggttcgccaggcaccggggaagggcctggagtgggtgtccacaatcaacagtgggggtgcctctacttactatacagactccgtgaaaggcaggtttaccatctccagggacaacgccaaaaatatgctttatcttcagctcaattctctgaagaccgaggatactgcgatgtattactgtgcaaaagggggctcaggatatggcgatgcctcccgcatgaccagcccagggagccagggcacccaggtgaccgtctccagtggcggaggctctcaggtgcagctccaggagtcaggcggtggctccgtccaggctggcgggagcttgcgcttgtcctgtgttgcctccgctagtacctattgcacctatgatatgcactggtacagacaggctccgggtaagggccgtgagttcgtgtccgccattgatagcgacggcacaactcgctacgctgattccgtgaaaggccgcttcaccattagccagggcaccgctaagaacacagtgtacttgcagatgaacagcttgcagccagaggataccgcgatgtattactgcaaaactgtgtgcgtagtgggcagtagatggtccgactactggggccagggcacacaggtcaccgtgagcagc

SEQ ID NO: 1526 - DNA, 756 bp, synthetic construct
  source 1..756: mol_type = other DNA; note = Description of Artificial Sequence: Synthetic polynucleotide
caggtacagctccaagagtctggcggtggcctggtgcaaccagggggctcattgagattgtcttgcgccgcttctggattcacattctcccactcaggtatgagttgggtgcggcaagccccaggcaagggcctggagtgggtttctaccatcaacagtgggggagctagtacctactatacagactccgtgaaaggccgcttcaccattagccgcgataacgctaagaacatgctgtacttgcagctcaattccctgaagaccgaggacacagctatgtactattgcgccaagggaggcagtggttacggggacgccagccggatgacctctcccggctctcaagggacgcaggttaccgtgtcaagcggcggttccggtgggtccggtggctccggtcaagtgcagctccaggagagtgggggtggcagcgtccaggccggaggctccctcaggctgtcctgcgtggcctctgccagcacatattgcacatacgacatgcactggtatcgtcaggctcctggcaaagggcgcgagttcgtgtccgctattgattccgatggtacaacccggtacgctgacagtgtgaagggccgtttcacaattagccagggcaccgctaaaaacaccgtgtacctccagatgaactccctccaacctgaggatactgccatgtattactgcaaaacggtgtgcgtcgtgggctctcgctggtccgattactgggggcagggcactcaggtgaccgtgtccagc

SEQ ID NO: 1527 - DNA, 732 bp, synthetic construct
  source 1..732: mol_type = other DNA; note = Description of Artificial Sequence: Synthetic polynucleotide
caggtgcagttgcaggagagcggaggcgggctggtgcagcctggaggctctctgcgcctgtcctgcgcagcctcaggatttacattctctcacagtgggatgtcttgggtgcggcaggctccgggcaaaggcctggaatgggtgtccaccattaactctggtggcgcgagcacttactataccgatagtgtcaaaggccgcttcaccatcagccgggacaacgctaagaacatgctgtatctccagctgaacagcctgaagaccgaagacactgctatgtattactgtgccaagggcggttcaggttatggggacgcctctcggatgacatcaccgggctcccaaggaactcaggtcaccgtcagcagtggcggtggctcccaggtgcaacttcaggagtccgggggtggaagcgtgcaggctggaggctccctgacactgtcttgcgctgccagcgaatacgcttattccacctgtaacatggggtggtatcgccaagctcctgggaaggaacgtgaactggtcagtgccttcatctctgatgggtccacgtattacgctgattcagtaaagggacgtttcacaatcacccgcgacaacgccaaaaacactgtgtacttgcagatgaacagcctgaagccagaggataccgctatctactattgcagcgccaactgttaccgtcggctgcgcaactactgggggcagggcacacaagtcacagtgtccagc

SEQ ID NO: 1528 - DNA, 750 bp, synthetic construct
  source 1..750: mol_type = other DNA; note = Description of Artificial Sequence: Synthetic polynucleotide
caggtccagctccaggagtcagggggtggacttgttcaacccggtggctccctccgtctctcctgtgctgcgtctggtttcaccttcagccactctggaatgagctgggttagacaagcacctggcaaaggcctcgaatgggtctctaccatcaacagcggcggagcctccacttattacaccgactccgtgaagggtcgcttcacgatcagcagagacaacgccaagaacatgctgtacctccaactgaatagcctgaaaaccgaggatactgccatgtattactgtgcaaagggcggaagtggttacggagacgccagcaggatgacatctccgggttctcaaggcacccaggtcaccgtgagtagcggcggatctgggggcagcggaggcagcggccaggtgcagcttcaggaaagcggagggggttccgttcaggccgggggctcactgacactgagttgcgcggcctccgaatacgcctattctacttgtaacatgggctggtacagacaagctcctgggaaggagagagaactggtgagcgcttttatttctgacggctcaacctattacgcagactccgtcaagggccgcttcaccattacccgcgacaacgctaagaatacggtgtacctccagatgaactccctgaagcccgaagacaccgcaatttactattgcagcgccaactgctaccgccggttgcgcaactactggggccagggaactcaggttaccgtatcctcc

SEQ ID NO: 1529 - DNA, 753 bp, synthetic construct
  source 1..753: mol_type = other DNA; note = Description of Artificial Sequence: Synthetic polynucleotide
caggtgcaactccaggagtccggcggtggactggtgcagcctggcggtagcttgaggctgtcttgcgccgcatccggcttcacattcagccactctggaatgtcatgggtcagacaggctccgggcaagggcctggaatgggtctcaaccatcaatagtggaggtgcctcaacttactataccgactccgtgaaaggtcgtttcacaatttcacgcgacaacgctaagaacatgctgtacctccagctgaatagtctcaaaactgaggacaccgctatgtattactgtgctaagggcggttccgggtatggggacgcctccaggatgacttcaccgggtagccaggggacccaggtgacggtttctagcgggggcgggtcccaggtgcagcttcaggaaagcggagggggcctggtgcagcccggcgggtccctgagactgagctgcacggcaagcggcctgacgtttgatgactccgtgatgggctggttcagacaggcccccggcaaggggcgcgaagccgtctcctgtattagctccagcggggccaacgctttctacgcggacagcgtcaaaggccgcttcaccattagcagagacaacgctaagaacactctgtacctccagatgaacagcctgaaaccagaggataccgcaacgtattactgcaagcgcggacatgcttgcgcgggctattacccaatcccttatgacgattactggggccagggcactcaggtgacggtaagctcc

SEQ ID NO: 1530 - DNA, 771 bp, synthetic construct
  source 1..771: mol_type = other DNA; note = Description of Artificial Sequence: Synthetic polynucleotide
caggtccaactccaggagtccggcggtggcctggttcagccaggaggttccctgcgcctgtcctgtgccgcttccggctttaccttctcccattccggcatgagctgggtgaggcaggcccctggcaaaggcctggagtgggtgtctaccattaactctggcggagccagcacatactatacagactcagtaaagggacgcttcaccatcagcagggacaacgccaaaaacatgctgtatctccagctgaactctctcaagaccgaagacaccgctatgtattactgtgctaagggcggtagcggctatggggacgcatctcgtatgacctctcccggctctcaaggcacccaggtgactgtgtctagtggtgggtctggcgggtctggcggatctggtcaagtccagttgcaggagagtggaggcggtctcgtccagccaggcggaagcctgcgcctgtcttgtactgccagcggtttgacctttgatgactctgtgatgggctggtttcgtcaggcccccggcaagggccgtgaggccgtgtcatgtatctcatcttcaggagccaacgccttttatgccgatagcgtgaaagggagattcaccatctctcgtgataacgcaaagaacaccctgtaccttcagatgaactctctgaagcctgaggacactgctacctactattgtaagcgtgggcacgcctgcgctggatattaccctatcccttacgatgactattgggggcagggcactcaggtgaccgtcagcagc

SEQ ID NO: 1531 - protein, 6 aa, synthetic construct
  source 1..6: note = Description of Artificial Sequence: Synthetic 6xHis tag
HHHHHH

SEQ ID NO: 1532 - protein, 4 aa, synthetic construct
  source 1..4: note = Description of Artificial Sequence: Synthetic peptide
  REGION 1..4: note = See specification as filed for detailed description of substitutions and preferred embodiments
GGGS

SEQ ID NO: 1533 - protein, 4 aa, synthetic construct
  source 1..4: note = Description of Artificial Sequence: Synthetic peptide
  REGION 1..4: note = See specification as filed for detailed description of substitutions and preferred embodiments
GGSG

SEQ ID NO: 1534 - protein, 5 aa, synthetic construct
  source 1..5: note = Description of Artificial Sequence: Synthetic peptide
  REGION 1..5: note = See specification as filed for detailed description of substitutions and preferred embodiments
GGGGS

SEQ ID NO: 1535 - protein, 800 aa, synthetic construct
  source 1..800: note = Description of Artificial Sequence: Synthetic polypeptide
  VARIANT 1..20: note = SITE - This region may encompass 1-20 residues
  VARIANT 21..40: note = SITE - This region may encompass 1-20 residues
  VARIANT 41..60: note = SITE - This region may encompass 1-20 residues
  VARIANT 61..80: note = SITE - This region may encompass 1-20 residues
  VARIANT 81..100: note = SITE - This region may encompass 1-20 residues
  VARIANT 101..120: note = SITE - This region may encompass 1-20 residues
  VARIANT 121..140: note = SITE - This region may encompass 1-20 residues
  VARIANT 141..160: note = SITE - This region may encompass 1-20 residues
  VARIANT 161..180: note = SITE - This region may encompass 1-20 residues
  VARIANT 181..200: note = SITE - This region may encompass 1-20 residues
  VARIANT 201..220: note = SITE - This region may encompass 1-20 residues
  VARIANT 221..240: note = SITE - This region may encompass 1-20 residues
  VARIANT 241..260: note = SITE - This region may encompass 1-20 residues
  VARIANT 261..280: note = SITE - This region may encompass 1-20 residues
  VARIANT 281..300: note = SITE - This region may encompass 1-20 residues
  VARIANT 301..320: note = SITE - This region may encompass 1-20 residues
  VARIANT 321..340: note = SITE - This region may encompass 1-20 residues
  VARIANT 341..360: note = SITE - This region may encompass 1-20 residues
  VARIANT 361..380: note = SITE - This region may encompass 1-20 residues
  VARIANT 381..400: note = SITE - This region may encompass 1-20 residues
  VARIANT 401..420: note = SITE - This region may encompass 1-20 residues
  VARIANT 421..440: note = SITE - This region may encompass 1-20 residues
  VARIANT 441..460: note = SITE - This region may encompass 1-20 residues
  VARIANT 461..480: note = SITE - This region may encompass 1-20 residues
  VARIANT 481..500: note = SITE - This region may encompass 1-20 residues
  VARIANT 501..520: note = SITE - This region may encompass 1-20 residues
  VARIANT 521..540: note = SITE - This region may encompass 1-20 residues
  VARIANT 541..560: note = SITE - This region may encompass 1-20 residues
  VARIANT 561..580: note = SITE - This region may encompass 1-20 residues
  VARIANT 581..600: note = SITE - This region may encompass 1-20 residues
  VARIANT 601..620: note = SITE - This region may encompass 1-20 residues
  VARIANT 621..640: note = SITE - This region may encompass 1-20 residues
  VARIANT 641..660: note = SITE - This region may encompass 1-20 residues
  VARIANT 661..680: note = SITE - This region may encompass 1-20 residues
  VARIANT 681..700: note = SITE - This region may encompass 1-20 residues
  VARIANT 701..720: note = SITE - This region may encompass 1-20 residues
  VARIANT 721..740: note = SITE - This region may encompass 1-20 residues
  VARIANT 741..760: note = SITE - This region may encompass 1-20 residues
  VARIANT 761..780: note = SITE - This region may encompass 1-20 residues
  VARIANT 781..800: note = SITE - This region may encompass 1-20 residues
  VARIANT 1..800: note = SITE - This sequence may encompass 1-20 (Gly)m(Ser)o repeating units, wherein m = 1 to 20, o = 1 to 20
  REGION 1..800: note = See specification as filed for detailed description of substitutions and preferred embodiments
GGGGGGGGGGGGGGGGGGGGSSSSSSSSSSSSSSSSSSSSGGGGGGGGGGGGGGGGGGGGSSSSSSSSSSSSSSSSSSSSGGGGGGGGGGGGGGGGGGGGSSSSSSSSSSSSSSSSSSSSGGGGGGGGGGGGGGGGGGGGSSSSSSSSSSSSSSSSSSSSGGGGGGGGGGGGGGGGGGGGSSSSSSSSSSSSSSSSSSSSGGGGGGGGGGGGGGGGGGGGSSSSSSSSSSSSSSSSSSSSGGGGGGGGGGGGGGGGGGGGSSSSSSSSSSSSSSSSSSSSGGGGGGGGGGGGGGGGGGGGSSSSSSSSSSSSSSSSSSSSGGGGGGGGGGGGGGGGGGGGSSSSSSSSSSSSSSSSSSSSGGGGGGGGGGGGGGGGGGGGSSSSSSSSSSSSSSSSSSSSGGGGGGGGGGGGGGGGGGGGSSSSSSSSSSSSSSSSSSSSGGGGGGGGGGGGGGGGGGGGSSSSSSSSSSSSSSSSSSSSGGGGGGGGGGGGGGGGGGGGSSSSSSSSSSSSSSSSSSSSGGGGGGGGGGGGGGGGGGGGSSSSSSSSSSSSSSSSSSSSGGGGGGGGGGGGGGGGGGGGSSSSSSSSSSSSSSSSSSSSGGGGGGGGGGGGGGGGGGGGSSSSSSSSSSSSSSSSSSSSGGGGGGGGGGGGGGGGGGGGSSSSSSSSSSSSSSSSSSSSGGGGGGGGGGGGGGGGGGGGSSSSSSSSSSSSSSSSSSSSGGGGGGGGGGGGGGGGGGGGSSSSSSSSSSSSSSSSSSSSGGGGGGGGGGGGGGGGGGGGSSSSSSSSSSSSSSSSSSSS

SEQ ID NO: 1536 - protein, 100 aa, synthetic construct
  source 1..100: note = Description of Artificial Sequence: Synthetic polypeptide
  VARIANT 1..100: note = SITE - This sequence may encompass 1-20 Gly Ser Gly Gly Ser repeating units
  REGION 1..100: note = See specification as filed for detailed description of substitutions and preferred embodiments
GSGGSGSGGSGSGGSGSGGSGSGGSGSGGSGSGGSGSGGSGSGGSGSGGSGSGGSGSGGSGSGGSGSGGSGSGGSGSGGSGSGGSGSGGSGSGGSGSGGS

SEQ ID NO: 1537 - protein, 1200 aa, synthetic construct
  source 1..1200: note = Description of Artificial Sequence: Synthetic polypeptide
  VARIANT 1..20: note = SITE - This region may encompass 1-20 residues
  VARIANT 21..40: note = SITE - This region may encompass 1-20 residues
  VARIANT 41..60: note = SITE - This region may encompass 1-20 residues
  VARIANT 61..80: note = SITE - This region may encompass 1-20 residues
  VARIANT 81..100: note = SITE - This region may encompass 1-20 residues
  VARIANT 101..120: note = SITE - This region may encompass 1-20 residues
  VARIANT 121..140: note = SITE - This region may encompass 1-20 residues
  VARIANT 141..160: note = SITE - This region may encompass 1-20 residues
  VARIANT 161..180: note = SITE - This region may encompass 1-20 residues
  VARIANT 181..200: note = SITE - This region may encompass 1-20 residues
  VARIANT 201..220: note = SITE - This region may encompass 1-20 residues
  VARIANT 221..240: note = SITE - This region may encompass 1-20 residues
  VARIANT 241..260: note = SITE - This region may encompass 1-20 residues
  VARIANT 261..280: note = SITE - This region may encompass 1-20 residues
  VARIANT 281..300: note = SITE - This region may encompass 1-20 residues
  VARIANT 301..320: note = SITE - This region may encompass 1-20 residues
  VARIANT 321..340: note = SITE - This region may encompass 1-20 residues
  VARIANT 341..360: note = SITE - This region may encompass 1-20 residues
  VARIANT 361..380: note = SITE - This region may encompass 1-20 residues
  VARIANT 381..400: note = SITE - This region may encompass 1-20 residues
  VARIANT 401..420: note = SITE - This region may encompass 1-20 residues
  VARIANT 421..440: note = SITE - This region may encompass 1-20 residues
  VARIANT 441..460: note = SITE - This region may encompass 1-20 residues
  VARIANT 461..480: note = SITE - This region may encompass 1-20 residues
  VARIANT 481..500: note = SITE - This region may encompass 1-20 residues
  VARIANT 501..520: note = SITE - This region may encompass 1-20 residues
  VARIANT 521..540: note = SITE - This region may encompass 1-20 residues
  VARIANT 541..560: note = SITE - This region may encompass 1-20 residues
  VARIANT 561..580: note = SITE - This region may encompass 1-20 residues
  VARIANT 581..600: note = SITE - This region may encompass 1-20 residues
  VARIANT 601..620: note = SITE - This region may encompass 1-20 residues
  VARIANT 621..640: note = SITE - This region may encompass 1-20 residues
  VARIANT 641..660: note = SITE - This region may encompass 1-20 residues
  VARIANT 661..680: note = SITE - This region may encompass 1-20 residues
  VARIANT 681..700: note = SITE - This region may encompass 1-20 residues
  VARIANT 701..720: note = SITE - This region may encompass 1-20 residues
  VARIANT 721..740: note = SITE - This region may encompass 1-20 residues
  VARIANT 741..760: note = SITE - This region may encompass 1-20 residues
  VARIANT 761..780: note = SITE - This region may encompass 1-20 residues
  VARIANT 781..800: note = SITE - This region may encompass 1-20 residues
  VARIANT 801..820: note = SITE - This region may encompass 1-20 residues
  VARIANT 821..840: note = SITE - This region may encompass 1-20 residues
  VARIANT 841..860: note = SITE - This region may encompass 1-20 residues
  VARIANT 861..880: note = SITE - This region may encompass 1-20 residues
  VARIANT 881..900: note = SITE - This region may encompass 1-20 residues
  VARIANT 901..920: note = SITE - This region may encompass 1-20 residues
  VARIANT 921..940: note = SITE - This region may encompass 1-20 residues
  VARIANT 941..960: note = SITE - This region may encompass 1-20 residues
  VARIANT 961..980: note = SITE - This region may encompass 1-20 residues
  VARIANT 981..1000: note = SITE - This region may encompass 1-20 residues
  VARIANT 1001..1020: note = SITE - This region may encompass 1-20 residues
  VARIANT 1021..1040: note = SITE - This region may encompass 1-20 residues
  VARIANT 1041..1060: note = SITE - This region may encompass 1-20 residues
  VARIANT 1061..1080: note = SITE - This region may encompass 1-20 residues
  VARIANT 1081..1100: note = SITE - This region may encompass 1-20 residues
  VARIANT 1101..1120: note = SITE - This region may encompass 1-20 residues
  VARIANT 1121..1140: note = SITE - This region may encompass 1-20 residues
  VARIANT 1141..1160: note = SITE - This region may encompass 1-20 residues
  VARIANT 1161..1180: note = SITE - This region may encompass 1-20 residues
  VARIANT 1181..1200: note = SITE - This region may encompass 1-20 residues
  VARIANT 1..1200: note = SITE - This sequence may encompass 1-20 (Gly)m(Ser)o(Gly)m repeating units, wherein m = 1 to 20, o = 1 to 20
  REGION 1..1200: note = See specification as filed for detailed description of substitutions and preferred embodiments
GGGGGGGGGGGGGGGGGGGGSSSSSSSSSSSSSSSSSSSSGGGGGGGGGGGGGGGGGGGGGGGGGGGGGGGGGGGGGGGGSSSSSSSSSSSSSSSSSSSSGGGGGGGGGGGGGGGGGGGGGGGGGGGGGGGGGGGGGGGGSSSSSSSSSSSSSSSSSSSSGGGGGGGGGGGGGGGGGGGGGGGGGGGGGGGGGGGGGGGGSSSSSSSSSSSSSSSSSSSSGGGGGGGGGGGGGGGGGGGGGGGGGGGGGGGGGGGGGGGGSSSSSSSSSSSSSSSSSSSSGGGGGGGGGGGGGGGGGGGGGGGGGGGGGGGGGGGGGGGGSSSSSSSSSSSSSSSSSSSSGGGGGGGGGGGGGGGGGGGGGGGGGGGGGGGGGGGGGGGGSSSSSSSSSSSSSSSSSSSSGGGGGGGGGGGGGGGGGGGGGGGGGGGGGGGGGGGGGGGGSSSSSSSSSSSSSSSSSSSSGGGGGGGGGGGGGGGGGGGGGGGGGGGGGGGGGGGGGGGGSSSSSSSSSSSSSSSSSSSSGGGGGGGGGGGGGGGGGGGGGGGGGGGGGGGGGGGGGGGGSSSSSSSSSSSSSSSSSSSSGGGGGGGGGGGGGGGGGGGGGGGGGGGGGGGGGGGGGGGGSSSSSSSSSSSSSSSSSSSSGGGGGGGGGGGGGGGGGGGGGGGGGGGGGGGGGGGGGGGGSSSSSSSSSSSSSSSSSSSSGGGGGGGGGGGGGGGGGGGGGGGGGGGGGGGGGGGGGGGGSSSSSSSSSSSSSSSSSSSSGGGGGGGGGGGGGGGGGGGGGGGGGGGGGGGGGGGGGGGGSSSSSSSSSSSSSSSSSSSSGGGGGGGGGGGGGGGGGGGGGGGGGGGGGGGGGGGGGGGGSSSSSSSSSSSSSSSSSSSSGGGGGGGGGGGGGGGGGGGGGGGGGGGGGGGGGGGGGGGGSSSSSSSSSSSSSSSSSSSSGGGGGGGGGGGGGGGGGGGGGGGGGGGGGGGGGGGGGGGGSSSSSSSSSSSSSSSSSSSSGGGGGGGGGGGGGGGGGGGGGGGGGGGGGGGGGGGGGGGGSSSSSSSSSSSSSSSSSSSSGGGGGGGGGGGGGGGGGGGGGGGGGGGGGGGGGGGGGGGGSSSSSSSSSSSSSSSSSSSSGGGGGGGGGGGGGGGGGGGGGGGGGGGGGGGGGGGGGGGGSSSSSSSSSSSSSSSSSSSSGGGGGGGGGGGGGGGGGGGG

SEQ ID NO: 1538 - protein, 2000 aa, synthetic construct
  source 1..2000: note = Description of Artificial Sequence: Synthetic polypeptide
  VARIANT 1..20: note = SITE - This region may encompass 1-20 residues
  VARIANT 21..40: note = SITE - This region may encompass 1-20 residues
  VARIANT 41..60: note = SITE - This region may encompass 1-20 residues
  VARIANT 61..80: note = SITE - This region may encompass 1-20 residues
  VARIANT 81..100: note = SITE - This region may encompass 1-20 residues
  VARIANT 101..120: note = SITE - This region may encompass 1-20 residues
  VARIANT 121..140: note = SITE - This region may encompass 1-20 residues
  VARIANT 141..160: note = SITE - This region may encompass 1-20 residues
  VARIANT 161..180: note = SITE - This region may encompass 1-20 residues
  VARIANT 181..200: note = SITE - This region may encompass 1-20 residues
  VARIANT 201..220: note = SITE - This region may encompass 1-20 residues
  VARIANT 221..240: note = SITE - This region may encompass 1-20 residues
  VARIANT 241..260: note = SITE - This region may encompass 1-20 residues
  VARIANT 261..280: note = SITE - This region may encompass 1-20 residues
  VARIANT 281..300: note = SITE - This region may encompass 1-20 residues
  VARIANT 301..320: note = SITE - This region may encompass 1-20 residues
  VARIANT 321..340: note = SITE - This region may encompass 1-20 residues
  VARIANT 341..360: note = SITE - This region may encompass 1-20 residues
  VARIANT 361..380: note = SITE - This region may encompass 1-20 residues
  VARIANT 381..400: note = SITE - This region may encompass 1-20 residues
  VARIANT 401..420: note = SITE - This region may encompass 1-20 residues
  VARIANT 421..440: note = SITE - This region may encompass 1-20 residues
  VARIANT 441..460: note = SITE - This region may encompass 1-20 residues
  VARIANT 461..480: note = SITE - This region may encompass 1-20 residues
  VARIANT 481..500: note = SITE - This region may encompass 1-20 residues
  VARIANT 501..520: note = SITE - This region may encompass 1-20 residues
  VARIANT 521..540: note = SITE - This region may encompass 1-20 residues
  VARIANT 541..560: note = SITE - This region may encompass 1-20 residues
  VARIANT 561..580: note = SITE - This region may encompass 1-20 residues
  VARIANT 581..600: note = SITE - This region may encompass 1-20 residues
  VARIANT 601..620: note = SITE - This region may encompass 1-20 residues
  VARIANT 621..640: note = SITE - This region may encompass 1-20 residues
  VARIANT 641..660: note = SITE - This region may encompass 1-20 residues
  VARIANT 661..680: note = SITE - This region may encompass 1-20 residues
  VARIANT 681..700: note = SITE - This region may encompass 1-20 residues
  VARIANT 701..720: note = SITE - This region may encompass 1-20 residues
  VARIANT 721..740: note = SITE - This region may encompass 1-20 residues
  VARIANT 741..760: note = SITE - This region may encompass 1-20 residues
  VARIANT 761..780: note = SITE - This region may encompass 1-20 residues
  VARIANT 781..800: note = SITE - This region may encompass 1-20 residues
  VARIANT 801..820: note = SITE - This region may encompass 1-20 residues
  VARIANT 821..840: note = SITE - This region may encompass 1-20 residues
  VARIANT 841..860: note = SITE - This region may encompass 1-20 residues
  VARIANT 861..880: note = SITE - This region may encompass 1-20 residues
  VARIANT 881..900: note = SITE - This region may encompass 1-20 residues
  VARIANT 901..920: note = SITE - This region may encompass 1-20 residues
  VARIANT 921..940: note = SITE - This region may encompass 1-20 residues
  VARIANT 941..960: note = SITE - This region may encompass 1-20 residues
  VARIANT 961..980: note = SITE - This region may encompass 1-20 residues
  VARIANT 981..1000: note = SITE - This region may encompass 1-20 residues
  VARIANT 1001..1020: note = SITE - This region may encompass 1-20 residues
  VARIANT 1021..1040: note = SITE - This region may encompass 1-20 residues
  VARIANT 1041..1060: note = SITE - This region may encompass 1-20 residues
  VARIANT 1061..1080: note = SITE - This region may encompass 1-20 residues
  VARIANT 1081..1100: note = SITE - This region may encompass 1-20 residues
  VARIANT 1101..1120: note = SITE - This region may encompass 1-20 residues
  VARIANT 1121..1140: note = SITE - This region may encompass 1-20 residues
  VARIANT 1141..1160: note = SITE - This region may encompass 1-20 residues
  VARIANT 1161..1180: note = SITE - This region may encompass 1-20 residues
  VARIANT 1181..1200: note = SITE - This region may encompass 1-20 residues
  VARIANT 1201..1220: note = SITE - This region may encompass 1-20 residues
  VARIANT 1221..1240: note = SITE - This region may encompass 1-20 residues
  VARIANT 1241..1260: note = SITE - This region may encompass 1-20 residues
  VARIANT 1261..1280: note = SITE - This region may encompass 1-20 residues
  VARIANT 1281..1300: note = SITE - This region may encompass 1-20 residues
  VARIANT 1301..1320: note = SITE - This region may encompass 1-20 residues
  VARIANT 1321..1340: note = SITE - This region may encompass 1-20 residues
  VARIANT 1341..1360: note = SITE - This region may encompass 1-20 residues
  VARIANT 1361..1380: note = SITE - This region may encompass 1-20 residues
  VARIANT 1381..1400: note = SITE - This region may encompass 1-20 residues
  VARIANT 1401..1420: note = SITE - This region may encompass 1-20 residues
  VARIANT 1421..1440: note = SITE - This region may encompass 1-20 residues
  VARIANT 1441..1460: note = SITE - This region may encompass 1-20 residues
  VARIANT 1461..1480: note = SITE - This region may encompass 1-20 residues
  VARIANT 1481..1500: note = SITE - This region may encompass 1-20 residues
  VARIANT 1501..1520: note = SITE - This region may encompass 1-20 residues
  VARIANT 1521..1540: note = SITE - This region may encompass 1-20 residues
  VARIANT 1541..1560: note = SITE - This region may encompass 1-20 residues
  VARIANT 1561..1580: note = SITE - This region may encompass 1-20 residues
  VARIANT 1581..1600: note = SITE - This region may encompass 1-20 residues
  VARIANT 1601..1620: note = SITE - This region may encompass 1-20 residues
  VARIANT 1621..1640: note = SITE - This region may encompass 1-20 residues
  VARIANT 1641..1660: note = SITE - This region may encompass 1-20 residues
  VARIANT 1661..1680: note = SITE - This region may encompass 1-20 residues
  VARIANT 1681..1700: note = SITE - This region may encompass 1-20 residues
  VARIANT 1701..1720: note = SITE - This region may encompass 1-20 residues
  VARIANT 1721..1740: note = SITE - This region may encompass 1-20 residues
  VARIANT 1741..1760: note = SITE - This region may encompass 1-20 residues
  VARIANT 1761..1780: note = SITE - This region may encompass 1-20 residues
  VARIANT 1781..1800: note = SITE - This region may encompass 1-20 residues
  VARIANT 1801..1820: note = SITE - This region may encompass 1-20 residues
  VARIANT 1821..1840: note = SITE - This region may encompass 1-20 residues
  VARIANT 1841..1860: note = SITE - This region may encompass 1-20 residues
  VARIANT 1861..1880: note = SITE - This region may encompass 1-20 residues
  VARIANT 1881..1900: note = SITE - This region may encompass 1-20 residues
  VARIANT 1901..1920: note = SITE - This region may encompass 1-20 residues
  VARIANT 1921..1940: note = SITE - This region may encompass 1-20 residues
  VARIANT 1941..1960: note = SITE - This region may encompass 1-20 residues
  VARIANT 1961..1980: note = SITE - This region may encompass 1-20 residues
  VARIANT 1981..2000: note = SITE - This region may encompass 1-20 residues
  VARIANT 1..2000: note = SITE - This sequence may encompass 1-20 (Gly)m(Ser)o(Gly)m(Ser)o(Gly)m repeating units, wherein m = 1 to 20, o = 1 to 20
  REGION 1..2000: note = See specification as filed for detailed description of substitutions and preferred embodiments
GGGGGGGGGGGGGGGGGGGGSSSSSSSSSSSSSSSSSSSSGGGGGGGGGGGGGGGGGGGGSSSSSSSSSSSSSSSSSSSSGGGGGGGGGGGGGGGGGGGGGGGGGGGGGGGGGGGGGGGGSSSSSSSSSSSSSSSSSSSSGGGGGGGGGGGGGGGGGGGGSSSSSSSSSSSSSSSSSSSSGGGGGGGGGGGGGGGGGGGGGGGGGGGGGGGGGGGGGGGGSSSSSSSSSSSSSSSSSSSSGGGGGGGGGGGGGGGGGGGGSSSSSSSSSSSSSSSSSSSSGGGGGGGGGGGGGGGGGGGGGGGGGGGGGGGGGGGGGGGGSSSSSSSSSSSSSSSSSSSSGGGGGGGGGGGGGGGGGGGGSSSSSSSSSSSSSSSSSSSSGGGGGGGGGGGGGGGGGGGGGGGGGGGGGGGGGGGGGGGGSSSSSSSSSSSSSSSSSSSSGGGGGGGGGGGGGGGGGGGGSSSSSSSSSSSSSSSSSSSSGGGGGGGGGGGGGGGGGGGGGGGGGGGGGGGGGGGGGGGGSSSSSSSSSSSSSSSSSSSSGGGGGGGGGGGGGGGGGGGGSSSSSSSSSSSSSSSSSSSSGGGGGGGGGGGGGGGGGGGGGGGGGGGGGGGGGGGGGGGGSSSSSSSSSSSSSSSSSSSSGGGGGGGGGGGGGGGGGGGGSSSSSSSSSSSSSSSSSSSSGGGGGGGGGGGGGGGGGGGGGGGGGGGGGGGGGGGGGGGGSSSSSSSSSSSSSSSSSSSSGGGGGGGGGGGGGGGGGGGGSSSSSSSSSSSSSSSSSSSSGGGGGGGGGGGGGGGGGGGGGGGGGGGGGGGGGGGGGGGGSSSSSSSSSSSSSSSSSSSSGGGGGGGGGGGGGGGGGGGGSSSSSSSSSSSSSSSSSSSSGGGGGGGGGGGGGGGGGGGGGGGGGGGGGGGGGGGGGGGGSSSSSSSSSSSSSSSSSSSSGGGGGGGGGGGGGGGGGGGGSSSSSSSSSSSSSSSSSSSSGGGGGGGGGGGGGGGGGGGGGGGGGGGGGGGGGGGGGGGGSSSSSSSSSSSSSSSSSSSSGGGGGGGGGGGGGGGGGGGGSSSSSSSSSSSSSSSSSSSSGGGGGGGGGGGGGGGGGGGGGGGGGGGGGGGGGGGGGGGGSSSSSSSSSSSSSSSSSSSSGGGGGGGGGGGGGGGGGGGGSSSSSSSSSSSSSSSSSSSSGGGGGGGGGGGGGGGGGGGGGGGGGGGGGGGGGGGGGGGGSSSSSSSSSSSSSSSSSSSSGGGGGGGGGGGGGGGGGGGGSSSSSSSSSSSSSSSSSSSSGGGGGGGGGGGGGGGGGGGGGGGGGGGGGGGGGGGGGGGGSSSSSSSSSSSSSSSSSSSSGGGGGGGGGGGGGGGGGGGGSSSSSSSSSSSSSSSSSSSSGGGGGGGGGGGGGGGGGGGGGGGGGGGGGGGGGGGGGGGGSSSSSSSSSSSSSSSSSSSSGGGGGGGGGGGGGGGGGGGGSSSSSSSSSSSSSSSSSSSSGGGGGGGGGGGGGGGGGGGGGGGGGGGGGGGGGGGGGGGGSSSSSSSSSSSSSSSSSSSSGGGGGGGGGGGGGGGGGGGGSSSSSSSSSSSSSSSSSSSSGGGGGGGGGGGGGGGGGGGGGGGGGGGGGGGGGGGGGGGGSSSSSSSSSSSSSSSSSSSSGGGGGGGGGGGGGGGGGGGGSSSSSSSSSSSSSSSSSSSSGGGGGGGGGGGGGGGGGGGGGGGGGGGGGGGGGGGGGGGGSSSSSSSSSSSSSSSSSSSSGGGGGGGGGGGGGGGGGGGGSSSSSSSSSSSSSSSSSSSSGGGGGGGGGGGGGGGGGGGGGGGGGGGGGGGGGGGGGGGGSSSSSSSSSSSSSSSSSSSSGGGGGGGGGGGGGGGGGGGGSSSSSSSSSSSSSSSSSSSSGGGGGGGGGGGGGGGGGGGGGGGGGGGGGGGGGGGGGGGGSSSSSSSSSSSSSSSSSSSSGGGGGGGGGGGGGGGGGGGGSSSSSSSSSSSSSSSSSSSSGGGGGGGGGGGGGGGGGGGG

SEQ ID NO: 1539 - protein, 480 aa, synthetic construct
  source 1..480: note = Description of Artificial Sequence: Synthetic polypeptide
  VARIANT 5..24: note = SITE - This region may encompass 1-20 residues
  VARIANT 29..48: note = SITE - This region may encompass 1-20 residues
  VARIANT 53..72: note = SITE - This region may encompass 1-20 residues
  VARIANT 77..96: note = SITE - This region may encompass 1-20 residues
  VARIANT 101..120: note = SITE - This region may encompass 1-20 residues
  VARIANT 125..144: note = SITE - This region may encompass 1-20 residues
  VARIANT 149..168: note = SITE - This region may encompass 1-20 residues
  VARIANT 173..192: note = SITE - This region may encompass 1-20 residues
  VARIANT 197..216: note = SITE - This region may encompass 1-20 residues
  VARIANT 221..240: note = SITE - This region may encompass 1-20 residues
  VARIANT 245..264: note = SITE - This region may encompass 1-20 residues
  VARIANT 269..288: note = SITE - This region may encompass 1-20 residues
  VARIANT 293..312: note = SITE - This region may encompass 1-20 residues
  VARIANT 317..336: note = SITE - This region may encompass 1-20 residues
  VARIANT 341..360: note = SITE - This region may encompass 1-20 residues
  VARIANT 365..384: note = SITE - This region may encompass 1-20 residues
  VARIANT 389..408: note = SITE - This region may encompass 1-20 residues
  VARIANT 413..432: note = SITE - This region may encompass 1-20 residues
  VARIANT 437..456: note = SITE - This region may encompass 1-20 residues
  VARIANT 461..480: note = SITE - This region may encompass 1-20 residues
  VARIANT 1..480: note = SITE - This sequence may encompass 1-20 (Gly)(Ser)(Gly)(Gly)(Ser)m repeating units, wherein m = 1 to 20
  REGION 1..480: note = See specification as filed for detailed description of substitutions and preferred embodiments
GSGGSSSSSSSSSSSSSSSSSSSSGSGGSSSSSSSSSSSSSSSSSSSSGSGGSSSSSSSSSSSSSSSSSSSSGSGGSSSSSSSSSSSSSSSSSSSSGSGGSSSSSSSSSSSSSSSSSSSSGSGGSSSSSSSSSSSSSSSSSSSSGSGGSSSSSSSSSSSSSSSSSSSSGSGGSSSSSSSSSSSSSSSSSSSSGSGGSSSSSSSSSSSSSSSSSSSSGSGGSSSSSSSSSSSSSSSSSSSSGSGGSSSSSSSSSSSSSSSSSSSSGSGGSSSSSSSSSSSSSSSSSSSSGSGGSSSSSSSSSSSSSSSSSSSSGSGGSSSSSSSSSSSSSSSSSSSSGSGGSSSSSSSSSSSSSSSSSSSSGSGGSSSSSSSSSSSSSSSSSSSSGSGGSSSSSSSSSSSSSSSSSSSSGSGGSSSSSSSSSSSSSSSSSSSSGSGGSSSSSSSSSSSSSSSSSSSSGSGGSSSSSSSSSSSSSSSSSSSS

SEQ ID NO: 1540 - protein, 480 aa, synthetic construct
  source 1..480: note = Description of Artificial Sequence: Synthetic polypeptide
  VARIANT 4..23: note = SITE - This region may encompass 1-20 residues
  VARIANT 28..47: note = SITE - This region may encompass 1-20 residues
  VARIANT 52..71: note = SITE - This region may encompass 1-20 residues
  VARIANT 76..95: note = SITE - This region may encompass 1-20 residues
  VARIANT 100..119: note = SITE - This region may encompass 1-20 residues
  VARIANT 124..143: note = SITE - This region may encompass 1-20 residues
  VARIANT 148..167: note = SITE - This region may encompass 1-20 residues
  VARIANT 172..191: note = SITE - This region may encompass 1-20 residues
  VARIANT 196..215: note = SITE - This region may encompass 1-20 residues
  VARIANT 220..239: note = SITE - This region may encompass 1-20 residues
  VARIANT 244..263: note = SITE - This region may encompass 1-20 residues
  VARIANT 268..287: note = SITE - This region may encompass 1-20 residues
  VARIANT 292..311: note = SITE - This region may encompass 1-20 residues
  VARIANT 316..335: note = SITE - This region may encompass 1-20 residues
  VARIANT 340..359: note = SITE - This region may encompass 1-20 residues
  VARIANT 364..383: note = SITE - This region may encompass 1-20 residues
  VARIANT 388..407: note = SITE - This region may encompass 1-20 residues
  VARIANT 412..431: note = SITE - This region may encompass 1-20 residues
  VARIANT 436..455: note = SITE - This region may encompass 1-20 residues
  VARIANT 460..479: note = SITE - This region may encompass 1-20 residues
  VARIANT 1..480: note = SITE - This sequence may encompass 1-20 (Gly)(Ser)(Gly)(Ser)m(Gly) repeating units, wherein m = 1 to 20
  REGION 1..480: note = See specification as filed for detailed description of substitutions and preferred embodiments
GSGSSSSSSSSSSSSSSSSSSSSGGSGSSSSSSSSSSSSSSSSSSSSGGSGSSSSSSSSSSSSSSSSSSSSGGSGSSSSSSSSSSSSSSSSSSSSGGSGSSSSSSSSSSSSSSSSSSSSGGSGSSSSSSSSSSSSSSSSSSSSGGSGSSSSSSSSSSSSSSSSSSSSGGSGSSSSSSSSSSSSSSSSSSSSGGSGSSSSSSSSSSSSSSSSSSSSGGSGSSSSSSSSSSSSSSSSSSSSGGSGSSSSSSSSSSSSSSSSSSSSGGSGSSSSSSSSSSSSSSSSSSSSGGSGSSSSSSSSSSSSSSSSSSSSGGSGSSSSSSSSSSSSSSSSSSSSGGSGSSSSSSSSSSSSSSSSSSSSGGSGSSSSSSSSSSSSSSSSSSSSGGSGSSSSSSSSSSSSSSSSSSSSGGSGSSSSSSSSSSSSSSSSSSSSGGSGSSSSSSSSSSSSSSSSSSSSGGSGSSSSSSSSSSSSSSSSSSSSG

SEQ ID NO: 1541 - protein, 61 aa, synthetic construct
  source 1..61: note = Description of Artificial Sequence: Synthetic polypeptide
  VARIANT 1..60: note = SITE - This sequence may encompass 1-20 Gly Gly Ser repeating units
  REGION 1..61: note = See specification as filed for detailed description of substitutions and preferred embodiments
GGSGGSGGSGGSGGSGGSGGSGGSGGSGGSGGSGGSGGSGGSGGSGGSGGSGGSGGSGGSG

SEQ ID NO: 1542 - protein, 460 aa, synthetic construct
  source 1..460: note = Description of Artificial Sequence: Synthetic polypeptide
  VARIANT 4..23: note = SITE - This region may encompass 1-20 residues
  VARIANT 27..46: note = SITE - This region may encompass 1-20 residues
  VARIANT 50..69: note = SITE - This region may encompass 1-20 residues
  VARIANT 73..92: note = SITE - This region may encompass 1-20 residues
  VARIANT 96..115: note = SITE - This region may encompass 1-20 residues
  VARIANT 119..138: note = SITE - This region may encompass 1-20 residues
  VARIANT 142..161: note = SITE - This region may encompass 1-20 residues
  VARIANT 165..184: note = SITE - This region may encompass 1-20 residues
  VARIANT 188..207: note = SITE - This region may encompass 1-20 residues
  VARIANT 211..230: note = SITE - This region may encompass 1-20 residues
  VARIANT 234..253: note = SITE - This region may encompass 1-20 residues
  VARIANT 257..276: note = SITE - This region may encompass 1-20 residues
  VARIANT 280..299: note = SITE - This region may encompass 1-20 residues
  VARIANT 303..322: note = SITE - This region may encompass 1-20 residues
  VARIANT 326..345: note = SITE - This region may encompass 1-20 residues
  VARIANT 349..368: note = SITE - This region may encompass 1-20 residues
  VARIANT 372..391: note = SITE - This region may encompass 1-20 residues
  VARIANT 395..414: note = SITE - This region may encompass 1-20 residues
  VARIANT 418..437: note = SITE - This region may encompass 1-20 residues
  VARIANT 441..460: note = SITE - This region may encompass 1-20 residues
  VARIANT 1..460: note = SITE - This sequence may encompass 1-20 (Gly)(Gly)(Gly)(Ser)m repeating units, wherein m = 1 to 20
  REGION 1..460: note = See specification as filed for detailed description of substitutions and preferred embodiments
GGGSSSSSSSSSSSSSSSSSSSSGGGSSSSSSSSSSSSSSSSSSSSGGGSSSSSSSSSSSSSSSSSSSSGGGSSSSSSSSSSSSSSSSSSSSGGGSSSSSSSSSSSSSSSSSSSSGGGSSSSSSSSSSSSSSSSSSSSGGGSSSSSSSSSSSSSSSSSSSSGGGSSSSSSSSSSSSSSSSSSSSGGGSSSSSSSSSSSSSSSSSSSSGGGSSSSSSSSSSSSSSSSSSSSGGGSSSSSSSSSSSSSSSSSSSSGGGSSSSSSSSSSSSSSSSSSSSGGGSSSSSSSSSSSSSSSSSSSSGGGSSSSSSSSSSSSSSSSSSSSGGGSSSSSSSSSSSSSSSSSSSSGGGSSSSSSSSSSSSSSSSSSSSGGGSSSSSSSSSSSSSSSSSSSSGGGSSSSSSSSSSSSSSSSSSSSGGGSSSSSSSSSSSSSSSSSSSSGGGSSSSSSSSSSSSSSSSSSSS

SEQ ID NO: 1543 - protein, 100 aa, synthetic construct
  source 1..100: note = Description of Artificial Sequence: Synthetic polypeptide
  VARIANT 1..100: note = SITE - This sequence may encompass 1-50 Gly Ser repeating units
  REGION 1..100: note = See specification as filed for detailed description of substitutions and preferred embodiments
GSGSGSGSGSGSGSGSGSGSGSGSGSGSGSGSGSGSGSGSGSGSGSGSGSGSGSGSGSGSGSGSGSGSGSGSGSGSGSGSGSGSGSGSGSGSGSGSGSGS

SEQ ID NO: 1544 - protein, 250 aa, synthetic construct
  source 1..250: note = Description of Artificial Sequence: Synthetic polypeptide
  VARIANT 1..250: note = SITE - This sequence may encompass 1-50 Gly Ser Gly Gly Ser repeating units
  REGION 1..250: note = See specification as filed for detailed description of substitutions and preferred embodiments
GSGGSGSGGSGSGGSGSGGSGSGGSGSGGSGSGGSGSGGSGSGGSGSGGSGSGGSGSGGSGSGGSGSGGSGSGGSGSGGSGSGGSGSGGSGSGGSGSGGSGSGGSGSGGSGSGGSGSGGSGSGGSGSGGSGSGGSGSGGSGSGGSGSGGSGSGGSGSGGSGSGGSGSGGSGSGGSGSGGSGSGGSGSGGSGSGGSGSGGSGSGGSGSGGSGSGGSGSGGSGSGGSGSGGSGSGGSGSGGSGSGGSGSGGS

SEQ ID NO: 1545 - protein, 200 aa, synthetic construct
  source 1..200: note = Description of Artificial Sequence: Synthetic polypeptide
  VARIANT 1..200: note = SITE - This sequence may encompass 1-50 Gly Gly Gly Ser repeating units
  REGION 1..200: note = See specification as filed for detailed description of substitutions and preferred embodiments
GGGSGGGSGGGSGGGSGGGSGGGSGGGSGGGSGGGSGGGSGGGSGGGSGGGSGGGSGGGSGGGSGGGSGGGSGGGSGGGSGGGSGGGSGGGSGGGSGGGSGGGSGGGSGGGSGGGSGGGSGGGSGGGSGGGSGGGSGGGSGGGSGGGSGGGSGGGSGGGSGGGSGGGSGGGSGGGSGGGSGGGSGGGSGGGSGGGSGGGS

SEQ ID NO: 1546 - protein, 250 aa, synthetic construct
  source 1..250: note = Description of Artificial Sequence: Synthetic polypeptide
  VARIANT 1..250: note = SITE - This sequence may encompass 1-50 Gly Gly Gly Gly Ser repeating units
  REGION 1..250: note = See specification as filed for detailed description of substitutions and preferred embodiments
GGGGSGGGGSGGGGSGGGGSGGGGSGGGGSGGGGSGGGGSGGGGSGGGGSGGGGSGGGGSGGGGSGGGGSGGGGSGGGGSGGGGSGGGGSGGGGSGGGGSGGGGSGGGGSGGGGSGGGGSGGGGSGGGGSGGGGSGGGGSGGGGSGGGGSGGGGSGGGGSGGGGSGGGGSGGGGSGGGGSGGGGSGGGGSGGGGSGGGGSGGGGSGGGGSGGGGSGGGGSGGGGSGGGGSGGGGSGGGGSGGGGSGGGGS

SEQ ID NO: 1547 - protein, 6 aa, synthetic construct
  source 1..6: note = Description of Artificial Sequence: Synthetic His tag
  VARIANT 1..6: note = SITE - This sequence may encompass 3-6 residues
HHHHHH

What is claimed is:

1. An IL27 receptor (IL27R) binding protein that specifically binds to IL27Rα subunit (IL27Rα) and glycoprotein 130 subunit (gp130),
wherein the binding protein causes the multimerization of IL27Rα and gp130 when bound to IL27Rα and gp130, and
wherein the binding protein comprises a single-domain antibody (sdAb) that specifically binds to IL27Rα (an anti-IL27Rα sdAb) and a sdAb that specifically binds to gp130 (an anti-gp130 sdAb) and wherein the anti-IL27Rα sdAb is an anti-IL27Rα $V_H$H antibody and the anti-gp130 sdAb is an anti-gp130 $V_H$H antibody and
wherein the anti-gp130 $V_H$H antibody comprises a set of a CDR1, a CDR2, and a CDR3, wherein the set is selected from the group consisting of:
SEQ ID NO: 193, SEQ ID NO: 199, SEQ ID NO: 205, respectively;
SEQ ID NO: 194, SEQ ID NO: 200, SEQ ID NO: 206, respectively;
SEQ ID NO: 195, SEQ ID NO: 201, SEQ ID NO: 207, respectively;
SEQ ID NO: 196, SEQ ID NO: 202, SEQ ID NO: 208, respectively;
SEQ ID NO: 197, SEQ ID NO: 203, SEQ ID NO: 209, respectively; and
SEQ ID NO: 198, SEQ ID NO: 204, SEQ ID NO: 210, respectively; and
the anti-IL27Rα $V_H$H antibody comprises a set of a CDR1, a CDR2, and a CDR3, wherein the set is selected from the group consisting of
SEQ ID NO: 211, SEQ ID NO: 218, SEQ ID NO: 225, respectively;
SEQ ID NO: 212, SEQ ID NO: 219, SEQ ID NO: 226, respectively;
SEQ ID NO: 213, SEQ ID NO: 220, SEQ ID NO: 227, respectively;
SEQ ID NO: 214, SEQ ID NO: 221, SEQ ID NO: 228, respectively;
SEQ ID NO: 215, SEQ ID NO: 222, SEQ ID NO: 229, respectively;
SEQ ID NO: 216, SEQ ID NO: 223, SEQ ID NO: 230, respectively; and
SEQ ID NO: 217, SEQ ID NO: 224, SEQ ID NO: 231, respectively.

2. The IL27R binding protein of claim 1, wherein the anti-gp130 $V_H$H antibody comprises the set of CDR1, CDR2, and CDR3 comprising amino acid sequences of SEQ ID NO: 196, SEQ ID NO: 202, and SEQ ID NO: 208, respectively.

3. The IL27R binding protein of claim 2, wherein the anti-IL27Rα $V_H$H antibody CDR1 comprises the set of CDR1, CDR2, and CDR3 comprising amino acid sequences of SEQ ID NO: 214, SEQ ID NO: 221, SEQ ID NO: 228, respectively.

4. The IL27R binding protein of claim 2, wherein the anti-IL27Rα $V_H$H antibody CDR1 comprises the set of CDR1, CDR2, and CDR3 comprising amino acid sequences of SEQ ID NO: 216, SEQ ID NO: 223 and SEQ ID NO: 230, respectively.

5. An IL27 receptor (IL27R) binding protein that specifically binds to IL27Rα subunit (IL27Rα) and glycoprotein 130 subunit (gp130),
wherein the binding protein causes the multimerization of IL27Rα and gp130 when bound to IL27Rα and gp130, and
wherein the binding protein comprises a single-domain antibody (sdAb) that specifically binds to IL27Rα (an anti-IL27Rα sdAb) and a sdAb that specifically binds to gp130 (an anti-gp130 sdAb) and wherein the anti-IL27Rα sdAb is an anti-IL27Rα $V_H$H antibody and the anti-gp130 sdAb is an anti-gp130 $V_H$H antibody, and
wherein the IL27 receptor (IL27R) binding protein comprises an amino acid sequence of SEQ ID NO: 64.

6. An IL27 receptor (IL27R) binding protein that specifically binds to IL27Rα subunit (IL27Rα) and glycoprotein 130 subunit (gp130),
wherein the binding protein causes the multimerization of IL27Rα and gp130 when bound to IL27Rα and gp130, and
wherein the binding protein comprises a single-domain antibody (sdAb) that specifically binds to IL27Rα (an anti-IL27Rα sdAb) and a sdAb that specifically binds to gp130 (an anti-gp130 sdAb) and wherein the anti-IL27Rα sdAb is an anti-IL27Rα $V_H$H antibody and the anti-gp130 sdAb is an anti-gp130 $V_H$H antibody, and
wherein the IL27 receptor (IL27R) binding protein comprises an amino acid sequence of SEQ ID NO: 76.

\* \* \* \* \*